US011718879B2

(12) United States Patent
Firat et al.

(10) Patent No.: US 11,718,879 B2
(45) Date of Patent: Aug. 8, 2023

(54) NON-CODING RNAS (NCRNA) FOR THE DIAGNOSIS OF COGNITIVE DISORDERS

(71) Applicants: AMONETA DIAGNOSTICS, Huningue (FR); Hueseyin Firat, Huningue (FR); Saliha Moussaoui, Bartenheim (FR); Eric Schordan, Wentzwiller (FR)

(72) Inventors: Hueseyin Firat, Huningue (FR); Saliha Moussaoui, Bartenheim (FR); Eric Schordan, Wentzwiller (FR)

(73) Assignee: AMONETA DIAGNOSTICS, Huningue (FR)

( * ) Notice: Subject to any disclaimer, the term of this patent is extended or adjusted under 35 U.S.C. 154(b) by 42 days.

(21) Appl. No.: 16/644,812

(22) PCT Filed: Sep. 5, 2018

(86) PCT No.: PCT/EP2018/073905
§ 371 (c)(1),
(2) Date: Mar. 5, 2020

(87) PCT Pub. No.: WO2019/048500
PCT Pub. Date: Mar. 14, 2019

(65) Prior Publication Data
US 2021/0071252 A1 Mar. 11, 2021

Related U.S. Application Data

(60) Provisional application No. 62/554,427, filed on Sep. 5, 2017.

(51) Int. Cl.
*C12Q 1/6883* (2018.01)
(52) U.S. Cl.
CPC ..... *C12Q 1/6883* (2013.01); *C12Q 2600/158* (2013.01); *C12Q 2600/178* (2013.01)
(58) Field of Classification Search
None
See application file for complete search history.

(56) References Cited

U.S. PATENT DOCUMENTS

2018/0371548 A1   12/2018   Backes et al.

FOREIGN PATENT DOCUMENTS

| EP | 1 716 227 A2 | 11/2006 |
| EP | 3184646 A1 | 6/2017 |
| WO | WO 2013/024469 A1 | 2/2013 |
| WO | WO 2014/075911 A1 | 5/2014 |
| WO | WO 2015/031958 A1 | 3/2015 |
| WO | WO2015/179909 | 12/2015 |
| WO | WO 2020/049135 A1 | 12/2020 |

OTHER PUBLICATIONS

Tan (Mol Neurobiol 2013 47:382-393).*
Sarropoulos (Nature vol. 571 Jul. 25, 2019).*
Bolha (Disease Markers vol. 2017 Article ID 7243968, 14 pages pub May 29, 2017).*
Zhou (Briefings in Bioinformatics 20(2) 2019 598-608).*
Deng (Int J Clin Exp Pathol 2017;10(4) pp. 4694-4699).*
Hu et al., "Diagnostic Value of microRNA for Alzheimer's Disease: A Systematic Review and Meta-Analysis", Front Aging Neurosci., 8:1-9, (2016).
Luo et al., "Long noncoding RNAs and Alzheimer's disease", Clin. Interv. Aging, 11: 867-872, (2016).
Carlson et al., "Amyloid-related imaging abnormalities from trials of solanezumab for Alzheimer's disease," Alzheimer's Dement (Amst), vol. 2, pp. 75-85, (2016). DOI: http://dx.doi.org/10.1016/j.dadm.2016.02.004.
Chetelat et al., "Amyloid imaging in cognitively normal individuals, at-risk populations and preclinical Alzheimer's disease," NeuroImage: Clinical, vol. 2, pp. 356-365, (2013), DOE http://dx.doi.org/10.1016/j.nicl.2013.02.006.
Choi et al., "Preclinical Properties of 18F-AV-45: A PET Agent for Aβ Plagues in the Brain," Journal of Nuclear Medicine, vol. 50, No. 11, pp. 1887-1894, (2009). DOI: 10.2967/jnumed.109.065284.
Cummings et al., "Repackaging FDA-approved drugs for degenerative diseases: promises and challenges," Expert Review of Clinical Pharmacology, vol. 7, No. 2, pp. 161-165, (2014), DOI: 10.1186/s13195-016-0207-9.
Deng et al., "Plasma long noncoding RNA 51A as a stable biomarker of Alzheimer's disease," International Journal of Clinical and Experimental Pathology, vol. 10, No. 4, pp. 4694-4699, (2017).
Dubois et al., "Advancing research diagnostic criteria for Alzheimer's disease: the IWF-2 criteria," Lancet Neurology, vol. 13, No. 6, pp. 614-629, (2014).
Feng et al., "Plasma long non-coding RNA BACE1 as a novel biomarker for diagnosis of Alzheimer disease," BMC Neurology, vol. 18, No. 1, (2018). DOI: 10.1186/s12883-017-1008-x.
Frisoni et al., "The clinical use of structural MRI in Alzheimer disease," National Reviews Neuroscience, vol. 6, No. 2, pp. 67-77, (2010). DOI: 10.103 8/nfneurol.2009.215.
Geekiyanage et al., "Blood serum miRNA: Non-invasive biomarkers for Alzheimer's disease," Experimental Neurology, vol. 235, No. 2, pp. 491-496, (2012). DOI: 10.1016/j.expneurol.2011.11.026.
Gotz et al., "Tau-targeted treatment strategies in Alzheimer's disease," British Journal of Pharmacology and Chemotherapy, vol. 165, No. 5, pp. 1246-1259, (2012). DOI: 10.1111/j.1476-5381.2011.01713.x.
Gui et al., "Altered microRNA profiles in cerebrospinal fluid exosome in Parkinson disease and Alzheimer disease," Oncotarget, vol. 6, No. 35, p. 37043, 37047, (2015).
Marcus et al., "Targeting Post-translational Modifications on Tau as a Therapeutic Strategy for Alzheimer's Disease," Journal of Neurogenetics, vol. 25, No. 4, pp. 127-133, (2011), DOI: https://doi.org/10.310901677063.2011.626471. Abstract Only.
Prince et al., World Alzheimer's Report 2015, Alzheimer's Disease International, (2015).

(Continued)

Primary Examiner — Amanda Haney
(74) Attorney, Agent, or Firm — Hoxie & Associates LLC

(57) ABSTRACT

The present invention describes a method for the diagnosis of a cognitive disorder including but not limited to Alzheimer disease in a subject at risk of having or developing a cognitive disorder.

3 Claims, 12 Drawing Sheets
Specification includes a Sequence Listing.

(56) References Cited

OTHER PUBLICATIONS

Satoh, et al., "MicroRNA-Seq Data Analysis Pipeline to Identify Blood Biomarkers for Alzheimer's Disease from Public Data," *Biomarker Insights*, vol. 10, No. 15, pp. 22, 23, 27, 30, (2015), DOI: 10.4137/BMI.S25132.

Shankar et al., "Transcriptome analysis in different rice cultivars provides novel insights into desiccation and salinity stress responses," *Scientific Reports*, vol. 6, No. 1, (2016), DOI: 10.1038/srep23719.

Siemers et al., "Phase 3 solanezumab trials: Secondary outcomes in mild Alzheimer's disease patients," *Alzheimer's & Dementia Journal*, vol. 12, No. 2, pp. 110-120, (2016), DOI: http://dx.doi.org/10.1016/j.jalz.2015.06.1893.

Soreq et al., "Long Non-Coding RNA and Alternative Splicing Modulations in Parkinson's Leukocytes Identified by RNA Sequencing," *PLOS Computational Biology*, vol. 10, No. 3, p. 1003517, (2014).

Sunderland et al., "Decreased β-Amyloid 1-42 and Increased Tau Levels in Cerebrospinal Fluid of Patients With Alzheimer Disease," *JAMA*, vol. 289, No. 16, pp. 2094-2103, (2003).

Tahmasian et al., "Based on the Network Degeneration Hypothesis: Separating Individual Patients with Different Neurodegenerative Syndromes in a Preliminary Hybrid PET/MR Study," *Journal of Nuclear Medicine*, vol. 57, No. 3, pp. 410-415, (2016), DOI: 10.2967/jnumed.115.165464.

Wong et al., "In Vivo Imaging of Amyloid Deposition in Alzheimer's Disease using the Novel Radioligand [18F]AV-45 (Florbetapir F 18)," *Journal of Nuclear Medicine*, vol. 51, No. 6, pp. 913-920, (2010), DOI: 10.2967/jnumed.109.069088.

Written Opinion of the International Search Authority for International Application No. PCT/EP2018/073905, 12 pages, Date of mailing as indicated by PCT/ISA/210 (second sheet) Dec. 11, 2018.

HTG Molecular Diagnostics, Inc., "HTG EdgeSeq miRNA Whole Transcriptome Assay", [retrieved on May 10, 2017], XP055830822, Retrieved from the Internet: URL: https://www.htgmolecular.com/pubsearch/pdf/S1HTGEdgeSeqmiRNAWTA.pdf.

Wang H.Y., et al. "Quantamatrix Multiplexed Assay Platform system for direct detection of bacteria and antibiotic resistance determinants in positive blood culture bottles," *Clin Microbiol Infect.* May 2017; 23(5):333.e1-333.e7.

Cogswell, et al., "Identification of miRNA changes in Alzheimer's disease brain and CSF yields putative biomarkers and insights into disease pathways.", *Journal of Alzheimer's disease*, vol. 14, p. 27-41, (2008).

Yang, et al., "Distinct Hippocampal Expression Profiles of Long Non-coding RNAs in an Alzheimer's Disease Model", *Mol. Neurobiol.*, vol. 54, No. 7, pp. 4833-4846, (2016).

Yaohui, et al., "Investigation of Long Non-coding RNA Expression Profiles in the Substantia Nigra of Parkinson's Disease", *Cell Mol. Neurobiol.*, vol. 37, No. 2, pp. 329-338, (2016).

Zhang, et al., "Preparation and application of streptavidin magnetic particles", *Sci. China Ser. B-Chem.*, vol. 50, No. 1, pp. 127-134, (2007).

\* cited by examiner

NON-CODING RNAS (NCRNA) FOR THE DIAGNOSIS OF COGNITIVE DISORDERS

CROSS REFERENCE TO RELATED APPLICATIONS

This application is a U.S. national stage application filed under 35 U.S.C. § 371 of International Application No. PCT/EP2018/073905, filed on Sep. 5, 2018, which claims the benefit and priority of U.S. provisional application 62/554,427, filed on Sep. 5, 2017, the contents of each of which are incorporated herein by reference in their entireties.

FIELD OF THE INVENTION

The present invention relates to the field of human medicine and specifically to the diagnosis of cognitive disorder including Alzheimer disease. This invention relates to a biomarker for cognitive disorders, in particular Alzheimer's disease, consisting of circulating non-coding RNAs (ncRNA) such as microRNA (miRNA) and long non-coding RNAs (lncRNA), or their combination in a peripheral body fluid and representing a non-invasive method for diagnosing the cognitive disorder in particular Alzheimer's disease or for monitoring its development or progression using this biomarker. It further relates to associated kits, methods, protocols and transmittable forms of information for diagnosis purposes and/or for other human medicine applications including the patient stratification in clinical trials and/or monitoring the efficacy of therapeutic strategies using this biomarker and peripheral body fluids from patients. The present invention will thus have a strong impact on the quality of life of patients and a significant impact on the healthcare system and economy.

BACKGROUND ART

Alzheimer's disease (AD) is a chronic neurodegenerative disease characterized by progressive loss of cognitive function and pathologically by extracellular deposition of amyloid-beta peptide (Aβ) and intracellular deposition of hyperphosphorylated tau protein in neurofibrillary tangles in the brain, associated with progressive neuronal degeneration (Marcus et al. J Neurogenet. 2011; 25(4):127-33; Gotz et al, Br J Pharmacol. 2012; 165(5):1246-59).

AD is the most common form of dementia. Approximately 46.8 million people worldwide currently live with AD or other type of dementia. With an ageing population, this number is estimated to increase to 131.5 million by 2050 (World Alzheimer Report, 2015: http://www.alz.co.uk/research/WorldAlzheimerReport2015.pdf). As such, AD is becoming an increasingly important burden on the affected individuals and their families as well as economic and social costs on medical and healthcare resources in both developed and emerging countries.

Currently, there is no cure for AD. Symptomatic treatments exist for this disease all trying to counterbalance neurotransmitter's disturbance. Although a number of new potential disease-modifying therapeutic candidates are currently being studied in clinical trials, none has been approved yet. From 2002 to 2012, there was a failure of 99.6% of AD clinical trials that were 289 Phases 2 and 3 trials on symptomatic agents (36.6%), disease-modifying small molecules (35.1%) and disease-modifying immuno-therapies (18%) (Cummings et al., Expert Rev Clin Pharmacol. 2014; 7(2):161-5). Among the strategies proposed by worldwide experts in the AD field and by pharmaceutical industries to improve the success rate for AD drug development, are: a) intervening earlier in the disease process before neurodegeneration begins, b) identifying and developing accurate biomarkers for early diagnosis, non-invasive and suitable for stratification of subject populations and for longitudinal monitoring of drug efficacy in clinical trials.

The AD pathological features are defined in post-mortem histopathological analysis. The presence of amyloid plaques remains an absolutely required feature for the definitive diagnosis of AD, as accepted by the American Academy of Neurology, American Psychiatric Association (DSM-IV) and both the CERAD and NIA-Reagan Institute neuropathological criteria.

Current diagnosis of the disease remains uncertain (Dubois et al Lancet Neurol. 2014; 13(6):614-29) and it is based on combination of battery of clinical and neuropsychological tests and neuroimaging, such as structural imaging using Magnetic Resonance Imaging (MRI) and/or glucose metabolism using Positron emission tomography (PET) of fluorodeoxyglucose F18 ($^{18}$F-FDG), with an accuracy of less than 70%-85% depending on the method and the severity stage of the disease (Frisoni et al., Nat Rev Neurol. 2010; 6(2): 67-77; Tahmasian et al., J Nucl Med. 2016; 57(3):410-5).

Sometimes, detection of AD-associated biomarkers Aβ42 and tau or phosphorylated-tau in cerebrospinal fluid (CSF) is additionally performed (Sunderland et al., JAMA. 2003; 289(16):2094-2103), but CSF tests request a lumbar puncture, which is an invasive procedure and often requires hospitalization of subjects. In addition, the accuracy of these CSF tests remains insufficient as up to 30% of subjects can be misdiagnosed and the test cannot be longitudinally practiced to be followed up for confirmation of diagnostic purposes.

Longitudinal confirmatory diagnosis test is essential for applications to early detection of the preclinical stages of AD and mild cognitive impairment (MCI; defined as an early stage during which the first subtle symptoms manifest) and thus detecting early and calculating the risk of conversion of MCI into AD. Due to its limits (invasive), a CSF test is not rarely used as a biomarker for early diagnosis in preclinical AD stages before symptoms appear, nor it is suitable as a companion biomarker repeatedly practiced at several time points in same subjects recruited in longitudinal clinical trials.

Recently, specific neuroimaging methods relevant for AD pathology are being developed, notably with ligands for in vivo amyloid-beta (Aβ) ligands for Positron Emission Tomography (PET) neuroimaging including F-18 florbetapir and F-18 flutemetamol which have been approved by FDA and/or EMA (Choi et al., 2009 and Wong et al., 2010). However, their practice is costly and very limited (available only in some hospitals of large cities equipped with PET technology, still mainly for research purposes as not reimbursed by health insurances) and their diagnosis accuracy is still under studies for further understanding. Thus, the use of these Aβ PET neuroimaging methods remains very limited and the vast majority of patients do not profit from such tests even in rich countries.

There is a need for better definition of AD patient population to be included for the drug-development trials: PET imaging using Aβ ligands showed that up to 30% of subjects diagnosed with AD show a negative Aβ scan and that up to 35% of subjects with normal cognition status show a positive Aβ scan (Gaël Chételat et al, NeuroImage Clinical 2013; 2:356-65). Thus, PET Aβ scan is being used to guide for recruitment of subjects in the desired cohorts in some clinical trials by the large pharmaceutical companies. Anti-Aβ antibody e.g. Solanezumab tested in patients with mixed mild to moderate AD failed to show clear efficacy, however with some encouraging data in only mild AD patients subgroup. In mild AD patients selected based on CSF biomarker profile, the results showed a promising efficacy (Carlson et al., Alzheimers Dement (Amst). 2016; 2:75-85; Siemers et al., Alzheimers Dement. 2016; 12(2):110-20). However, the use of CSF biomarker is invasive, dramatically limiting its use as a biomarker for drug development. For example, it is not suitable for repeated use to monitor the stability and/or the progression of the disease, nor it is suitable to monitor in clinical longitudinal trials the efficacy of disease-modifying therapeutic drug candidates or preventive strategies.

Overall, the existing tests either lack an easy accessibility and simplicity for use for diagnosis of the large AD population and/or lack accuracy (sensitivity and specificity). This represents a major impediment and bottleneck to develop reliable and rapid diagnosis test for AD. Another impediment is the identification of a biomarker that does not require invasive sample collecting, such as a spinal tap. The lack of such an accessible, sensitive and specific biomarker that could be validated by cellular, animal model, pre-clinical models, and human testing impedes the development of therapies and drugs for AD or for the studies on pathological processes triggering AD or involved in the progression of AD.

Today, clearly there is an unmet need for an accurate and non-invasive peripheral biomarker test for diagnosis of AD including preclinical and early AD and for applications in drug development (patient stratification and monitoring drug efficacy in clinical trials).

ncRNAs include small microRNAs (miRNAs) and long non-coding RNAs (lncRNAs).

miRNAs are small non-coding RNA molecules (18-23 nucleotide) that modulate gene expression negatively at the post-transcriptional level. About 70% of the currently identified miRNAs are expressed in the brain. miRNAs play a major role in neural development, differentiation and synaptic plasticity. Some specific miRNAs are aberrantly expressed in AD brain, CSF and blood (for review: Hu et al., 2016, Front Aging Neurosci. 9(8):13), revealing their potential value in the diagnosis of AD.

lncRNAs are typically defined as transcripts longer than 200 nucleotides and expressed in a tissue-specific manner. In the brain, lncRNAs can regulate gene expression at epigenetic, transcriptional, and posttranscriptional levels of proteins with diverse functions including neuronal transmission and synaptic plasticity. Recent studies identified lncRNA candidates in AD postmortem brain tissue; some lncRNA candidates directly or indirectly regulate the formation of the neurotoxic Aβ, synaptic activity or the neuronal DNA repair (for review: Luo K and Chen Y, Clin Interv Aging 2016; 11: 867-872).

Expression levels of miRNAs may have potential as diagnostic biomarkers as they are known to circulate and tissue specific profiles can be identified in a number of body fluids such as plasma, CSF and urine. Recent developments in deep sequencing technology present a viable approach to develop biomarker pipelines in order to profile peripheral miRNA signatures specific to neurodegenerative diseases.

We previously showed that the lncRNAs expressed or highly enriched in tissues such as cardiac tissue or brain tissue, can be released into the peripheral circulation and be easily quantifiable by classical RT-PCR in different peripheral samples (PCT/EP2018/065492). In addition of the RT-PCR, we performed also total RNA sequencing on peripheral samples and quantified significant proportion of lncRNAs in the peripheral samples such as serum, plasma and Paxgene-RNA-tube collected whole blood (PCT/EP2018/065492).

According to the invention, new miRNA signatures and lncRNA signatures specific of neurodegenerative diseases, especially of AD, have been identified, using a method set up combining most recent technology and samples collected in non-invasively manner, including Paxgene whole blood tube, serum and plasma.

DESCRIPTION OF THE INVENTION

Figure 1:
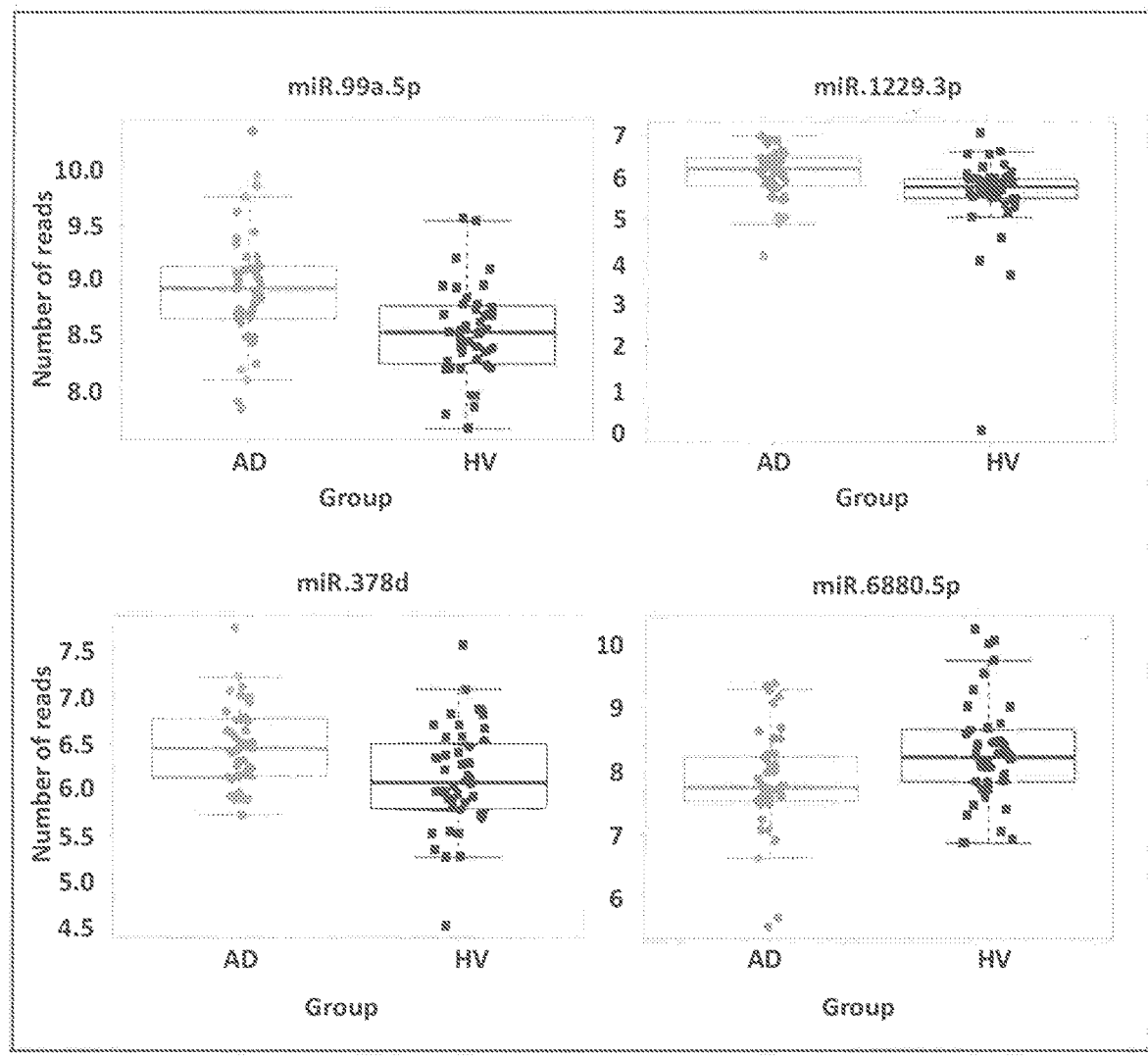
FIG. 1 shows the expression level of miR.99a.5p, MiR.1229.3p, miR.378d and miR.6880.5p on human plasma lithium heparin samples from patients with early to moderate Alzheimer (AD) and age-matched healthy controls. Y axis: mean+/−SD of the mean of concentration of the miRNAs in log 2 of the normalized number of reads. X axis: AD: Alzheimer patient group, HV: Healthy control group.

The invention relates to a method for the diagnosis of a cognitive disorder including but not limited to Alzheimer disease in a subject at risk of having or developing mild cognitive impairment or a cognitive disorder, comprising:
  (a) isolating a biological sample from the subject;
  (b) detecting a level of expression in a ncRNA (miRNA and/or lncRNA) signature, the ncRNA signature comprising or consisting of at least one ncRNA (miRNA and/or lncRNA) selected from 406 miRNAs listed in Table 1 and 1008 lncRNAs listed in Table 5 in the biological sample from said subject;
  (c) comparing the level of expression of miRNA and/or lncRNA in the sample to a level of expression in a reference, wherein an increased or decreased level of expression in the sample compared to the level in the reference identifies the subject having a cognitive disorder or being at risk of developing a cognitive disorder.

In some embodiments, the ncRNA signature comprises or consists of ncRNAs selected from the group consisting of:
  (i) miR.99a.5p;
  (ii) 7 miRNAs of miR.99a.5p, miR.378d, miR.100.5p, miR.193b.3p, miR.34a.5p, miR.1306.5p, and miR.1229.3p;
  (iii) 3 miRNAs of miR1220.3p, miR378d and miR99a.5p;
  (iv) 11 mRNAs of miR.99a.5p, miR.1229.3p, miR.100.5p, miR.378d, miR.193b.3p, miR.1306.5p, miR.195.5p, miR.532.3p, miR.125b.5p, miR.34a.5p, and miR.6880.5p;
  (v) 15 miRNAs of miR.23a.5p, miR.6880.5p, miR.7111.5p, miR.6812.5p, miR.6738.5p, miR.5196.5p, miR.6894.5p, miR.8085, miR.4463, miR.2392, miR.144.3p, miR.192.5p, miR.193b.3p, miR.194.5p, and miR.122.5p;
  (vi) 13 lncRNAs of lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20;
  (vii) 7 lncRNAs of LINCO2345:11, lnc-EBLN1-1:4, lnc-TPPP-1:2, lnc-TENM3-3:3, lnc-FAT1-7:2, lnc-DKK1-5:3, and lnc-TACSTD2-2:4;
  (viii) 12 lncRNAs of lnc-TPPP-1:2, ARRDC3-AS1:7, lnc-TENM3-3:5, lnc-TENM3-3:4, lnc-QRFP-5:1, lnc-CRYBB1-1:1, lnc-MGST3-1:3, lnc-FAM49B-8:1, HAND2-AS1:70, lnc-TMEM185B-12:7, lnc-CNDP1-7:1, and lnc-C21orf58-1:2;
  (ix) 3 lncRNAs of lnc-TENM3-3:3, lnc-MARCH4-2:7, and lnc-LRRC1-5:2;
  (x) 7 lncRNAs of lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46;
  (xi) 18 lncRNAs of lnc-TPPP-1:2, LINCO2345:11, lnc-ZNF273-4:4, lnc-TACC2-8:6, LINC01206:20, lnc-C5orf67-3:1, HAND2-AS1:58, lnc-PRDM9-20:1, lnc-CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, and lnc-AKR1E2-15:1;
  (xii) 28 miRNAs listed in Table 2;
  (xiii) 74 miRNAs listed in Table 3;
  (xiv) 33 lncRNAs listed in Table 6;
  (xv) 60 lncRNAs listed in Table 7;
  (xvi) 32 lncRNAs listed in Table 8;
  (xvii) 84 lncRNAs listed in Table 9; and
  (xviii) 94 lncRNAS listed in Table 10.

The invention also relates to a method for monitoring the development or progression of a cognitive disorder in a subject suffering from a loss or impairment of cognitive function or dementia, said method comprising the following steps:
  (a) isolating a biological sample from the subject;
  (b) detecting a level of expression in a ncRNA signature, the ncRNA signature comprising or consisting of at least one ncRNA (miRNA and/or lncRNA) selected from 406 miRNAs listed in Table 1 and 1008 lncRNAs listed in Table 5 in the biological sample;
  (c) comparing the level of expression of miRNA and/or lncRNA in the sample to a level of expression in a reference, wherein an increased or decreased level of expression in the sample compared to the level in the reference identifies the subject having a cognitive disorder or being at risk of developing a cognitive disorder, and
  (d) designing the therapeutic treatment according to the said identified cognitive disorder.

In some embodiments, the ncRNA signature comprises or consists of ncRNAs selected from the group consisting of:
  (i) miR.99a.5p;
  (ii) 7 miRNAs of miR.99a.5p, miR.378d, miR.100.5p, miR.193b.3p, miR.34a.5p, miR.1306.5p, and miR.1229.3p;
  (iii) 3 miRNAs of miR1220.3p, miR378d and miR99a.5p;
  (iv) 11 mRNAs of miR.99a.5p, miR.1229.3p, miR.100.5p, miR.378d, miR.193b.3p, miR.1306.5p, miR.195.5p, miR.532.3p, miR.125b.5p, miR.34a.5p, and miR.6880.5p;
  (v) 15 miRNAs of miR.23a.5p, miR.6880.5p, miR.7111.5p, miR.6812.5p, miR.6738.5p, miR.5196.5p, miR.6894.5p, miR.8085, miR.4463, miR.2392, miR.144.3p, miR.192.5p, miR.193b.3p, miR.194.5p, and miR.122.5p;
  (vi) 13 lncRNAs of lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20;
  (vii) 7 lncRNAs of LINCO2345:11, lnc-EBLN1-1:4, lnc-TPPP-1:2, lnc-TENM3-3:3, lnc-FAT1-7:2, lnc-DKK1-5:3, and lnc-TACSTD2-2:4;
  (viii) 12 lncRNAs of lnc-TPPP-1:2, ARRDC3-AS1:7, lnc-TENM3-3:5, lnc-TENM3-3:4, lnc-QRFP-5:1, lnc-CRYBB1-1:1, lnc-MGST3-1:3, lnc-FAM49B-8:1, HAND2-AS1:70, lnc-TMEM185B-12:7, lnc-CNDP1-7:1, and lnc-C21orf58-1:2;

(ix) 3 lncRNAs of lnc-TENM3-3:3, lnc-MARCH4-2:7, and lnc-LRRC1-5:2;
(x) 7 lncRNAs of lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46;
(xi) 18 lncRNAs of lnc-TPPP-1:2, LINCO2345:11, lnc-ZNF273-4:4, lnc-TACC2-8:6, LINC01206:20, lnc-C5orf67-3:1, HAND2-AS1:58, lnc-PRDM9-20:1, lnc-CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, and lnc-AKR1E2-15:1;
(xii) 28 miRNAs listed in Table 2;
(xiii) 74 miRNAs listed in Table 3;
(xiv) 33 lncRNAs listed in Table 6;
(xv) 60 lncRNAs listed in Table 7;
(xvi) 32 lncRNAs listed in Table 8;
(xvii) 84 lncRNAs listed in Table 9; and
(xviii) 94 lncRNAS listed in Table 10.

A biological sample may be a small part of a subject obtained from a body fluid, e.g. blood, plasma, serum, urine or cerebrospinal fluid. Suitably the biological sample are plasma or serum or Paxgene-RNA-tube.

By cognitive disorder is meant e.g. progressive impairment or progressive loss of a cognitive function, for example AD.

For Diagnosis of Cognitive Impairment or Dementia:

The "reference" may be suitable control sample such as for example a sample from a normal, healthy subject having no cognitive impairment symptoms and no abnormal neuroimaging findings and being age-matched to the patient to be diagnosed with the method of the present invention. The reference may be a sample from the same subject prior to demonstration of disorder or disease symptoms or prior to diagnosis of the impairment or loss of cognitive function or dementia. The reference may be a standardized sample, e.g. a sample comprising material or data from several samples of healthy subjects who have no cognitive impairment symptoms and no abnormal neuroimaging findings.

For Differential Diagnosis of a Specific Dementia Type or its Mild Cognitive Impairment (MCI) Versus Other Dementia Types and their MCI:

Dementia types and subtypes are numerous and include e.g.

Alzheimer (AD) and MCI of AD type
Frontotemporal dementia (FTD) and MCI of FTD type
Dementia with Lewy body (DLB) and MCI of DLB type
Parkinson's disease dementia (PDD) and MCI of PDD type
Vascular dementia
Progressive supranuclear palsy (PSP),
Corticobasal degeneration (CBD)

For differential diagnosis of one dementia subtype, the reference sample may be sample(s) from patient(s) suffering dementia of other type(s). For example, for differential diagnosis of AD or MCI of AD type, the sample(s) shall be from patient(s) with MCI/dementia of non-AD type (i.e. sample(s) from subject(s) with FTD and/or DLB and/or PDD and/or vascular dementia and/or PSP and/or CBD and/or other dementia), or from subject(s) who may suffer another disease but have no cognitive impairment or dementia.

The invention also relates to a method of diagnosing a cognitive disorder including but not limited to Alzheimer disease and monitoring its development or progression in a subject suffering from progressive impairment or loss of cognitive function or dementia, comprising:

(a) determining the presence of a cognitive disorder using a biological sample of the said subject using a method according to the invention, and (b) adapting a therapeutic treatment in function of the results of step (a).

The invention also relates to a method of diagnosing a cognitive disorder including but not limited to early MCI and very mild Alzheimer disease in a subject with no apparent and/or no measurable symptoms when using the available methods such as MMSE, MoCA and other neurocognitive tests, but with abnormal changes of biomarkers of the present invention preceding the symptoms, comprising:

(a) determining the risk of developing a cognitive disorder using a biological sample of the said subject using a method according to the invention, and (b) adapting a therapeutic treatment in function of the results of step (a).

The invention further relates to a method of predictive diagnosing a cognitive disorder including but not limited to early MCI and very mild Alzheimer disease in a subject with no apparent and/or no measurable abnormality by neuroimaging methods as MRI and/or CT scans, comprising:

(a) determining the risk of developing a cognitive disorder using a biological sample of the said subject using a method according to the invention, and (b) adapting a therapeutic treatment in function of the results of step (a).

The invention also relates to a method for treating a subject suffering from a progressive impairment or loss of cognitive function or dementia, said method comprising:

(a) diagnosing the cognitive disorder associated to the progressive impairment or loss of cognitive function or dementia in said patient using the method according to the invention, and (b) adapting the therapeutic treatment to the results obtained in step (a).

Examples of therapeutic treatment of cognitive disorders may comprise the administration of:

a drug already approved for treatment of cognitive disorders in particular Alzheimer's disease, e.g. cholinesterase inhibitors, for example donenepezil, rivastigmine or galantamine, or a NMDA receptor antagonist, e.g. memantine, or a combination of drugs, for example donepezil and memantine, and/or a novel therapeutic candidate or combination under clinical development, for example as currently tested in the anti-amyloid field, e.g. beta-secretase inhibitors and anti-beta-amyloid monoclonal antibodies, and anti-tau approaches, for example as currently tested in the anti-tau field, e.g. modulators of kinases or phosphatases that regulate tau phosphorylation status and anti-tau antibodies; and drug candidates modulating the molecular pathways such as neurodegeneration, synaptic plasticity, oxidative stress, autophagy, mitochondrial dysfunction and immuno-inflammation pathways where ncRNAs of the present invention are implicated.

Furthermore, the invention comprises a kit for diagnosing and/or monitoring a cognitive disorder including but not limited to AD, comprising at least one reagent for the determination of a ncRNA expression profile comprising or consisting of at least one ncRNA (miRNA and/or lncRNA) selected from 406 miRNAs listed in Table 1 and 1008 lncRNAs listed in Table 5 in the biological sample.

In some embodiments, the ncRNA expression profile comprises or consists of ncRNAs selected from the group consisting of:
(i) miR.99a.5p;
(ii) 7 miRNAs of miR.99a.5p, miR.378d, miR.100.5p, miR.193b.3p, miR.34a.5p, miR.1306.5p, and miR.1229.3p;
(iii) 3 miRNAs of miR1220.3p, miR378d and miR99a.5p;
(iv) 11 mRNAs of miR.99a.5p, miR.1229.3p, miR.100.5p, miR.378d, miR.193b.3p, miR.1306.5p, miR.195.5p, miR.532.3p, miR.125b.5p, miR.34a.5p, and miR.6880.5p;
(v) 15 miRNAs of miR.23a.5p, miR.6880.5p, miR.7111.5p, miR.6812.5p, miR.6738.5p, miR.5196.5p, miR.6894.5p, miR.8085, miR.4463, miR.2392, miR.144.3p, miR.192.5p, miR.193b.3p, miR.194.5p, and miR.122.5p;
(vi) 13 lncRNAs of lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20;
(vii) 7 lncRNAs of LINCO2345:11, lnc-EBLN1-1:4, lnc-TPPP-1:2, lnc-TENM3-3:3, lnc-FAT1-7:2, lnc-DKK1-5:3, and lnc-TACSTD2-2:4;
(viii) 12 lncRNAs of lnc-TPPP-1:2, ARRDC3-AS1:7, lnc-TENM3-3:5, lnc-TENM3-3:4, lnc-QRFP-5:1, lnc-CRYBB1-1:1, lnc-MGST3-1:3, lnc-FAM49B-8:1, HAND2-AS1:70, lnc-TMEM185B-12:7, lnc-CNDP1-7:1, and lnc-C21orf58-1:2;
(ix) 3 lncRNAs of lnc-TENM3-3:3, lnc-MARCH4-2:7, and lnc-LRRC1-5:2;
(x) 7 lncRNAs of lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46;
(xi) 18 lncRNAs of lnc-TPPP-1:2, LINCO2345:11, lnc-ZNF273-4:4, lnc-TACC2-8:6, LINC01206:20, lnc-C5orf67-3:1, HAND2-AS1:58, lnc-PRDM9-20:1, lnc-CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, and lnc-AKR1E2-15:1;
(xii) 28 miRNAs listed in Table 2;
(xiii) 74 miRNAs listed in Table 3;
(xiv) 33 lncRNAs listed in Table 6;
(xv) 60 lncRNAs listed in Table 7;
(xvi) 32 lncRNAs listed in Table 8;
(xvii) 84 lncRNAs listed in Table 9; and
(xviii) 94 lncRNAS listed in Table 10.

The kit of the invention allows performing the measurement of the miRNA signature and/or the lncRNA signature of the invention, wherein the kit comprises at least one reagent for measuring at least one ncRNA (miRNA and/or lncRNA) as indicated above.

By "reagent" is meant a reagent which specifically allows the determination of the miRNA/gene expression profile, i.e. a reagent specifically intended for the specific determination of the expression level of the miRNA/gene present in the miRNA/gene expression profile. Examples include e.g. amplification primer pairs (forward and reward) and/or probes specific for the miRNA/gene present in the miRNA/gene expression profile. This definition excludes generic reagents useful for the determination of the expression level of any other miRNA/gene.

By "reagent" is also meant a reagent which specifically allows the determination of the lncRNA expression profile, i.e. a reagent specifically intended for the specific determination of the expression level of the lncRNA present in the lncRNA expression profile. Examples include e.g. amplification primer pairs (forward and reward) and/or probes specific for the lncRNA present in the lncRNA expression profile. This definition excludes generic reagents useful for the determination of the expression level of any other lncRNA.

In some embodiments, the kit for diagnosing and/or monitoring a cognitive disorder comprises one or more oligonucleotide probes specific for ncRNAs of interest and a reagent for purifying the probe-target nucleic acid complexes. The oligonucleotide probes comprise a sequence complementary to a region of the ncRNAs of interest. The oligonucleotide probes may be DNA or RNA. The oligonucleotide probes are preferably DNA. In a preferred embodiment, the oligonucleotide probes are biotinylated and the reagent for purifying the probe-target complexes is a streptavidin-coated substrate, e.g., a streptavidin-coated magnetic particle, e.g., T1 streptavidin coated magnetic bead. In a preferred embodiment, the ncRNAs of interest is lncRNAs. The length of oligonucleotide probes specific for lncRNAs may be from 30 to 80 nucleotides, e.g., from 40 to 70, from 40 to 60, or about 50 nucleotides.

A further embodiment of the invention relates to a targeted sequencing panel for next generation sequencing, comprising nucleic acids specific for at least one ncRNA (miRNA and/or lncRNA) selected from 406 miRNAs listed in Table 1 and 1008 lncRNAs listed in Table 5 in the biological sample.

In some embodiments, the at least one ncRNA (miRNA and/or lncRNA) comprises or consists of ncRNAs selected from the group consisting of:
(i) miR.99a.5p;
(ii) 7 miRNAs of miR.99a.5p, miR.378d, miR.100.5p, miR.193b.3p, miR.34a.5p, miR.1306.5p, and miR.1229.3p;
(iii) 3 miRNAs of miR1220.3p, miR378d and miR99a.5p;
(iv) 11 mRNAs of miR.99a.5p, miR.1229.3p, miR.100.5p, miR.378d, miR.193b.3p, miR.1306.5p, miR.195.5p, miR.532.3p, miR.125b.5p, miR.34a.5p, and miR.6880.5p;
(v) 15 miRNAs of miR.23a.5p, miR.6880.5p, miR.7111.5p, miR.6812.5p, miR.6738.5p, miR.5196.5p, miR.6894.5p, miR.8085, miR.4463, miR.2392, miR.144.3p, miR.192.5p, miR.193b.3p, miR.194.5p, and miR.122.5p;
(vi) 13 lncRNAs of lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20;
(vii) 7 lncRNAs of LINCO2345:11, lnc-EBLN1-1:4, lnc-TPPP-1:2, lnc-TENM3-3:3, lnc-FAT1-7:2, lnc-DKK1-5:3, and lnc-TACSTD2-2:4;
(viii) 12 lncRNAs of lnc-TPPP-1:2, ARRDC3-AS1:7, lnc-TENM3-3:5, lnc-TENM3-3:4, lnc-RFP-5:1, lnc-CRYBB1-1:1, lnc-MGST3-1:3, lnc-FAM49B-8:1, HAND2-AS1:70, lnc-TMEM185B-12:7, lnc-CNDP1-7:1, and lnc-C21orf58-1:2;
(ix) 3 lncRNAs of lnc-TENM3-3:3, lnc-MARCH4-2:7, and lnc-LRRC1-5:2;
(x) 7 lncRNAs of lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46;
(xi) 18 lncRNAs of lnc-TPPP-1:2, LINCO2345:11, lnc-ZNF273-4:4, lnc-TACC2-8:6, LINC01206:20, lnc-C5orf67-3:1, HAND2-AS1:58, lnc-PRDM9-20:1, lnc- CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, and lnc-AKR1E2-15:1;
(xii) 28 miRNAs listed in Table 2;
(xiii) 74 miRNAs listed in Table 3;
(xiv) 33 lncRNAs listed in Table 6;
(xv) 60 lncRNAs listed in Table 7;
(xvi) 32 lncRNAs listed in Table 8;
(xvii) 84 lncRNAs listed in Table 9; and
(xviii) 94 lncRNAS listed in Table 10.

The invention also relates to the applications of the method for development of new therapeutic strategies (drug candidates) tested in clinical trials for the treatment of a cognitive disorder including but not limited to Alzheimer disease, wherein the method can be used (a) before starting the treatment for the selection of patients who would then be recruited in clinical trial; thus the test will enhance the likelihood for treating patient population that benefits from the tested therapeutic strategy(ies) while avoiding recruitment of patient subpopulation patients who do not benefit from this tested new drug candidate(s) and/or (b) for monitoring the response(s) including efficacy of the tested therapeutic strategy(ies) once treatment with the new tested drug candidate starts.

In a further aspect, the invention also relates to methods of detection. For example, the invention contemplates a method for the detection of at least one ncRNA (miRNA and/or lncRNA). In one aspect, the method comprises:
(a) isolating a biological sample from the subject;
(b) detecting a level of expression in a ncRNA signature, the ncRNA signature comprising or consisting of at least one ncRNA selected from 406 miRNAs listed in Table 1 and 1008 lncRNAs listed in Table 5 in the biological sample from said subject.

In some embodiments, the ncRNA signature comprises or consists of ncRNAs selected from the group consisting of:
(i) miR.99a.5p;
(ii) 7 miRNAs of miR.99a.5p, miR.378d, miR.100.5p, miR.193b.3p, miR.34a.5p, miR.1306.5p, and miR.1229.3p;
(iii) 3 miRNAs of miR1220.3p, miR378d and miR99a.5p;
(iv) 11 mRNAs of miR.99a.5p, miR.1229.3p, miR.100.5p, miR.378d, miR.193b.3p, miR.1306.5p, miR.195.5p, miR.532.3p, miR.125b.5p, miR.34a.5p, and miR.6880.5p;
(v) 15 miRNAs of miR.23a.5p, miR.6880.5p, miR.7111.5p, miR.6812.5p, miR.6738.5p, miR.5196.5p, miR.6894.5p, miR.8085, miR.4463, miR.2392, miR.144.3p, miR.192.5p, miR.193b.3p, miR.194.5p, and miR.122.5p;
(vi) 13 lncRNAs of lnc-DLG5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20;
(vii) 7 lncRNAs of LINCO2345:11, lnc-EBLN1-1:4, lnc-TPPP-1:2, lnc-TENM3-3:3, lnc-FAT1-7:2, lnc-DKK1-5:3, and lnc-TACSTD2-2:4;
(viii) 12 lncRNAs of lnc-TPPP-1:2, ARRDC3-AS1:7, lnc-TENM3-3:5, lnc-TENM3-3:4, lnc-QRFP-5:1, lnc-CRYBB1-1:1, lnc-MGST3-1:3, lnc-FAM49B-8:1, HAND2-AS1:70, lnc-TMEM185B-12:7, lnc-CNDP1-7:1, and lnc-C21orf58-1:2;
(ix) 3 lncRNAs of lnc-TENM3-3:3, lnc-MARCH4-2:7, and lnc-LRRC1-5:2;
(x) 7 lncRNAs of lnc-TPPP-1:2, lnc-TENM3-3:3, lnc-TMEM185B-12:7, lnc-NAXD-6:5, lnc-HECA-6:1, lnc-COMMD6-10:1, and MIR29B2CHG:46;
(xi) 18 lncRNAs of lnc-TPPP-1:2, LINCO2345:11, lnc-ZNF273-4:4, lnc-TACC2-8:6, LINC01206:20, lnc-C5orf67-3:1, HAND2-AS1:58, lnc-PRDM9-20:1, lnc-CLK1-1:7, lnc-DNALI1-5:4, RORB-AS1:6, lnc-TPPP-1:3, lnc-BMS1-2:1, lnc-ADRB1-4:1, lnc-XXYLT1-5:1, MIR99AHG:104, LINC01748:17, and lnc-AKR1E2-15:1;
(xii) 28 miRNAs listed in Table 2;
(xiii) 74 miRNAs listed in Table 3;
(xiv) 33 lncRNAs listed in Table 6;
(xv) 60 lncRNAs listed in Table 7;
(xvi) 32 lncRNAs listed in Table 8;
(xvii) 84 lncRNAs listed in Table 9; and
(xviii) 94 lncRNAS listed in Table 10.

The expression level of miRNAs and/or lncRNAs may be determined by any technology known by a man skilled in the art. In particular, the expression level of miRNAs and/or lncRNAs is determined by measuring the amount of nucleic acid transcripts of each miRNA or lncRNAs. The amount of nucleic acid transcripts can be measured by any technology known by a man skilled in the art. The measure may be carried out directly on an extracted RNA sample or on retrotranscribed complementary DNA (cDNA) prepared from extracted RNA by technologies well-known in the art. From the RNA or cDNA sample, the amount of nucleic acid transcripts may be measured using any technology known by a man skilled in the art, including nucleic acid microarrays, quantitative PCR, sequencing (e.g., next generation sequencing), FIMAP quantification, and hybridization with a labeled probe.

In some embodiments, the expression level of miRNAs and/or lncRNAs is determined using sequencing, e.g., next generation sequencing. Sequencing may be carried out after converting extracted RNA to cDNA using reverse transcriptase or RNA molecules may be directly sequenced. In a particular embodiment, which should not be considered as limiting the scope of the invention, the measurement of the expression level using next generation sequencing may be performed as follows. Briefly, RNA is extracted from a sample (e.g., blood sample). After removing rRNA, RNA samples are then reverse transcribed into cDNA. To ensure strand specificity, single stranded cDNA is first synthetized using Super-Script II reverse transcriptase and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3'end adenylation step, adaptor is attached to cDNA. So obtained cDNA (sequencing library) may be amplified by PCR. The sequencing libraries can be sequenced by any next generation sequencing technology known by a man skilled in the art.

In some embodiments, the measurement of the expression level of ncRNAs, e.g., by sequencing (e.g., next generation sequencing), is facilitated by capturing and enriching nucleic acids (RNA or cDNA) corresponding to ncRNAs of interest prior to the measurement. As used herein, enrichment refers to increasing the percentage of the nucleic acids of interest in the sample relative to the initial sample by selectively purifying the nucleic acids of interest. The enrichment of nucleic acids corresponding to ncRNAs of interest can be carried out on extracted RNA sample or cDNA sample prepared from extracted RNA. In some embodiments, nucleic acids corresponding to ncRNAs of interest are captured and enriched by hybridizing RNA or cDNA sample to oligonucleotide probes specific for ncRNAs of interest (e.g. oligonucleotide probes comprising a sequence complementary to a region of ncRNAs of interest) under conditions allowing for hybridization of the probes and target nucleic acids to form probe-target nucleic acid complexes. Probes may be DNA or RNA, preferably DNA. The probe-target nucleic acid complexes can be purified by any technology known by a man skilled in the art. In a preferred embodiment, probes are biotinylated. The biotinylated probe-target nucleic acid complexes can be purified by using a streptavidin-coated substrate, e.g., a streptavidin-coated magnetic particle, e.g., T1 streptavidin coated magnetic bead. In a preferred embodiment, the ncRNAs measured by this method are lncRNAs. The length of probes specific for lncRNAs may be from 30 to 80 nucleotides, e.g., from 40 to 70, from 40 to 60, or about 50 nucleotides.

In some embodiments, the expression level of miRNAs and/or lncRNAs may be determined using quantitative PCR. Quantitative, or real-time, PCR is a well-known and easily available technology for those skilled in the art and does not need a precise description. In a particular embodiment, which should not be considered as limiting the scope of the invention, the determination of the expression profile using quantitative PCR may be performed as follows. Briefly, the real-time PCR reactions are carried out using the TaqMan Universal PCR Master Mix (Applied Biosystems). 6 µl cDNA is added to a 9 µl PCR mixture containing 7.5 µl TaqMan Universal PCR Master Mix, 0.75 µl of a 20× mixture of probe and primers and 0.75 µl water. The reaction consists of one initiating step of 2 min at 50 deg. C., followed by 10 min at 95 deg. C., and 40 cycles of amplification including 15 sec at 95 deg. C. and 1 min at 60 deg. C. The reaction and data acquisition can be performed using the ABI 7900HT Fast Real-Time PCR System (Applied Biosystems). The number of template transcript molecules in a sample is determined by recording the amplification cycle in the exponential phase (cycle threshold or $C_Q$ or $C_T$), at which time the fluorescence signal can be detected above background fluorescence. Thus, the starting number of template transcript molecules is inversely related to $C_T$.

In some embodiments, the expression level of miRNAs and/or lncRNAs may be determined by the use of a nucleic acid microarray. A nucleic acid microarray consists of different nucleic acid probes that are attached to a substrate, which can be a microchip, a glass slide or a microsphere-sized bead. A microchip may be constituted of polymers, plastics, resins, polysaccharides, silica or silica-based materials, carbon, metals, inorganic glasses, or nitrocellulose. Probes can be nucleic acids such as cDNAs ("cDNA microarray") or oligonucleotides ("oligonucleotide microarray"). To determine the expression profile of a target nucleic acid sample, said sample is labelled, contacted with the microarray in hybridization conditions, leading to the formation of complexes between target nucleic acids that are complementary to probe sequences attached to the microarray surface. The presence of labelled hybridized complexes is then detected. Many variants of the microarray hybridization technology are available to the man skilled in the art.

In some embodiments, the expression level of miRNAs and/or lncRNAs may be determined by FIMAP quantification. Briefly, lncRNAs and miRNAs are amplified by PCR using primers with the same sequences as for qPCR that are chemically modified. Forward primers are phosphorylated in 5' and Reverse primers biotinylated in 5'. PCR products are digested with exonuclease to eliminate the phosphorylated strand and keep only the biotinylated ones. Biotinylated PCR products are incubated with coded silica microdisks coated with oligos complementary to the RNAs of interest (one code per target oligo), and hybridized products are revealed by addition of a fluorescent streptavidin conjugate. The expression level of miRNAs and/or lncRNAs is determined by measuring fluorescence signal.

In a still further aspect, the method of detection contemplates the use of a reagent to measure or detect the one or more miRNAs and/or one or more lncRNA. By "reagent" is meant a reagent that specifically allows the determination of the miRNA/gene or the lncRNA expression profile, i.e. a reagent specifically intended for the specific determination of the expression level of the miRNA/gene present in the miRNA/gene expression profile or the lncRNA present in the lncRNA expression profile. Examples include e.g. amplification primer pairs (forward and reward) and/or probes specific for the miRNA/gene present in the miRNA/gene expression profile and/or or the lncRNA present in the lncRNA expression profile. This definition excludes generic reagents useful for the determination of the expression level of any other miRNA/gene and generic reagents useful for the determination of the expression level of any other lncRNA.

In yet a further aspect, the method of detection comprises detecting one or more miRNAs and/or lncRNA from a biological sample, wherein the biological sample is selected from blood, plasma, serum, urine, cerebrospinal fluid, tear, saliva. In some embodiments, the biological sample is blood.

By "treating" or "treatment" of a subject being at risk to develop or having a cognitive disorder, particularly a progressive impairment or loss of cognitive function or dementia, e.g. AD, is meant administering or administration of a regimen to the subject in need thereof such that at least one symptom of the disorder or disease is cured, alleviated, remedied or improved. According to the present invention, depending on the diagnosing results, the subject is submitted to an adapted therapeutic treatment and is further monitored. The monitoring of the subject based on the miRNA signature and/or lncRNA signature of the invention allows to further adapt or modify the therapeutic treatment, e.g. increasing the drug amount, administering a combination of drugs to obtain a synergy effect, or replacing the drug by an effective amount of another drug.

The invention also relates to the modification of a therapeutic strategy in subjects suffering from cognitive disorder who have been diagnosed and/or monitored using a method for (in vitro) diagnosis or monitoring of a progressive impairment or loss of cognitive function or dementia according to the invention.

According to the invention, the miRNAs and/or the lncRNAs of the invention may be used in combination with one or more biomarkers currently used for diagnosing a cognitive disorder including but not limited to AD. Examples of such biomarkers include without any limitation the biomarkers as disclosed in U.S. Pat. Nos. 9,377,472, 7,897,786 and in U.S. Pat. No. 6,703,212, the contents thereof being included herein by reference. The method of the invention combining the miRNAs and/or the lncRNAs of the invention with one or more known biomarkers may allow enhanced accuracy of diagnosis; or differential diagnosis; and a more efficient and successful drug development, e.g. enhanced accuracy for patient stratification before recruitment in clinical trials and monitoring of the efficacy of approved therapies or novel drugs under development.

According to the invention, the miRNAs and/or the lncRNAs of the invention may be used in combination with one or more tests currently used for diagnosing a cognitive disorder including but not limited to AD and/or for differential diagnostic purposes. Examples of such tests include without any limitation the neuropsychological tests, such as MMSE, MoCA, and the neuroimaging methods, in particular volumetric MRI. The method of the invention combining the miRNAs and/or the lncRNAs of the invention with one or more known biomarkers may allow enhanced accuracy of diagnosis; or differential diagnosis; and a more efficient and successful drug development, e.g. enhanced accuracy for patient stratification before recruitment in clinical trials and monitoring of the efficacy of approved therapies or novel drugs under development.

To identify miRNA signatures involved specifically in the pathogenesis of AD and mild cognitive impairment (MCI) of AD type, a total of 2083 miRNAs in samples from different groups, including a group of patients with AD or MCI of AD type and group of cognitively intact healthy controls with no brain imaging abnormalities, have been screened. Subsequently miRNA profiling in all samples, 406 miRNAs have been detected above the threshold. By comparison of miRNA-expression levels measured in the samples of the different groups, the miRNA differentially expressed in the samples of the control group as compared to the expression level in the samples of patient group diagnosed as having AD or cognitive impairment of AD type (at the Neurology department of clinical site, based on neurocognitive and neuropsychological tests and neuroimaging tests and on cerebrospinal fluid biomarkers: beta-amyloid peptide 1-42 (Aβ42) and tau (total and/or phosphorylated) were identified as miRNA biomarker candidates.

To identify lncRNA signatures involved specifically in the pathogenesis of AD and mild cognitive impairment (MCI) of AD type, a total of 127802 lncRNAs in samples from different groups, including a group of patients with AD or MCI of AD type and group of cognitively intact healthy controls with no brain imaging abnormalities, have been screened. Subsequently lncRNA profiling in all samples, 19867 lncRNAs have been detected above the threshold. By comparison of lncRNA-expression levels measured in the samples of the different groups, the lncRNA differentially expressed in the samples of the control group as compared to the expression level in the samples of patient group diagnosed as having AD or cognitive impairment of AD type (at the Neurology department of clinical sites, based on neurocognitive and neuropsychological tests and neuroimaging tests and on cerebrospinal fluid biomarkers: beta-amyloid peptide 1-42 (Aβ42) and tau (total and/or phosphorylated) were identified as lncRNA biomarker candidates.

Expression levels were analyzed using a two-tailed Welch t test and/or Wilcoxon Mann-Whitney test between two groups. Significant differential expression was identified as p<0.05. Fold change and AUC (Area Under the Curve) are calculated for each miRNA and lncRNA and for each tested condition.

miRNA candidates were also selected when differential expression was determined based on fold-changes ≥1.49-fold or ≤0.75-fold changes and/or AUC>0.6 or <0.4, are indicated in Tables 2, 3 and 4.

lncRNA candidates were also selected when differential expression was determined based on fold-changes ≥1.6 (or ≤0.6) and/or an AUC≥0.80 (or <0.20), are indicated in Tables 6 and 7.

Random Forest algorithm (Breimann 2001, Breiman and Cutler 2001) was used to build the model and also used to select the top miRNAs and/or the top lncRNAs. A predictive model based on the combination of the top 2-20 miRNAs and/or lncRNAs enables to predict the disease with an accuracy of ≥80%.

Out of the 2083 miRNA measured, 406 miRNA showed expression levels above threshold. Sequences of the 406 miRNAs are shown in Table 1. These 406 miRNAs are also listed in the sequence listing included in this application.

TABLE 1

Sequences of 406 miRNAs

| miRNA | SEQ ID | Sequence |
| --- | --- | --- |
| let.7a.5p | SEQ 1009 | UGAGGUAGUAGGUUGUAUAGUU |
| let.7b.5p | SEQ 1010 | UGAGGUAGUAGGUUGUGUGGUU |
| let.7c.5p | SEQ 1011 | UGAGGUAGUAGGUUGUAUGGUU |
| let.7d.3p | SEQ 1012 | CUAUACGACCUGCUGCCUUUCU |
| let.7d.5p | SEQ 1013 | AGAGGUAGUAGGUUGCAUAGUU |
| let.7e.5p | SEQ 1014 | UGAGGUAGGAGGUUGUAUAGUU |
| let.7f.5p | SEQ 1015 | UGAGGUAGUAGAUUGUAUAGUU |
| let.7g.5p | SEQ 1016 | UGAGGUAGUAGUUUGUACAGUU |
| let.7i.5p | SEQ 1017 | UGAGGUAGUAGUUUGUGCUGUU |
| miR.100.5p | SEQ 1018 | AACCCGUAGAUCCGAACUUGUG |
| miR.101.3p | SEQ 1019 | UACAGUACUGUGAUAACUGAA |
| miR.103a.2.5p | SEQ 1020 | AGCUUCUUUACAGUGCUGCCUUG |
| miR.103a.3p | SEQ 1021 | AGCAGCAUUGUACAGGGCUAUGA |
| miR.106a.5p | SEQ 1022 | AAAAGUGCUUACAGUGCAGGUAG |
| miR.106b.3p | SEQ 1023 | CCGCACUGUGGGUACUUGCUGC |
| miR.106b.5p | SEQ 1024 | UAAAGUGCUGACAGUGCAGAU |
| miR.107 | SEQ 1025 | AGCAGCAUUGUACAGGGCUAUCA |
| miR.10a.5p | SEQ 1026 | UACCCUGUAGAUCCGAAUUUGUG |
| miR.10b.5p | SEQ 1027 | UACCCUGUAGAACCGAAUUUGUG |
| miR.1202 | SEQ 1028 | GUGCCAGCUGCAGUGGGGGAG |
| miR.1207.5p | SEQ 1029 | UGGCAGGGAGGCUGGGAGGGG |
| miR.122.5p | SEQ 1030 | UGAGCCCCUGUGCCGCCCCCAG |
| miR.1225.3p | SEQ 1031 | GUGGGUACGGCCCAGUGGGGGG |
| miR.1225.5p | SEQ 1032 | UGGAGUGUGACAAUGGUGUUUG |
| miR.1228.3p | SEQ 1033 | UCACACCUGCCUCGCCCCCC |
| miR.1229.3p | SEQ 1034 | CUCUCACCACUGCCCUCCCACAG |
| miR.1233.3p | SEQ 1035 | UGAGCCCUGUCCUCCCGCAG |
| miR.1234.3p | SEQ 1036 | UCGGCCUGACCACCCACCCCAC |
| miR.1237.5p | SEQ 1037 | CGGGGGCGGGGCCGAAGCGCG |
| miR.1244 | SEQ 1038 | AAGUAGUUGGUUUGUAUGAGAUGGUU |
| miR.1247.3p | SEQ 1039 | CCCCGGGAACGUCGAGACUGGAGC |
| miR.1249 | SEQ 1040 | AGGAGGGAGGAGAUGGGCCAAGUU |
| miR.1254 | SEQ 1041 | AGCCUGGAAGCUGGAGCCUGCAGU |

TABLE 1-continued

Sequences of 406 miRNAs

| miRNA | SEQ ID | Sequence |
|---|---|---|
| miR.1255b.2.3p | SEQ 1042 | AACCACUUUCUUUGCUCAUCCA |
| miR.125a.5p | SEQ 1043 | UCCCUGAGACCCUUUAACCUGUGA |
| miR.125b.5p | SEQ 1044 | UCCCUGAGACCCUAACUUGUGA |
| miR.126.3p | SEQ 1045 | UCGUACCGUGAGUAAUAAUGCG |
| miR.126.5p | SEQ 1046 | CAUUAUUACUUUUGGUACGCG |
| miR.1273a | SEQ 1047 | GGGCGACAAAGCAAGACUCUUUCUU |
| miR.1273c | SEQ 1048 | GGCGACAAAACGAGACCCUGUC |
| miR.1273d | SEQ 1049 | GAACCCAUGAGGUUGAGGCUGCAGU |
| miR.1273e | SEQ 1050 | UUGCUUGAACCCAGGAAGUGGA |
| miR.1273g.5p | SEQ 1051 | GGUGGUUGAGGCUGCAGUAAGU |
| miR.1273h.5p | SEQ 1052 | CUGGGAGGUCAAGGCUGCAGU |
| miR.1275 | SEQ 1053 | GUGGGGGAGAGGCUGUC |
| miR.128.3p | SEQ 1054 | UCACAGUGAACCGGUCUCUUU |
| miR.1285.5p | SEQ 1055 | GAUCUCACUUUGUUGCCCAGG |
| miR.1287.5p | SEQ 1056 | UGCUGGAUCAGUGGUUCGAGUC |
| miR.1290 | SEQ 1057 | UGGAUUUUUGGAUCAGGGA |
| miR.1291 | SEQ 1058 | UGGCCCUGACUGAAGACCAGCAGU |
| miR.1299 | SEQ 1059 | UUCUGGAAUUCUGUGUGAGGGA |
| miR.1301.3p | SEQ 1060 | UUGCAGCUGCCUGGGAGUGACUUC |
| miR.1303 | SEQ 1061 | UUUAGAGACGGGGUCUUGCUCU |
| miR.1304.3p | SEQ 1062 | UCUCACUGUAGCCUCGAACCCC |
| miR.1306.5p | SEQ 1063 | CCACCUCCCCUGCAAACGUCCA |
| miR.1307.3p | SEQ 1064 | ACUCGGCGUGGCGUCGGUCGUG |
| miR.1307.5p | SEQ 1065 | UCGACCGGACCUCGACCGGCU |
| miR.130a.3p | SEQ 1066 | CAGUGCAAUGUUAAAAGGGCAU |
| miR.130b.3p | SEQ 1067 | CAGUGCAAUGAUGAAAGGGCAU |
| miR.130b.5p | SEQ 1068 | ACUCUUUCCCUGUUGCACUAC |
| miR.134.5p | SEQ 1069 | UGUGACUGGUUGACCAGAGGGG |
| miR.136.5p | SEQ 1070 | ACUCCAUUUGUUUUGAUGAUGGA |
| miR.138.1.3p | SEQ 1071 | GCUACUUCACAACACCAGGGCC |
| miR.139.5p | SEQ 1072 | UCUACAGUGCACGUGUCUCCAGU |
| miR.140.5p | SEQ 1073 | CAGUGGUUUUACCCUAUGGUAG |
| miR.141.3p | SEQ 1074 | UAACACUGUCUGGUAAAGAUGG |
| miR.142.5p | SEQ 1075 | CAUAAAGUAGAAAGCACUACU |
| miR.143.3p | SEQ 1076 | UGAGAUGAAGCACUGUAGCUC |
| miR.144.3p | SEQ 1077 | UACAGUAUAGAUGAUGUACU |
| miR.144.5p | SEQ 1078 | GGAUAUCAUCAUAUACUGUAAG |
| miR.145.5p | SEQ 1079 | GUCCAGUUUUCCCAGGAAUCCCU |
| miR.146a.5p | SEQ 1080 | UGAGAACUGAAUUCCAUGGGUU |
| miR.146b.5p | SEQ 1081 | UGAGAACUGAAUUCCAUAGGCU |
| miR.148a.3p | SEQ 1082 | UCAGUGCACUACAGAACUUUGU |
| miR.148b.3p | SEQ 1083 | UCAGUGCAUCACAGAACUUUGU |
| miR.149.3p | SEQ 1084 | AGGGAGGGACGGGGGCUGUGC |
| miR.150.5p | SEQ 1085 | UCUCCCAACCCUUGUACCAGUG |
| miR.151a.3p | SEQ 1086 | CUAGACUGAAGCUCCUUGAGG |
| miR.152.3p | SEQ 1087 | UCAGUGCAUGACAGAACUUGG |
| miR.154.5p | SEQ 1088 | UAGGUUAUCCGUGUUGCCUUCG |
| miR.155.5p | SEQ 1089 | UUAAUGCUAAUCGUGAUAGGGGU |
| miR.15a.5p | SEQ 1090 | UAGCAGCACAUAAUGGUUUGUG |
| miR.15b.5p | SEQ 1091 | UAGCAGCACAUCAUGGUUUACA |
| miR.16.5p | SEQ 1092 | UAGCAGCACGUAAAUAUUGGCG |
| miR.17.3p | SEQ 1093 | ACUGCAGUGAAGGCACUUGUAG |
| miR.17.5p | SEQ 1094 | CAAAGUGCUUACAGUGCAGGUAG |
| miR.181a.5p | SEQ 1095 | AACAUUCAACGCUGUCGGUGAGU |
| miR.181b.5p | SEQ 1096 | AACAUUCAUUGCUGUCGGUGGGU |
| miR.181c.5p | SEQ 1097 | AACAUUCAACCUGUCGGUGAGU |
| miR.181d.5p | SEQ 1098 | AACAUUCAUUGUUGUCGGUGGGU |
| miR.185.3p | SEQ 1099 | AGGGGCUGGCUUUCCUCUGGUC |
| miR.185.5p | SEQ 1100 | UGGAGAGAAAGGCAGUUCCUGA |
| miR.186.3p | SEQ 1101 | GCCCAAAGGUGAAUUUUUUGGG |
| miR.186.5p | SEQ 1102 | CAAAGAAUUCUCCUUUUGGGCU |
| miR.187.3p | SEQ 1103 | UCGUGUCUUGUGUUGCAGCCGG |
| miR.187.5p | SEQ 1104 | GGCUACAACACAGGACCCGGGC |
| miR.18a.5p | SEQ 1105 | UAAGGUGCAUCUAGUGCAGAUAG |
| miR.18b.5p | SEQ 1106 | UAAGGUGCAUCUAGUGCAGUUAG |
| miR.1908.5p | SEQ 1107 | CGGCGGGGACGGCGAUUGGUC |
| miR.191.5p | SEQ 1108 | UCUGCCCCUCCGCUGCUGCCA |
| miR.1913 | SEQ 1109 | GGAGGGGUCCCGCACUGGGAGG |
| miR.1914.3p | SEQ 1110 | CCCUGUGCCCGGCCACUUCUG |
| miR.1914.5p | SEQ 1111 | CCCCAGGGCGACGCGGCGGG |
| miR.1915.3p | SEQ 1112 | CAACGGAAUCCCAAAAGCAGCUG |
| miR.192.5p | SEQ 1113 | CUGACCUAUGAAUUGACAGCC |
| miR.193a.3p | SEQ 1114 | AACUGGCCUACAAAGUCCCAGU |
| miR.193a.5p | SEQ 1115 | UGGGUCUUUGCGGGCGAGAUGA |
| miR.193b.3p | SEQ 1116 | AACUGGCCCUCAAAGUCCCGCU |
| miR.194.5p | SEQ 1117 | UGUAACAGCAACUCCAUGUGGA |

TABLE 1-continued

Sequences of 406 miRNAs

| miRNA | SEQ ID | Sequence |
|---|---|---|
| miR.195.5p | SEQ 1118 | UAGCAGCACAGAAAUAUUGGC |
| miR.197.3p | SEQ 1119 | UUCACCACCUUCUCCACCCAGC |
| miR.197.5p | SEQ 1120 | CGGGUAGAGAGGGCAGUGGGAGG |
| miR.1976 | SEQ 1121 | CCUCCUGCCCUCCUUGCUGU |
| miR.199a.3p | SEQ 1122 | ACAGUAGUCUGCACAUUGGUUA |
| miR.199a.5p | SEQ 1123 | CCCAGUGUUCAGACUACCUGUUC |
| miR.19a.3p | SEQ 1124 | UGUGCAAAUCUAUGCAAAACUGA |
| miR.19b.3p | SEQ 1125 | UGUGCAAAUCCAUGCAAAACUGA |
| miR.204.3p | SEQ 1126 | GCUGGGAAGGCAAAGGGACGU |
| miR.205.5p | SEQ 1127 | UCCUUCAUUCCACCGGAGUCUG |
| miR.20a.5p | SEQ 1128 | UAAAGUGCUUAUAGUGCAGGUAG |
| miR.20b.5p | SEQ 1129 | CAAAGUGCUCAUAGUGCAGGUAG |
| miR.21.3p | SEQ 1130 | CUGUGCGUGUGACAGCGGCUGA |
| miR.21.5p | SEQ 1131 | AGCCCCUGCCCACCGCACACUG |
| miR.210.3p | SEQ 1132 | UUGGGGAAACGGCCGCUGAGUG |
| miR.210.5p | SEQ 1133 | CAUCAGAAUUCAUGGAGGCUAG |
| miR.2110 | SEQ 1134 | AGCUUCCAUGACUCCUGAUGGA |
| miR.2115.3p | SEQ 1135 | CAACACCAGUCGAUGGGCUGU |
| miR.2115.5p | SEQ 1136 | UAGCUUAUCAGACUGAUGUUGA |
| miR.22.3p | SEQ 1137 | AGCUACAUUGUCUGCUGGGUUUC |
| miR.22.5p | SEQ 1138 | AGCUACAUCUGGCUACUGGGU |
| miR.221.3p | SEQ 1139 | UGUCAGUUUGUCAAAUACCCCA |
| miR.222.3p | SEQ 1140 | CGUGUAUUUGACAAGCUGAGUU |
| miR.223.3p | SEQ 1141 | AAGCUGCCAGUUGAAGAACUGU |
| miR.223.5p | SEQ 1142 | CAAGUCACUAGUGGUUCCGUU |
| miR.224.5p | SEQ 1143 | AGUCUUCAGUGGCAAGCUUUA |
| miR.2392 | SEQ 1144 | UAGGAUGGGGGUGAGAGGUG |
| miR.23a.3p | SEQ 1145 | AUCACAUUGCCAGGGAUUUCC |
| miR.23a.5p | SEQ 1146 | GGGGUUCCUGGGGAUGGGAUUU |
| miR.23b.3p | SEQ 1147 | AUCACAUUGCCAGGGAUUACC |
| miR.24.2.5p | SEQ 1148 | UGCCUACUGAGCUGAAACACAG |
| miR.24.3p | SEQ 1149 | UGGCUCAGUUCAGCAGGAACAG |
| miR.25.3p | SEQ 1150 | CAUUGCACUUGUCUCGGUCUGA |
| miR.26a.5p | SEQ 1151 | UUCAAGUAAUCCAGGAUAGGCU |
| miR.26b.3p | SEQ 1152 | CCUGUUCUCCAUUACUUGGCUC |
| miR.26b.5p | SEQ 1153 | UUCAAGUAAUUCAGGAUAGGU |
| miR.27a.3p | SEQ 1154 | UUCACAGUGGCUAAGUUCCGC |
| miR.27a.5p | SEQ 1155 | AGGGCUUAGCUGCUUGUGAGCA |
| miR.27b.3p | SEQ 1156 | UUCACAGUGGCUAAGUUCUGC |
| miR.28.5p | SEQ 1157 | AAGGAGCUCACAGUCUAUUGAG |
| miR.2861 | SEQ 1158 | GGGGCCUGGCGGUGGGCGG |
| miR.29a.3p | SEQ 1159 | UAGCACCAUCUGAAAUCGGUUA |
| miR.29b.3p | SEQ 1160 | UAGCACCAUUUGAAAUCAGUGUU |
| miR.29c.3p | SEQ 1161 | UAGCACCAUUUGAAAUCGGUUA |
| miR.29c.5p | SEQ 1162 | UGACCGAUUUCUCCUGGUGUUC |
| miR.301a.3p | SEQ 1163 | CAGUGCAAUAGUAUUGUCAAAGC |
| miR.30a.5p | SEQ 1164 | UGUAAACAUCCUCGACUGGAAG |
| miR.30b.5p | SEQ 1165 | UGUAAACAUCCUACACUCAGCU |
| miR.30c.5p | SEQ 1166 | UGUAAACAUCCUACACUCUCAGC |
| miR.30d.5p | SEQ 1167 | UGUAAACAUCCCCGACUGGAAG |
| miR.30e.3p | SEQ 1168 | CUUUCAGUCGGAUGUUUACAGC |
| miR.30e.5p | SEQ 1169 | UGUAAACAUCCUUGACUGGAAG |
| miR.3135a | SEQ 1170 | UGCCUAGGCUGAGACUGCAGUG |
| miR.3140.3p | SEQ 1171 | AGCUUUUGGGAAUUCAGGUAGU |
| miR.3140.5p | SEQ 1172 | ACCUGAAUUACCAAAAGCUUU |
| miR.3141 | SEQ 1173 | GAGGGCGGGUGGAGGAGGA |
| miR.3157.5p | SEQ 1174 | UUCAGCCAGGCUAGUGCAGUCU |
| miR.3162.5p | SEQ 1175 | UUAGGGAGUAGAAGGGUGGGGAG |
| miR.3180.3p | SEQ 1176 | UGGGGCGGAGCUUCCGGAGGCC |
| miR.3197 | SEQ 1177 | GGAGGCGCAGGCUCGGAAAGGCG |
| miR.320a | SEQ 1178 | AAAAGCUGGGUUGAGAGGGCGA |
| miR.320b | SEQ 1179 | AAAAGCUGGGUUGAGAGGGCAA |
| miR.320c | SEQ 1180 | AAAAGCUGGGUUGAGAGGGU |
| miR.320d | SEQ 1181 | AAAAGCUGGGUUGAGAGGA |
| miR.320e | SEQ 1182 | AAAGCUGGGUUGAGAAGG |
| miR.324.3p | SEQ 1183 | ACUGCCCCAGGUGCUGCUGG |
| miR.324.5p | SEQ 1184 | CGCAUCCCCUAGGGCAUUGGUGU |
| miR.326 | SEQ 1185 | CCUCUGGGCCCUUCCUCCAG |
| miR.328.3p | SEQ 1186 | CUGGCCCUCUCUGCCCUUCCGU |
| miR.329.3p | SEQ 1187 | AACACACCUGGUUAACCUCUUU |
| miR.331.3p | SEQ 1188 | GCCCCUGGGCCUAUCCUAGAA |
| miR.335.5p | SEQ 1189 | UCAAGAGCAAUAACGAAAAAUGU |
| miR.337.5p | SEQ 1190 | GAACGGCUUCAUACAGGAGUU |
| miR.338.3p | SEQ 1191 | UCCAGCAUCAGUGAUUUUGUUG |
| miR.339.3p | SEQ 1192 | UGAGCGCCUCGACGACAGAGCCG |
| miR.339.5p | SEQ 1193 | UCCCUGUCCUCCAGGAGCUCACG |

TABLE 1-continued

Sequences of 406 miRNAs

| miRNA | SEQ ID | Sequence |
|---|---|---|
| miR.33a.5p | SEQ 1194 | GUGCAUUGUAGUUGCAUUGCA |
| miR.33b.5p | SEQ 1195 | GUGCAUUGCUGUUGCAUUGC |
| miR.342.3p | SEQ 1196 | UCUCACACAGAAAUCGCACCCGU |
| miR.345.5p | SEQ 1197 | GCUGACUCCUAGUCCAGGGCUC |
| miR.34a.5p | SEQ 1198 | UGGCAGUGUCUUAGCUGGUUGU |
| miR.34b.3p | SEQ 1199 | CAAUCACUAACUCCACUGCCAU |
| miR.361.3p | SEQ 1200 | UCCCCCAGGUGUGAUUCUGAUUU |
| miR.361.5p | SEQ 1201 | UUAUCAGAAUCUCCAGGGGUAC |
| miR.362.5p | SEQ 1202 | AAUCCUUGGAACCUAGGUGUGAG |
| miR.363.3p | SEQ 1203 | AAUUGCACGGUAUCCAUCUGUAU |
| miR.3648 | SEQ 1204 | AGCCGCGGGGAUCGCCGAGGG |
| miR.3652 | SEQ 1205 | CGGCUGGAGGUGUGAGGA |
| miR.3663.5p | SEQ 1206 | GCUGGUCUGCGUGGUGCUCGG |
| miR.3674 | SEQ 1207 | AUUGUAGAACCUAAGAUUGGCC |
| miR.3687 | SEQ 1208 | CCCGGACAGGCGUUCGUGCGACGU |
| miR.370.3p | SEQ 1209 | GCCUGCUGGGGUGGAACCUGGU |
| miR.374b.5p | SEQ 1210 | AUAUAAUACAACCUGCUAAGUG |
| miR.375 | SEQ 1211 | UUUGUUCGUUCGGCUCGCGUGA |
| miR.376a.3p | SEQ 1212 | AUCAUAGAGGAAAAUCCACGU |
| miR.376c.3p | SEQ 1213 | AACAUAGAGGAAAUUCCACGU |
| miR.377.3p | SEQ 1214 | AUCACACAAAGGCAACUUUUGU |
| miR.378a.3p | SEQ 1215 | ACUGGACUUGGAGUCAGAAGGC |
| miR.378d | SEQ 1216 | ACUGGACUUGGAGUCAGAAA |
| miR.378f | SEQ 1217 | ACUGGACUUGGAGCCAGAAG |
| miR.378g | SEQ 1218 | ACUGGGCUUGGAGUCAGAAG |
| miR.378i | SEQ 1219 | ACUGGACUAGGAGUCAGAAGG |
| miR.381.3p | SEQ 1220 | UAUACAAGGGCAAGCUCUCUGU |
| miR.382.5p | SEQ 1221 | GAAGUUGUUCGUGGUGGAUUCG |
| miR.3912.3p | SEQ 1222 | UAACGCAUAAUAUGGACAUGU |
| miR.3912.5p | SEQ 1223 | AUGUCCAUAUUAUGGGUUAGU |
| miR.3937 | SEQ 1224 | ACAGGCGGCUGUAGCAAUGGGG |
| miR.3940.5p | SEQ 1225 | GUGGGUUGGGGCGGGCUCUG |
| miR.409.3p | SEQ 1226 | GAAUGUUGCUCGGUGAACCCCU |
| miR.410.3p | SEQ 1227 | AAUAUAACACAGAUGGCCUGU |
| miR.424.3p | SEQ 1228 | CAAAACGUGAGGCGCUGCUAU |
| miR.425.3p | SEQ 1229 | AUCGGGAAUGUCGUGUCCGCCC |
| miR.425.5p | SEQ 1230 | AAUGACACGAUCACUCCCGUUGA |
| miR.4257 | SEQ 1231 | CCAGAGGUGGGGACUGAG |
| miR.4270 | SEQ 1232 | UCAGGGAGUCAGGGGAGGGC |
| miR.4274 | SEQ 1233 | CAGCAGUCCCUCCCCCUG |
| miR.4279 | SEQ 1234 | CUCUCCUCCCGGCUUC |
| miR.4291 | SEQ 1235 | UUCAGCAGGAACAGCU |
| miR.4292 | SEQ 1236 | CCCCUGGGCCGGCCUUGG |
| miR.4306 | SEQ 1237 | UGGAGAGAAAGGCAGUA |
| miR.431.5p | SEQ 1238 | UGUCUUGCAGGCCGUCAUGCA |
| miR.432.5p | SEQ 1239 | UCUUGGAGUAGGUCAUUGGGUGG |
| miR.4417 | SEQ 1240 | GGUGGGCUUCCCGGAGGG |
| miR.4429 | SEQ 1241 | AAAAGCUGGGCUGAGAGGCG |
| miR.4430 | SEQ 1242 | AGGCUGGAGUGAGCGGAG |
| miR.4433b.5p | SEQ 1243 | AUGUCCACCCCCACUCCUGU |
| miR.4442 | SEQ 1244 | GCCGGACAAGAGGGAGG |
| miR.4449 | SEQ 1245 | CGUCCCGGGGCUGCGCGAGGCA |
| miR.4459 | SEQ 1246 | CCAGGAGGCGGAGGAGGUGGAG |
| miR.4461 | SEQ 1247 | GAUUGAGACUAGUAGGGCUAGGC |
| miR.4463 | SEQ 1248 | GAGACUGGGGUGGGGCC |
| miR.4478 | SEQ 1249 | GAGGCUGAGCUGAGGAG |
| miR.4481 | SEQ 1250 | GGAGUGGGCUGGUGGUU |
| miR.4484 | SEQ 1251 | AAAAGGCGGGAGAAGCCCCA |
| miR.4486 | SEQ 1252 | GCUGGGCGAGGCUGGCA |
| miR.4496 | SEQ 1253 | GAGGAAACUGAAGCUGAGAGGG |
| miR.4505 | SEQ 1254 | AGGCUGGGCUGGGACGGA |
| miR.4507 | SEQ 1255 | CUGGGUUGGGCUGGGCUGGG |
| miR.451a | SEQ 1256 | AAACCGUUACCAUUACUGAGUU |
| miR.4530 | SEQ 1257 | CCCAGCAGGACGGGAGCG |
| miR.4534 | SEQ 1258 | GGAUGGAGGAGGGGUCU |
| miR.4539 | SEQ 1259 | GCUGAACUGGGCUGAGCUGGGC |
| miR.454.3p | SEQ 1260 | UAGUGCAAUAUUGCUUAUAGGGU |
| miR.4632.5p | SEQ 1261 | GAGGGCAGCGUGGGUGUGGCGGA |
| miR.4646.5p | SEQ 1262 | ACUGGGAAGAGGAGCUGAGGGA |
| miR.4655.3p | SEQ 1263 | ACCCUCGUCAGGUCCCCGGG |
| miR.4655.5p | SEQ 1264 | CACCGGGGAUGGCAGAGGGUCG |
| miR.4656 | SEQ 1265 | UGGGCUGAGGGCAGGAGGCCUGU |
| miR.4667.5p | SEQ 1266 | ACUGGGGAGCAGAAGGAGAACC |
| miR.4690.5p | SEQ 1267 | GAGCAGGCGAGGCUGGGCUGAA |
| miR.4695.5p | SEQ 1268 | CAGGAGGCAGUGGGCGAGCAGG |
| miR.4706 | SEQ 1269 | AGCGGGGAGGAAGUGGGCGCUGCUU |

TABLE 1-continued

Sequences of 406 miRNAs

| miRNA | SEQ ID | Sequence |
|---|---|---|
| miR.4707.3p | SEQ 1270 | AGCCCGCCCCAGCCGAGGUUCU |
| miR.4726.5p | SEQ 1271 | AGGGCCAGAGGAGCCUGGAGUGG |
| miR.4728.5p | SEQ 1272 | UGGGAGGGGAGAGGCAGCAAGCA |
| miR.4734 | SEQ 1273 | GCUGCGGGCUGCGGUCAGGGCG |
| miR.4758.5p | SEQ 1274 | GUGAGUGGGAGCCGGUGGGGCUG |
| miR.4763.3 | SEQ 1275 | AGGCAGGGGCUGGUGCUGGGCGGG |
| miR.4784 | SEQ 1276 | UGAGGAGAUGCUGGGACUGA |
| miR.4793.5 | SEQ 1277 | ACAUCCUGCUCCACAGGGCAGAGG |
| miR.4800.3p | SEQ 1278 | CAUCCGUCCGUCUGUCCAC |
| miR.4800.5p | SEQ 1279 | AGUGGACCGAGGAAGGAAGGA |
| miR.484 | SEQ 1280 | UCAGGCUCAGUCCCCUCCCGAU |
| miR.485.3p | SEQ 1281 | GUCAUACACGGCUCUCCUCUCU |
| miR.486.5p | SEQ 1282 | UCCUGUACUGAGCUGCCCCGAG |
| miR.487b.3p | SEQ 1283 | AAUCGUACAGGGUCAUCCACUU |
| miR.491.5p | SEQ 1284 | AGUGGGGAACCCUUCCAUGAGG |
| miR.494.3p | SEQ 1285 | UGAAACAUACACGGGAAACCUC |
| miR.495.3p | SEQ 1286 | AAACAAACAUGGUGCACUUCUU |
| miR.5001.5p | SEQ 1287 | AGGGCUGGACUCAGCGGCGGAGCU |
| miR.5006.5p | SEQ 1288 | UUGCCAGGGCAGGAGGUGGAA |
| miR.502.3p | SEQ 1289 | AAUGCACCUGGGCAAGGAUUCA |
| miR.504.3p | SEQ 1290 | GGGAGUGCAGGGCAGGGUUUC |
| miR.505.3p | SEQ 1291 | CGUCAACACUUGCUGGUUUCCU |
| miR.5196.5p | SEQ 1292 | AGGGAAGGGGACGAGGGUUGGG |
| miR.532.3p | SEQ 1293 | CCUCCCACACCCAAGGCUUGCA |
| miR.532.5p | SEQ 1294 | CAUGCCUUGAGUGUAGGACCGU |
| miR.541.3p | SEQ 1295 | UGGUGGGCACAGAAUCUGGACU |
| miR.543 | SEQ 1296 | AAACAUUCGCGGUGCACUUCUU |
| miR.548ak | SEQ 1297 | AAAAGUAACUGCGGUUUUUGA |
| miR.548d.5p | SEQ 1298 | AAAAGUAAUUGUGGUUUUUGCC |
| miR.551b.3p | SEQ 1299 | GCGACCCAUACUUGGUUUCAG |
| miR.5585.3p | SEQ 1300 | CUGAAUAGCUGGGACUACAGGU |
| miR.5587.3p | SEQ 1301 | GCCCCGGGCAGUGUGAUCAUC |
| miR.561.3p | SEQ 1302 | CAAAGUUUAAGAUCCUUGAAGU |
| miR.566 | SEQ 1303 | GGGCGCCUGUGAUCCCAAC |
| miR.5694 | SEQ 1304 | CAGAUCAUGGGACUGUCUCAG |
| miR.5703 | SEQ 1305 | AGGAGAAGUCGGGAAGGU |
| miR.5739 | SEQ 1306 | GCGGAGAGAGAAUGGGAGC |
| miR.574.3p | SEQ 1307 | CACGCUCAUGCACACACCCACA |
| miR.574.5p | SEQ 1308 | UGAGUGUGUGUGUGUGAGUGU |
| miR.584.5p | SEQ 1309 | UUAUGGUUUGCCUGGGACUGAG |
| miR.590.5p | SEQ 1310 | GAGCUUAUUCAUAAAAGUGCAG |
| miR.6069 | SEQ 1311 | GGGCUAGGGCCUGCUGCCCCC |
| miR.6085 | SEQ 1312 | AAGGGGCUGGGGGAGCACA |
| miR.6086 | SEQ 1313 | GGAGGUUGGGAAGGGCAGAG |
| miR.6088 | SEQ 1314 | AGAGAUGAAGCGGGGGGGCG |
| miR.612 | SEQ 1315 | GCUGGGCAGGGCUUCUGAGCUCCUU |
| miR.6124 | SEQ 1316 | GGGAAAAGGAAGGGGGAGGA |
| miR.6126 | SEQ 1317 | GUGAAGGCCCGGCGGAGA |
| miR.6127 | SEQ 1318 | UGAGGGAGUGGGUGGGAGG |
| miR.6131 | SEQ 1319 | GGCUGGUCAGAUGGGAGUG |
| miR.6165 | SEQ 1320 | CAGCAGGAGGUGAGGGGAG |
| miR.625.5p | SEQ 1321 | AGGGGGAAAGUUCUAUAGUCC |
| miR.629.5p | SEQ 1322 | UGGGUUUACGUUGGGAGAACU |
| miR.6511b.3p | SEQ 1323 | CCUCACCACCCCUUCUGCCUGCA |
| miR.652.3p | SEQ 1324 | AAUGGCGCCACUAGGGUUGUG |
| miR.654.5p | SEQ 1325 | UGGUGGGCCGCAGAACAUGUGC |
| miR.658 | SEQ 1326 | GGCGGAGGGAAGUAGGUCCGUUGGU |
| miR.660.5p | SEQ 1327 | UACCCAUUGCAUAUCGGAGUUG |
| miR.663b | SEQ 1328 | GGUGGCCCGGCCGUGCCUGAGG |
| miR.664a.3p | SEQ 1329 | UAUUCAUUUAUCCCCAGCCUACA |
| miR.664b.5p | SEQ 1330 | UGGGCUAAGGGAGAUGAUUGGGUA |
| miR.671.5p | SEQ 1331 | AGGAAGCCCUGGAGGGGCUGGAG |
| miR.6716.5p | SEQ 1332 | UGGGAAUGGGGGUAAGGGCC |
| miR.6723.5p | SEQ 1333 | AUAGUCCGAGUAACGUCGGGC |
| miR.6726.5p | SEQ 1334 | CGGGAGCUGGGGUCUGCAGGU |
| miR.6727.5p | SEQ 1335 | CUCGGGGCAGGCGGCUGGGAGCG |
| miR.6729.3p | SEQ 1336 | UCAUCCCCCUCGCCCUCUCAG |
| miR.6738.5p | SEQ 1337 | CGAGGGGUAGAAGAGCACAGGGG |
| miR.6741.3p | SEQ 1338 | UCGGCUCUCUCCCUCACCCUAG |
| miR.6741.5p | SEQ 1339 | GUGGGUGCUGGUGGGAGCCGUG |
| miR.6742.5p | SEQ 1340 | AGUGGGUGGGACCCAGCUGUU |
| miR.6746.5p | SEQ 1341 | CCGGGAGAAGGAGGUGGCCUGG |
| miR.6756.5p | SEQ 1342 | AGGGUGGGGCUGGAGGUGGGCU |
| miR.6765.5p | SEQ 1343 | GUGAGGCGGGGCCAGGAGGGUGUGU |
| miR.6769a.5p | SEQ 1344 | AGGUGGGUAUGGAGGAGCCCU |
| miR.6769b.3p | SEQ 1345 | CCCUCUCUGUCCCACCCAUAG |

TABLE 1-continued

Sequences of 406 miRNAs

| miRNA | SEQ ID | Sequence |
|---|---|---|
| miR.6771.3p | SEQ 1346 | CAAACCCCUGUCUACCCGCAG |
| miR.6771.5p | SEQ 1347 | CUCGGGAGGGCAUGGGCCAGGC |
| miR.6775.3p | SEQ 1348 | AGGCCCUGUCCUCUGCCCAG |
| miR.6775.5p | SEQ 1349 | UCGGGGCAUGGGGAGGGAGGCUGG |
| miR.6778.5p | SEQ 1350 | AGUGGGAGGACAGGAGGCAGGU |
| miR.6780b.5p | SEQ 1351 | UGGGGAAGGCUUGGCAGGGAAGA |
| miR.6781.5p | SEQ 1352 | CGGGCCGGAGGUCAAGGGCGU |
| miR.6782.5p | SEQ 1353 | UAGGGGUGGGGGAAUUCAGGGGUGU |
| miR.6785.3p | SEQ 1354 | ACAUCGCCCCACCUUCCCCAG |
| miR.6789.5p | SEQ 1355 | GUAGGGGCGUCCCGGGCGCGCGGG |
| miR.6791.5p | SEQ 1356 | CCCCUGGGGCUGGGCAGGCGGA |
| miR.6794.5p | SEQ 1357 | CAGGGGGACUGGGGGUGAGC |
| miR.6795.3p | SEQ 1358 | ACCCCUCGUUUCUUCCCCCAG |
| miR.6796.3p | SEQ 1359 | GAAGCUCUCCCCUCCCCGCAG |
| miR.6797.5p | SEQ 1360 | AGGAGGGAAGGGGCUGAGAACAGGA |
| miR.6798.5p | SEQ 1361 | CCAGGGGAUGGGCGAGCUUGGG |
| miR.6799.5p | SEQ 1362 | GGGGAGGUGUGCAGGGCUGG |
| miR.6802.5p | SEQ 1363 | CUAGGUGGGGGGCUUGAAGC |
| miR.6803.3p | SEQ 1364 | UCCCUCGCCUUCUCACCCUCAG |
| miR.6803.5p | SEQ 1365 | CUGGGGGUGGGGGGCUGGGCGU |
| miR.6809.5p | SEQ 1366 | UGGCAAGGAAAGAAGAGGAUCA |
| miR.6810.3p | SEQ 1367 | UCCCCUGCUCCCUUGUUCCCCAG |
| miR.6812.5p | SEQ 1368 | AUGGGGUGAGAUGGGGAGGAGCAGC |
| miR.6813.3p | SEQ 1369 | AACCUUGGCCCCUCUCCCCAG |
| miR.6819.3p | SEQ 1370 | AAGCCUCUGUCCCCACCCCAG |
| miR.6821.5p | SEQ 1371 | GUGCGUGGUGGCUCGAGGCGGGG |
| miR.6824.5p | SEQ 1372 | GUAGGGGAGGUUGGGCAGGGA |
| miR.6829.5p | SEQ 1373 | UGGGCUGCUGAGAAGGGGCA |
| miR.6845.5p | SEQ 1374 | CGGGGCCAGAGCAGAGAGC |
| miR.6852.3p | SEQ 1375 | UGUCCUCUGUUCCUCAG |
| miR.6852.5p | SEQ 1376 | CCCUGGGGUUCUGAGGACAUG |
| miR.6869.5p | SEQ 1377 | GUGAGUAGUGGCGCGCGGCGGC |
| miR.6870.3p | SEQ 1378 | GCUCAUCCCCAUCUCCUUUCAG |
| miR.6870.5p | SEQ 1379 | UGGGGGAGAUGGGGGUUGA |
| miR.6873.3p | SEQ 1380 | UUCUCUCUGUCUUUCUCUCAG |
| miR.6875.5p | SEQ 1381 | UGAGGGACCCAGGACAGGAGA |
| miR.6877.5p | SEQ 1382 | AGGGCCGAAGGGUGGAAGCUGC |
| miR.6880.5p | SEQ 1383 | UGGUGGAGGAAGAGGGCAGCUC |
| miR.6892.3p | SEQ 1384 | UCCCUCUCCCACCCCUUGCAG |
| miR.6894.5p | SEQ 1385 | AGGAGGAUGGAGAGCUGGGCCAGA |
| miR.7106.5p | SEQ 1386 | UGGGAGGAGGGGAUCUUGGG |
| miR.7107.5p | SEQ 1387 | UCGGCCUGGGGAGGAGGAAGGG |
| miR.7108.5p | SEQ 1388 | GUGUGGCCGGCAGGCGGGUGG |
| miR.7111.5p | SEQ 1389 | UGGGGGAGGAAGGACAGGCCAU |
| miR.7114.3p | SEQ 1390 | UGACCCACCCCUCUCCACCAG |
| miR.7150 | SEQ 1391 | CUGGCAGGGGAGAGGUA |
| miR.744.5p | SEQ 1392 | UGCGGGGCUAGGGCUAACAGCA |
| miR.764 | SEQ 1393 | GCAGGUGCUCACUUGUCCUCCU |
| miR.765 | SEQ 1394 | UGGAGGAGAAGGAAGGUGAUG |
| miR.766.3p | SEQ 1395 | ACUCCAGCCCCACAGCCUCAGC |
| miR.766.5p | SEQ 1396 | AGGAGGAAUUGGUGCUGGUCUU |
| miR.769.5p | SEQ 1397 | UGAGACCUCUGGGUUCUGAGCU |
| miR.7845.5p | SEQ 1398 | AAGGGACAGGGAGGGUCGUGG |
| miR.7851.3p | SEQ 1399 | UACCUGGGAGACUGAGGUUGGA |
| miR.8069 | SEQ 1400 | GGAUGGUUGGGGCGGUCGGCGU |
| miR.8071 | SEQ 1401 | CGGUGGACUGGAGUGGGUGG |
| miR.8078 | SEQ 1402 | GGUCUAGGCCCGGUGAGAGACUC |
| miR.8085 | SEQ 1403 | UGGGAGAGAGGACUGUGAGGC |
| miR.8089 | SEQ 1404 | CCUGGGGACAGGGGAUUGGGCAG |
| miR.874.3p | SEQ 1405 | CUGCCCUGGCCCGAGGGACCGA |
| miR.877.3p | SEQ 1406 | UCCUCUUCUCCCUCCUCCCAG |
| miR.877.5p | SEQ 1407 | GUAGAGGAGAUGGCGCAGGG |
| miR.920 | SEQ 1408 | GGGGAGCUGUGGAAGCAGUA |
| miR.92a.3p | SEQ 1409 | UAUUGCACUUGUCCCGGCCUGU |
| miR.92b.3p | SEQ 1410 | UAUUGCACUCGUCCCGGCCUCC |
| miR.93.3p | SEQ 1411 | ACUGCUGAGCUAGCACUUCCCG |
| miR.93.5p | SEQ 1412 | CAAAGUGCUGUUCGUGCAGGUAG |
| miR.99a.5p | SEQ 1413 | AACCCGUAGAUCCGAUCUUGUG |
| miR.99b.5p | SEQ 1414 | CACCCGUAGAACCGACCUUGCG |

Out of the 406 detectable miRNAs analyzed, 28 miRNAs showed a statistically significant difference (Welch T-test p value <0.05), and among these candidates, 7 candidates showed a p value <0.01. The 28 miRNAs are shown in Table 2.

TABLE 2

List of 28 miRNAs useful based on their p value < 0.05. SD: standard deviation

| miRNA candidate | p value | Mean Log2 AD | SD log2 AD | Mean Log2 HC | SD log2 HC | Fold change | AUC |
|---|---|---|---|---|---|---|---|
| miR.99a.5p | 0.00025 | 8.92 | 0.53 | 8.52 | 0.42 | 1.348 | 0.268 |
| miR.378d | 0.00114 | 6.49 | 0.44 | 6.13 | 0.55 | 1.252 | 0.303 |
| miR.100.5p | 0.00147 | 7.51 | 0.54 | 7.18 | 0.38 | 1.304 | 0.301 |
| miR.193b.3p | 0.00242 | 6.75 | 1.01 | 6.14 | 0.80 | 1.716 | 0.307 |
| miR.34a.5p | 0.00602 | 6.84 | 0.89 | 6.32 | 0.81 | 1.479 | 0.342 |
| miR.1306.5p | 0.00865 | 7.13 | 0.44 | 6.90 | 0.39 | 1.190 | 0.328 |
| miR.1229.3p | 0.00909 | 6.08 | 0.59 | 5.60 | 1.05 | 1.306 | 0.301 |
| miR.195.5p | 0.01062 | 6.40 | 0.78 | 5.98 | 0.74 | 1.360 | 0.333 |
| miR.6880.5p | 0.01316 | 7.83 | 0.81 | 8.27 | 0.82 | 0.717 | 0.655 |
| miR.192.5p | 0.01449 | 7.96 | 1.04 | 7.48 | 0.70 | 1.666 | 0.378 |
| miR.532.5p | 0.01485 | 7.27 | 0.53 | 7.01 | 0.43 | 1.225 | 0.354 |
| miR.125b.5p | 0.01546 | 8.52 | 0.52 | 8.26 | 0.46 | 1.212 | 0.341 |
| miR.375 | 0.01644 | 7.19 | 1.03 | 6.66 | 0.99 | 1.468 | 0.363 |
| miR.378a.3p | 0.01800 | 7.93 | 0.46 | 7.70 | 0.43 | 1.184 | 0.381 |
| miR.532.3p | 0.01880 | 7.02 | 0.71 | 6.67 | 0.63 | 1.300 | 0.334 |
| miR.378i | 0.01888 | 7.64 | 0.43 | 7.43 | 0.40 | 1.165 | 0.351 |
| miR.194.5p | 0.01913 | 7.32 | 1.24 | 6.77 | 0.89 | 1.823 | 0.369 |
| miR.122.5p | 0.02053 | 10.72 | 1.49 | 10.04 | 1.17 | 2.225 | 0.380 |
| miR.141.3p | 0.02126 | 6.30 | 0.51 | 6.05 | 0.51 | 1.195 | 0.370 |
| miR.660.5p | 0.02134 | 7.54 | 0.92 | 7.10 | 0.84 | 1.415 | 0.363 |
| miR.5196.5p | 0.03121 | 9.19 | 0.84 | 9.59 | 0.86 | 0.741 | 0.649 |
| miR.6769a.5p | 0.03130 | 6.66 | 0.82 | 7.04 | 0.79 | 0.764 | 0.647 |
| miR.378f | 0.03183 | 7.02 | 0.46 | 6.80 | 0.50 | 1.160 | 0.375 |
| miR.144.3p | 0.03740 | 6.78 | 2.07 | 5.74 | 2.49 | 1.606 | 0.372 |
| miR.7111.5p | 0.03968 | 9.63 | 0.78 | 10.02 | 0.92 | 0.733 | 0.622 |
| miR.4270 | 0.04181 | 6.93 | 0.77 | 7.25 | 0.64 | 0.831 | 0.636 |
| miR.664a.3p | 0.04186 | 6.24 | 1.10 | 5.59 | 1.76 | 1.280 | 0.396 |
| miR.502.3p | 0.04801 | 6.14 | 0.75 | 5.83 | 0.70 | 1.262 | 0.378 |

Among the 406 detected miRNA, a total of 74 miRNA candidates also showed an AUC value ≥0.6 or ≤0.4; of which a total of 11 candidates showed a good AUC value of ≥0.65 or ≤0.35; and 1 candidates showed a very good AUC value of ≥0.7 or ≤0.30. The 74 candidate miRNAs are shown in Table 3.

TABLE 3

List of 74 candidates also showed an AUC value of ≥0.6 or ≤0.40

| miRNA | AUC |
|---|---|
| miR.99a.5p | 0.268 |
| miR.1229.3p | 0.301 |
| miR.100.5p | 0.301 |
| miR.378d | 0.303 |
| miR.193b.3p | 0.307 |
| miR.1306.5p | 0.328 |
| miR.195.5p | 0.333 |
| miR.532.3p | 0.334 |
| miR.125b.5p | 0.341 |
| miR.34a.5p | 0.342 |
| miR.378i | 0.351 |
| miR.532.5p | 0.354 |
| miR.375 | 0.363 |
| miR.660.5p | 0.363 |
| miR.194.5p | 0.369 |
| miR.141.3p | 0.370 |
| miR.144.3p | 0.372 |
| miR.1234.3p | 0.373 |
| miR.378f | 0.375 |
| miR.181b.5p | 0.376 |
| miR.502.3p | 0.378 |
| miR.192.5p | 0.378 |
| miR.766.3p | 0.378 |
| miR.122.5p | 0.380 |
| miR.378a.3p | 0.381 |
| miR.145.5p | 0.383 |
| miR.139.5p | 0.384 |
| miR.150.5p | 0.386 |
| miR.193a.3p | 0.390 |
| miR.342.3p | 0.391 |
| miR.210.3p | 0.392 |
| miR.144.5p | 0.392 |
| miR.27b.3p | 0.394 |
| miR.664a.3p | 0.396 |
| miR.16.5p | 0.396 |
| miR.877.3p | 0.397 |
| miR.29a.3p | 0.400 |
| miR.130a.3p | 0.400 |
| miR.6794.5p | 0.601 |
| miR.1908.5p | 0.601 |
| miR.6799.5p | 0.602 |
| miR.3141 | 0.604 |
| miR.6738.5p | 0.604 |
| miR.6894.5p | 0.604 |
| miR.7851.3p | 0.605 |
| miR.4695.5p | 0.608 |
| miR.23a.5p | 0.609 |
| miR.4463 | 0.610 |
| miR.382.5p | 0.611 |
| miR.4655.5p | 0.611 |
| miR.4800.5p | 0.612 |
| miR.6746.5p | 0.613 |
| miR.4667.5p | 0.614 |
| miR.4656 | 0.614 |
| miR.1914.3p | 0.616 |
| miR.1275 | 0.618 |
| miR.8089 | 0.619 |
| miR.5703 | 0.619 |
| miR.6124 | 0.621 |
| miR.2392 | 0.621 |
| miR.7111.5p | 0.622 |
| miR.8085 | 0.622 |
| miR.6716.5p | 0.624 |
| miR.6778.5p | 0.625 |
| miR.6797.5p | 0.625 |
| miR.4534 | 0.633 |
| miR.6775.5p | 0.635 |
| miR.4270 | 0.636 |
| miR.6812.5p | 0.638 |
| miR.6086 | 0.645 |
| miR.765 | 0.645 |
| miR.6769a.5p | 0.647 |
| miR.5196.5p | 0.649 |
| miR.6880.5p | 0.655 |

Among the 406 detected miRNAs, a total of 15 candidates showed both an AUC value of ≥0.6 or ≤0.4 and a fold change value of ≥1.49 or ≤0.75. The list of the 15 miRNAs are shown in Table 4.

TABLE 4

List of 15 candidates showing both an AUC value of ≥0.6 or ≤0.4 and a fold change value of ≥1.49 or ≤0.75

| miRNA | p value | Fold change | AUC |
|---|---|---|---|
| miR.23a.5p | 0.06528 | 0.630 | 0.609 |
| miR.6880.5p | 0.01316 | 0.717 | 0.655 |
| miR.7111.5p | 0.03968 | 0.733 | 0.622 |
| miR.6812.5p | 0.05632 | 0.735 | 0.638 |
| miR.6738.5p | 0.07930 | 0.741 | 0.604 |
| miR.5196.5p | 0.03121 | 0.741 | 0.649 |
| miR.6894.5p | 0.10422 | 0.746 | 0.604 |
| miR.8085 | 0.27457 | 0.747 | 0.622 |
| miR.4463 | 0.08930 | 0.748 | 0.610 |
| miR.2392 | 0.10513 | 0.748 | 0.621 |
| miR.144.3p | 0.03740 | 1.606 | 0.372 |
| miR.192.5p | 0.01449 | 1.666 | 0.378 |
| miR.193b.3p | 0.00242 | 1.716 | 0.307 |

TABLE 4-continued

List of 15 candidates showing both an AUC value of ≥0.6 or ≤0.4 and a fold change value of ≥1.49 or ≤0.75

| miRNA | p value | Fold change | AUC |
|---|---|---|---|
| miR.194.5p | 0.01913 | 1.823 | 0.369 |
| miR.122.5p | 0.02053 | 2.225 | 0.380 |

Out of the 127802 lncRNAs sequenced, 19867 lncRNAs were selected based on their threshold expression level for statistical analysis. The comparison of the AD patient with healthy control populations showed that 1008 lncRNAs are differentially expressed with a statistical significance (p value <0.05, Wilcoxon test) (Table 5). The sequences of these 1008 lncRNAs are shown in the sequence listing included in this application.

TABLE 5

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| ADAMTS9-AS2:12 | SEQ0397 | 0.02049 | 0.852 | 0.778 |
| ADNP-AS1:12 | SEQ0340 | 0.01727 | 0.809 | 0.785 |
| ADPGK-AS1:7 | SEQ0858 | 0.0449 | 1.225 | 0.257 |
| APTR:17 | SEQ0260 | 0.01209 | 1.147 | 0.201 |
| ARF4-AS1:8 | SEQ0859 | 0.0449 | 1.143 | 0.257 |
| ARRDC3-AS1:7 | SEQ0050 | 0.00232 | 0.441 | 0.854 |
| BISPR:24 | SEQ0566 | 0.02842 | 0.579 | 0.764 |
| BLACAT1:3 | SEQ0300 | 0.01449 | 1.717 | 0.208 |
| BLACAT1:5 | SEQ0341 | 0.01727 | 0.424 | 0.785 |
| CALML3-AS1:9 | SEQ0136 | 0.00681 | 1.567 | 0.181 |
| CASC15:51 | SEQ0567 | 0.02842 | 1.273 | 0.236 |
| CASC20:2 | SEQ0860 | 0.0449 | 0.765 | 0.743 |
| CERS3-AS1:5 | SEQ0301 | 0.01449 | 1.251 | 0.208 |
| CFAP58-AS1:4 | SEQ0109 | 0.00556 | 1.464 | 0.174 |
| CLRN1-AS1:1 | SEQ0475 | 0.02418 | 0.793 | 0.771 |
| CPB2-AS1:18 | SEQ0476 | 0.02418 | 0.682 | 0.771 |
| CYTOR:18 | SEQ0062 | 0.00291 | 1.278 | 0.153 |
| DARS-AS1:47 | SEQ0178 | 0.00829 | 2.015 | 0.188 |
| DDX11-AS1:5 | SEQ0861 | 0.0449 | 1.256 | 0.257 |
| DLEU2:26 | SEQ0862 | 0.0449 | 1.076 | 0.257 |
| DLEU2:45 | SEQ0863 | 0.0449 | 0.882 | 0.743 |
| DLGAP2-AS1:18 | SEQ0656 | 0.03324 | 0.789 | 0.757 |
| DPH6-AS1:3 | SEQ0342 | 0.01727 | 2.004 | 0.215 |
| EGFR-AS1:4 | SEQ0093 | 0.00451 | 0.81 | 0.833 |
| EGOT:11 | SEQ0110 | 0.00556 | 1.195 | 0.174 |
| EIF3J-AS1:21 | SEQ0261 | 0.01209 | 0.87 | 0.799 |
| ERICH3-AS1:4 | SEQ0864 | 0.0449 | 0.888 | 0.743 |
| EXTL3-AS1:16 | SEQ0568 | 0.02842 | 0.739 | 0.764 |
| FAM66B:14 | SEQ0063 | 0.00291 | 0.604 | 0.847 |
| FLG-AS1:14 | SEQ0752 | 0.03872 | 1.18 | 0.25 |
| FLVCR1-AS1:13 | SEQ0137 | 0.00681 | 0.413 | 0.819 |
| FRG1-DT:6 | SEQ0865 | 0.0449 | 0.873 | 0.743 |
| GAS1RR:11 | SEQ0302 | 0.01449 | 0.848 | 0.792 |
| GAS6-AS2:9 | SEQ0303 | 0.01449 | 0.787 | 0.792 |
| GPC5-AS1:7 | SEQ0753 | 0.03872 | 0.623 | 0.75 |
| GPR158-AS1:1 | SEQ0398 | 0.02049 | 0.775 | 0.778 |
| GRM5-AS1:1 | SEQ0138 | 0.00681 | 0.83 | 0.819 |
| HAND2-AS1:58 | SEQ0094 | 0.00451 | 0.587 | 0.833 |
| HAND2-AS1:59 | SEQ0111 | 0.00556 | 0.592 | 0.826 |
| HAND2-AS1:70 | SEQ0039 | 0.00183 | 0.543 | 0.861 |
| HAND2-AS1:71 | SEQ0076 | 0.00364 | 0.565 | 0.84 |
| HCG23:5 | SEQ0754 | 0.03872 | 0.813 | 0.75 |
| KAZN-AS1:4 | SEQ0399 | 0.02049 | 0.732 | 0.778 |
| KCNQ1-AS1:3 | SEQ0569 | 0.02842 | 0.848 | 0.764 |
| KCNQ1OT1:8 | SEQ0139 | 0.00681 | 0.908 | 0.819 |
| LACTB2-AS1:1 | SEQ0755 | 0.03872 | 1.206 | 0.25 |
| LINC00158:5 | SEQ0570 | 0.02842 | 0.748 | 0.764 |
| LINC00200:6 | SEQ0064 | 0.00291 | 1.29 | 0.153 |
| LINC00276:2 | SEQ0866 | 0.0449 | 0.846 | 0.743 |
| LINC00354:4 | SEQ0867 | 0.0449 | 1.284 | 0.257 |
| LINC00458:19 | SEQ0571 | 0.02842 | 0.789 | 0.764 |
| LINC00460:13 | SEQ0868 | 0.0449 | 0.752 | 0.743 |
| LINC00472:21 | SEQ0140 | 0.00681 | 1.389 | 0.181 |
| LINC00554:2 | SEQ0756 | 0.03872 | 0.766 | 0.75 |
| LINC00554:4 | SEQ0757 | 0.03872 | 0.766 | 0.75 |
| LINC00574:13 | SEQ0112 | 0.00556 | 0.771 | 0.826 |
| LINC00589:3 | SEQ0869 | 0.0449 | 0.781 | 0.743 |
| LINC00649:23 | SEQ0077 | 0.00364 | 0.619 | 0.84 |
| LINC00698:2 | SEQ0657 | 0.03324 | 0.85 | 0.757 |
| LINC00707:9 | SEQ0572 | 0.02842 | 1.304 | 0.236 |
| LINC00839:18 | SEQ0113 | 0.00556 | 0.874 | 0.826 |
| LINC00882:70 | SEQ0028 | 0.00111 | 0.867 | 0.875 |
| LINC00882:71 | SEQ0029 | 0.00111 | 0.867 | 0.875 |
| LINC00887:15 | SEQ0870 | 0.0449 | 0.925 | 0.743 |
| LINC00895:3 | SEQ0179 | 0.00829 | 1.491 | 0.188 |
| LINC00927:21 | SEQ0658 | 0.03324 | 0.619 | 0.757 |
| LINC00927:22 | SEQ0659 | 0.03324 | 0.619 | 0.757 |
| LINC00927:24 | SEQ0343 | 0.01727 | 0.772 | 0.785 |
| LINC00938:6 | SEQ0262 | 0.01209 | 0.811 | 0.799 |
| LINC00963:67 | SEQ0573 | 0.02842 | 1.379 | 0.236 |
| LINC01050:6 | SEQ0114 | 0.00556 | 0.82 | 0.826 |
| LINC01058:3 | SEQ0871 | 0.0449 | 1.225 | 0.257 |
| LINC01087:1 | SEQ0141 | 0.00681 | 0.764 | 0.819 |
| LINC01088:18 | SEQ0660 | 0.03324 | 0.757 | 0.757 |
| LINC01107:1 | SEQ0304 | 0.01449 | 0.768 | 0.792 |
| LINC01122:27 | SEQ0574 | 0.02842 | 1.263 | 0.236 |
| LINC01146:14 | SEQ0758 | 0.03872 | 0.774 | 0.75 |
| LINC01153:1 | SEQ0661 | 0.03324 | 1.169 | 0.243 |
| LINC01185:7 | SEQ0575 | 0.02842 | 0.793 | 0.764 |
| LINC02252:3 | SEQ0765 | 0.03872 | 0.881 | 0.75 |
| LINC02323:8 | SEQ0307 | 0.01449 | 0.622 | 0.792 |
| LINC02334:6 | SEQ0581 | 0.02842 | 0.737 | 0.764 |
| LINC02345:11 | SEQ0013 | 0.00066 | 1.181 | 0.111 |
| LINC02432:9 | SEQ0180 | 0.00829 | 0.776 | 0.813 |
| LINC02473:3 | SEQ0065 | 0.00291 | 0.786 | 0.847 |
| LINC02519:7 | SEQ0875 | 0.0449 | 0.682 | 0.743 |
| LINC02554:5 | SEQ0404 | 0.02049 | 0.744 | 0.778 |
| LINC02580:5 | SEQ0484 | 0.02418 | 0.767 | 0.771 |
| lnc-AASDHPPT-3:1 | SEQ0409 | 0.02049 | 0.715 | 0.778 |
| lnc-ABCA1-8:9 | SEQ0589 | 0.02842 | 0.592 | 0.764 |
| lnc-ABCA5-14:2 | SEQ0881 | 0.0449 | 1.164 | 0.257 |
| lnc-ABCA5-7:1 | SEQ0014 | 0.00066 | 1.309 | 0.111 |
| lnc-ABCG2-3:5 | SEQ0667 | 0.03324 | 0.758 | 0.757 |
| lnc-ACO1-1:1 | SEQ0590 | 0.02842 | 0.759 | 0.764 |
| lnc-ACOT12-9:1 | SEQ0053 | 0.00232 | 0.727 | 0.854 |
| lnc-ACTL7B-8:1 | SEQ0493 | 0.02418 | 0.697 | 0.771 |
| lnc-ADAD1-3:1 | SEQ0774 | 0.03872 | 0.828 | 0.75 |
| lnc-ADAMTS20-3:1 | SEQ0494 | 0.02418 | 1.219 | 0.229 |
| lnc-ADAMTS5-1:1 | SEQ0882 | 0.0449 | 0.851 | 0.743 |
| lnc-ADAT1-1:1 | SEQ0495 | 0.02418 | 0.877 | 0.771 |
| lnc-ADRA2A-4:1 | SEQ0883 | 0.0449 | 0.729 | 0.743 |
| lnc-ADRB1-4:1 | SEQ0118 | 0.00556 | 0.858 | 0.826 |
| lnc-AFG1L-5:1 | SEQ0263 | 0.01209 | 1.407 | 0.201 |
| lnc-AGO2-2:2 | SEQ0119 | 0.00556 | 0.511 | 0.826 |
| lnc-AGO2-2:3 | SEQ0668 | 0.03324 | 1.442 | 0.243 |
| lnc-AGR3-6:1 | SEQ0884 | 0.0449 | 1.156 | 0.257 |
| lnc-AHR-5:1 | SEQ0264 | 0.01209 | 0.792 | 0.799 |
| lnc-AIG1-5:1 | SEQ0496 | 0.02418 | 0.862 | 0.771 |
| lnc-AKAP9-1:2 | SEQ0775 | 0.03872 | 0.704 | 0.75 |
| lnc-AKIRIN1-1:11 | SEQ0591 | 0.02842 | 0.553 | 0.764 |
| lnc-AKR1C2-3:17 | SEQ0097 | 0.00451 | 0.768 | 0.833 |
| lnc-AKR1D1-5:2 | SEQ0098 | 0.00451 | 0.891 | 0.833 |
| lnc-AKR1D1-8:3 | SEQ0885 | 0.0449 | 0.797 | 0.743 |
| lnc-AKR1E2-15:1 | SEQ0410 | 0.02049 | 1.303 | 0.222 |
| lnc-AKR7A2-2:1 | SEQ0145 | 0.00681 | 1.339 | 0.181 |
| lnc-AKT1-1:15 | SEQ0411 | 0.02049 | 0.825 | 0.778 |
| lnc-ALB-1:12 | SEQ0146 | 0.00681 | 1.448 | 0.181 |
| lnc-ALB-1:6 | SEQ0886 | 0.0449 | 0.881 | 0.743 |
| lnc-ALDH3B2-3:4 | SEQ0412 | 0.02049 | 0.89 | 0.778 |
| lnc-ALG14-5:2 | SEQ0350 | 0.01727 | 0.697 | 0.785 |
| lnc-ALS2CR12-1:2 | SEQ0351 | 0.01727 | 0.729 | 0.785 |
| lnc-ANAPC11-2:6 | SEQ0887 | 0.0449 | 1.836 | 0.257 |
| lnc-ANKRD1-1:6 | SEQ0888 | 0.0449 | 0.77 | 0.743 |
| lnc-ANKRD26-1:3 | SEQ0497 | 0.02418 | 0.852 | 0.771 |
| lnc-ANKRD30BL-2:2 | SEQ0413 | 0.02049 | 0.747 | 0.778 |
| lnc-ANKRD46-1:3 | SEQ0669 | 0.03324 | 0.687 | 0.757 |

TABLE 5-continued

The Sequence number, p value, mean +/− SD, fold change
and AUC of the 1008 lncRNAs with differential expression in
AD group versus healthy control group (p value < 0.05, Wilcoxon test)

| lncRNA | SEQ | p value | Fold change | AUC |
|---|---|---|---|---|
| lnc-ANXA3-8:1 | SEQ0670 | 0.03324 | 0.838 | 0.757 |
| lnc-APBA1-5:1 | SEQ0592 | 0.02842 | 0.781 | 0.764 |
| lnc-APIP-1:13 | SEQ0776 | 0.03872 | 0.807 | 0.75 |
| lnc-APLP2-4:1 | SEQ0054 | 0.00232 | 0.786 | 0.854 |
| lnc-APOB-1:2 | SEQ0777 | 0.03872 | 0.583 | 0.75 |
| lnc-APPL2-1:2 | SEQ0498 | 0.02418 | 1.133 | 0.229 |
| lnc-AQP8-2:7 | SEQ0352 | 0.01727 | 1.254 | 0.215 |
| lnc-ARAP2-9:1 | SEQ0147 | 0.00681 | 0.795 | 0.819 |
| lnc-ARHGAP15-17:1 | SEQ0353 | 0.01727 | 0.857 | 0.785 |
| lnc-ARHGAP15-22:1 | SEQ0593 | 0.02842 | 0.846 | 0.764 |
| lnc-ARHGAP21-1:2 | SEQ0309 | 0.01449 | 0.723 | 0.792 |
| lnc-ARHGAP26-4:11 | SEQ0189 | 0.00829 | 0.923 | 0.813 |
| lnc-ARHGAP26-4:33 | SEQ0778 | 0.03872 | 0.71 | 0.75 |
| lnc-ARHGAP26-4:39 | SEQ0889 | 0.0449 | 1.383 | 0.257 |
| lnc-ARHGEF26-2:1 | SEQ0067 | 0.00291 | 1.399 | 0.153 |
| lnc-ARHGEF5-5:1 | SEQ0354 | 0.01727 | 0.712 | 0.785 |
| lnc-ARID2-7:1 | SEQ0671 | 0.03324 | 0.924 | 0.757 |
| lnc-ARNTL-2:1 | SEQ0265 | 0.01209 | 0.61 | 0.799 |
| lnc-ARRDC4-7:1 | SEQ0779 | 0.03872 | 0.876 | 0.75 |
| lnc-ART5-2:1 | SEQ0414 | 0.02049 | 0.787 | 0.778 |
| lnc-ATAD1-5:2 | SEQ0148 | 0.00681 | 0.738 | 0.819 |
| lnc-ATIC-2:8 | SEQ0780 | 0.03872 | 0.554 | 0.75 |
| lnc-ATP12A-3:1 | SEQ0499 | 0.02418 | 0.763 | 0.771 |
| lnc-ATP13A4-2:4 | SEQ0672 | 0.03324 | 1.64 | 0.243 |
| lnc-ATP5O-3:1 | SEQ0224 | 0.01004 | 1.358 | 0.194 |
| lnc-ATP6V0E2-7:1 | SEQ0500 | 0.02418 | 1.361 | 0.229 |
| lnc-ATP6V1B2-2:6 | SEQ0594 | 0.02842 | 1.132 | 0.236 |
| lnc-ATP6V1B2-2:7 | SEQ0595 | 0.02842 | 1.132 | 0.236 |
| lnc-ATP8A2-1:1 | SEQ0355 | 0.01727 | 1.477 | 0.215 |
| lnc-ATXN2-1:1 | SEQ0099 | 0.00451 | 0.792 | 0.833 |
| lnc-ATXN7-11:1 | SEQ0501 | 0.02418 | 1.319 | 0.229 |
| lnc-ATXN7L1-1:1 | SEQ0890 | 0.0449 | 1.32 | 0.257 |
| lnc-AUH-2:7 | SEQ0190 | 0.00829 | 0.584 | 0.813 |
| lnc-AUH-2:9 | SEQ0673 | 0.03324 | 1.35 | 0.243 |
| lnc-AUH-4:1 | SEQ0596 | 0.02842 | 0.79 | 0.764 |
| lnc-BAG3-4:4 | SEQ0891 | 0.0449 | 1.314 | 0.257 |
| lnc-BARHL2-4:4 | SEQ0100 | 0.00451 | 0.736 | 0.833 |
| lnc-BCHE-1:1 | SEQ0674 | 0.03324 | 0.741 | 0.757 |
| lnc-BCL6-9:1 | SEQ0310 | 0.01449 | 0.885 | 0.792 |
| lnc-BIRC2-5:5 | SEQ0225 | 0.01004 | 0.831 | 0.806 |
| lnc-BIRC6-1:4 | SEQ0892 | 0.0449 | 0.829 | 0.743 |
| lnc-BMS1-2:1 | SEQ0675 | 0.03324 | 1.124 | 0.243 |
| lnc-BNC2-5:1 | SEQ0191 | 0.00829 | 1.299 | 0.188 |
| lnc-BORA-3:1 | SEQ0192 | 0.00829 | 0.67 | 0.813 |
| lnc-BRD1-17:1 | SEQ0311 | 0.01449 | 0.669 | 0.792 |
| lnc-BRINP1-3:1 | SEQ0893 | 0.0449 | 0.894 | 0.743 |
| lnc-BRINP2-3:1 | SEQ0597 | 0.02842 | 0.878 | 0.764 |
| lnc-C10orf90-2:2 | SEQ0415 | 0.02049 | 1.687 | 0.222 |
| lnc-C12orf40-3:3 | SEQ0894 | 0.0449 | 1.434 | 0.257 |
| lnc-C12orf42-3:6 | SEQ0598 | 0.02842 | 1.303 | 0.236 |
| lnc-C15orf41-18:5 | SEQ0676 | 0.03324 | 1.649 | 0.243 |
| lnc-C15orf41-18:6 | SEQ0895 | 0.0449 | 1.561 | 0.257 |
| lnc-C19orf57-1:1 | SEQ0896 | 0.0449 | 1.361 | 0.257 |
| lnc-C1QTNF9-4:1 | SEQ0781 | 0.03872 | 1.282 | 0.25 |
| lnc-C21orf58-1:2 | SEQ0033 | 0.00143 | 2.231 | 0.132 |
| lnc-C2CD4B-6:4 | SEQ0193 | 0.00829 | 1.39 | 0.188 |
| lnc-C2orf42-10:1 | SEQ0502 | 0.02418 | 1.28 | 0.229 |
| lnc-C3orf58-7:1 | SEQ0599 | 0.02842 | 0.725 | 0.764 |
| lnc-C5orf30-10:1 | SEQ0266 | 0.01209 | 0.708 | 0.799 |
| lnc-C5orf30-10:2 | SEQ0600 | 0.02842 | 0.891 | 0.764 |
| lnc-C5orf67-3:1 | SEQ0149 | 0.00681 | 0.876 | 0.819 |
| lnc-C7orf57-4:1 | SEQ0356 | 0.01727 | 1.461 | 0.215 |
| lnc-C9orf3-5:1 | SEQ0120 | 0.00556 | 0.782 | 0.826 |
| lnc-CA7-2:2 | SEQ0677 | 0.03324 | 0.817 | 0.757 |
| lnc-CAB39L-1:4 | SEQ0267 | 0.01209 | 0.769 | 0.799 |
| lnc-CAB39L-4:2 | SEQ0601 | 0.02842 | 1.181 | 0.236 |
| lnc-CACNA1I-1:1 | SEQ0503 | 0.02418 | 0.813 | 0.771 |
| lnc-CACNA2D1-1:1 | SEQ0897 | 0.0449 | 0.82 | 0.743 |
| lnc-CACNG1-1:1 | SEQ0602 | 0.02842 | 0.652 | 0.764 |
| lnc-CALML6-1:10 | SEQ0898 | 0.0449 | 0.577 | 0.743 |
| lnc-CAPS2-1:1 | SEQ0357 | 0.01727 | 0.708 | 0.785 |
| lnc-CASC10-3:1 | SEQ0899 | 0.0449 | 0.744 | 0.743 |
| lnc-CASP9-1:1 | SEQ0782 | 0.03872 | 1.246 | 0.25 |
| lnc-CAVIN2-2:1 | SEQ0416 | 0.02049 | 1.425 | 0.222 |
| lnc-CBLB-9:1 | SEQ0900 | 0.0449 | 0.788 | 0.743 |
| lnc-CCDC102B-7:1 | SEQ0901 | 0.0449 | 0.816 | 0.743 |
| lnc-CCDC167-5:1 | SEQ0417 | 0.02049 | 1.25 | 0.222 |
| lnc-CCDC177-6:1 | SEQ0783 | 0.03872 | 1.157 | 0.25 |
| lnc-CCDC192-3:1 | SEQ0902 | 0.0449 | 0.8 | 0.743 |
| lnc-CCDC197-2:1 | SEQ0068 | 0.00291 | 0.672 | 0.847 |
| lnc-CCDC61-4:1 | SEQ0194 | 0.00829 | 0.561 | 0.813 |
| lnc-CCDC7-17:1 | SEQ0226 | 0.01004 | 1.341 | 0.194 |
| lnc-CCDC93-10:2 | SEQ0603 | 0.02842 | 0.87 | 0.764 |
| lnc-CCL1-10:1 | SEQ0227 | 0.01004 | 1.307 | 0.194 |
| lnc-CCNB1IP1-1:2 | SEQ0903 | 0.0449 | 0.512 | 0.743 |
| lnc-CCR8-2:1 | SEQ0904 | 0.0449 | 1.409 | 0.257 |
| lnc-CCSER1-2:1 | SEQ0678 | 0.03324 | 0.791 | 0.757 |
| lnc-CCT8L2-28:1 | SEQ0418 | 0.02049 | 0.812 | 0.778 |
| lnc-CD47-11:2 | SEQ0905 | 0.0449 | 1.317 | 0.257 |
| lnc-CD47-11:4 | SEQ0906 | 0.0449 | 1.139 | 0.257 |
| lnc-CDADC1-1:1 | SEQ0907 | 0.0449 | 1.18 | 0.257 |
| lnc-CDH23-2:1 | SEQ0908 | 0.0449 | 0.757 | 0.743 |
| lnc-CDK20-14:1 | SEQ0358 | 0.01727 | 1.274 | 0.215 |
| lnc-CDK2AP1-1:8 | SEQ0909 | 0.0449 | 0.84 | 0.743 |
| lnc-CEACAM16-2:1 | SEQ0195 | 0.00829 | 0.708 | 0.813 |
| lnc-CEBPD-11:2 | SEQ0784 | 0.03872 | 0.763 | 0.75 |
| lnc-CELF4-15:1 | SEQ0785 | 0.03872 | 0.89 | 0.75 |
| lnc-CELSR1-2:3 | SEQ0268 | 0.01209 | 0.762 | 0.799 |
| lnc-CEP170-9:2 | SEQ0042 | 0.00183 | 0.828 | 0.861 |
| lnc-CFAP36-3:2 | SEQ0786 | 0.03872 | 0.69 | 0.75 |
| lnc-CHD1L-5:13 | SEQ0312 | 0.01449 | 0.37 | 0.792 |
| lnc-CHMP2B-1:11 | SEQ0679 | 0.03324 | 0.858 | 0.757 |
| lnc-CHN1-5:11 | SEQ0419 | 0.02049 | 0.739 | 0.778 |
| lnc-CHRAC1-1:1 | SEQ0680 | 0.03324 | 0.747 | 0.757 |
| lnc-CHRAC1-6:1 | SEQ0420 | 0.02049 | 1.247 | 0.222 |
| lnc-CHRM2-1:1 | SEQ0121 | 0.00556 | 0.833 | 0.826 |
| lnc-CHRM3-1:5 | SEQ0681 | 0.03324 | 0.714 | 0.757 |
| lnc-CHST2-6:2 | SEQ0196 | 0.00829 | 0.763 | 0.813 |
| lnc-CLDN10-5:1 | SEQ0313 | 0.01449 | 0.717 | 0.792 |
| lnc-CLEC19A-3:1 | SEQ0787 | 0.03872 | 1.284 | 0.25 |
| lnc-CLK1-1:7 | SEQ0197 | 0.00829 | 0.602 | 0.813 |
| lnc-CLVS2-2:5 | SEQ0359 | 0.01727 | 0.818 | 0.785 |
| lnc-CMPK2-34:4 | SEQ0101 | 0.00451 | 0.651 | 0.833 |
| lnc-CMTM7-2:2 | SEQ0269 | 0.01209 | 0.838 | 0.799 |
| lnc-CMTR1-10:1 | SEQ0788 | 0.03872 | 0.868 | 0.75 |
| lnc-CNBD1-4:13 | SEQ0682 | 0.03324 | 0.568 | 0.757 |
| lnc-CNDP1-7:1 | SEQ0024 | 0.00086 | 0.534 | 0.882 |
| lnc-CNOT6-10:1 | SEQ0270 | 0.01209 | 1.19 | 0.201 |
| lnc-COL6A6-2:1 | SEQ0910 | 0.0449 | 0.717 | 0.743 |
| lnc-COMMD6-10:1 | SEQ0079 | 0.00364 | 1.58 | 0.16 |
| lnc-COX10-9:2 | SEQ0911 | 0.0449 | 0.849 | 0.743 |
| lnc-CPEB3-2:1 | SEQ0789 | 0.03872 | 0.78 | 0.75 |
| lnc-CPM-2:11 | SEQ0912 | 0.0449 | 0.424 | 0.743 |
| lnc-CPM-3:1 | SEQ0228 | 0.01004 | 0.831 | 0.806 |
| lnc-CRIPT-1:3 | SEQ0790 | 0.03872 | 0.802 | 0.75 |
| lnc-CRISP1-1:2 | SEQ0271 | 0.01209 | 0.685 | 0.799 |
| lnc-CRYBA1-4:1 | SEQ0421 | 0.02049 | 0.693 | 0.778 |
| lnc-CRYBB1-1:1 | SEQ0055 | 0.00232 | 0.487 | 0.854 |
| lnc-CSGALNACT2-2:3 | SEQ0791 | 0.03872 | 0.781 | 0.75 |
| lnc-CSNK1A1-6:1 | SEQ0030 | 0.00111 | 0.696 | 0.875 |
| lnc-CTIF-9:2 | SEQ0504 | 0.02418 | 1.28 | 0.229 |
| lnc-CTNNA2-3:11 | SEQ0198 | 0.00829 | 0.812 | 0.813 |
| lnc-CTNNA3-1:2 | SEQ0683 | 0.03324 | 0.82 | 0.757 |
| lnc-CTNND2-3:1 | SEQ0913 | 0.0449 | 0.797 | 0.743 |
| lnc-CTR9-7:1 | SEQ0914 | 0.0449 | 0.763 | 0.743 |
| lnc-CYB5R2-3:13 | SEQ0199 | 0.00829 | 0.749 | 0.813 |
| lnc-CYBA-4:3 | SEQ0150 | 0.00681 | 0.784 | 0.819 |
| lnc-CYP2E1-1:1 | SEQ0684 | 0.03324 | 1.733 | 0.243 |
| lnc-CYTIP-2:1 | SEQ0200 | 0.00829 | 0.727 | 0.813 |
| lnc-DAO-3:1 | SEQ0685 | 0.03324 | 1.109 | 0.243 |
| lnc-DAPP1-2:11 | SEQ0505 | 0.02418 | 0.822 | 0.771 |
| lnc-DAZAP2-3:1 | SEQ0056 | 0.00232 | 0.797 | 0.854 |
| lnc-DDX1-3:1 | SEQ0915 | 0.0449 | 1.251 | 0.257 |
| lnc-DDX18-1:1 | SEQ0506 | 0.02418 | 0.721 | 0.771 |
| lnc-DDX18-1:7 | SEQ0314 | 0.01449 | 0.755 | 0.792 |
| lnc-DEFB112-3:4 | SEQ0422 | 0.02049 | 0.565 | 0.778 |
| lnc-DEK-4:1 | SEQ0507 | 0.02418 | 0.715 | 0.771 |
| lnc-DEPTOR-5:3 | SEQ0360 | 0.01727 | 0.846 | 0.785 |

TABLE 5-continued

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| lnc-DGCR2-5:1 | SEQ0423 | 0.02049 | 0.872 | 0.778 |
| lnc-DGCR6-7:26 | SEQ0792 | 0.03872 | 0.736 | 0.75 |
| lnc-DHX37-18:1 | SEQ0229 | 0.01004 | 0.751 | 0.806 |
| lnc-DHX38-25:1 | SEQ0230 | 0.01004 | 0.894 | 0.806 |
| lnc-DKK1-5:3 | SEQ0005 | 0.00027 | 0.739 | 0.91 |
| lnc-DKK1-5:4 | SEQ0793 | 0.03872 | 0.893 | 0.75 |
| lnc-DLG5-1:1 | SEQ0034 | 0.00143 | 0.773 | 0.868 |
| lnc-DLX2-12:1 | SEQ0151 | 0.00681 | 0.747 | 0.819 |
| lnc-DMRTA1-17:1 | SEQ0201 | 0.00829 | 0.79 | 0.813 |
| lnc-DNAH9-1:1 | SEQ0508 | 0.02418 | 0.812 | 0.771 |
| lnc-DNALI1-5:4 | SEQ0102 | 0.00451 | 0.776 | 0.833 |
| lnc-DOCK7-7:1 | SEQ0015 | 0.00066 | 0.843 | 0.889 |
| lnc-DTWD2-14:1 | SEQ0361 | 0.01727 | 0.811 | 0.785 |
| lnc-DUSP10-6:1 | SEQ0057 | 0.00232 | 0.675 | 0.854 |
| lnc-DUSP26-3:2 | SEQ0031 | 0.00111 | 0.796 | 0.875 |
| lnc-DYNAP-1:1 | SEQ0604 | 0.02842 | 0.761 | 0.764 |
| lnc-EAF1-2:1 | SEQ0509 | 0.02418 | 0.737 | 0.771 |
| lnc-EBF3-1:6 | SEQ0686 | 0.03324 | 1.241 | 0.243 |
| lnc-EBLN1-1:4 | SEQ0016 | 0.00066 | 0.725 | 0.889 |
| lnc-EDDM13-5:11 | SEQ0231 | 0.01004 | 0.372 | 0.806 |
| lnc-EDDM13-5:3 | SEQ0035 | 0.00143 | 1.505 | 0.132 |
| lnc-EDEM3-7:3 | SEQ0272 | 0.01209 | 0.86 | 0.799 |
| lnc-EDRF1-1:5 | SEQ0916 | 0.0449 | 0.728 | 0.743 |
| lnc-EEF1AKMT1-3:6 | SEQ0202 | 0.00829 | 0.423 | 0.813 |
| lnc-EEF2-3:1 | SEQ0687 | 0.03324 | 1.301 | 0.243 |
| lnc-EFR3B-7:2 | SEQ0362 | 0.01727 | 0.821 | 0.785 |
| lnc-EGFR-7:1 | SEQ0917 | 0.0449 | 1.181 | 0.257 |
| lnc-EIF2AK3-31:7 | SEQ0918 | 0.0449 | 0.848 | 0.743 |
| lnc-EIF2AK3-4:81 | SEQ0688 | 0.03324 | 1.466 | 0.243 |
| lnc-ELF1-5:1 | SEQ0510 | 0.02418 | 0.799 | 0.771 |
| lnc-ELFN2-1:3 | SEQ0080 | 0.00364 | 0.764 | 0.84 |
| lnc-EPB42-1:3 | SEQ0689 | 0.03324 | 0.917 | 0.757 |
| lnc-EPHA7-3:1 | SEQ0081 | 0.00364 | 0.763 | 0.84 |
| lnc-ERCC6L2-10:2 | SEQ0605 | 0.02842 | 0.927 | 0.764 |
| lnc-ERCC6L2-6:1 | SEQ0363 | 0.01727 | 1.784 | 0.215 |
| lnc-ERFE-1:1 | SEQ0919 | 0.0449 | 0.489 | 0.743 |
| lnc-ERGIC2-2:2 | SEQ0364 | 0.01727 | 0.799 | 0.785 |
| lnc-ERH-1:1 | SEQ0424 | 0.02049 | 0.708 | 0.778 |
| lnc-ERICH1-9:1 | SEQ0920 | 0.0449 | 0.85 | 0.743 |
| lnc-ERV3-1-9:1 | SEQ0203 | 0.00829 | 1.32 | 0.188 |
| lnc-ESRP1-2:4 | SEQ0315 | 0.01449 | 0.542 | 0.792 |
| lnc-ETS1-2:2 | SEQ0082 | 0.00364 | 1.436 | 0.16 |
| lnc-EXOC2-21:6 | SEQ0204 | 0.00829 | 1.528 | 0.188 |
| lnc-EZH2-3:1 | SEQ0273 | 0.01209 | 0.79 | 0.799 |
| lnc-F11-8:1 | SEQ0690 | 0.03324 | 0.876 | 0.757 |
| lnc-F13A1-2:7 | SEQ0691 | 0.03324 | 1.485 | 0.243 |
| lnc-FAM133B-2:1 | SEQ0036 | 0.00143 | 0.767 | 0.868 |
| lnc-FAM171B-1:6 | SEQ0205 | 0.00829 | 0.851 | 0.813 |
| lnc-FAM19A3-6:3 | SEQ0274 | 0.01209 | 0.75 | 0.799 |
| lnc-FAM217A-1:2 | SEQ0032 | 0.00111 | 0.854 | 0.875 |
| lnc-FAM231B-2:1 | SEQ0511 | 0.02418 | 1.252 | 0.229 |
| lnc-FAM231B-2:2 | SEQ0512 | 0.02418 | 1.252 | 0.229 |
| lnc-FAM236D-2:1 | SEQ0692 | 0.03324 | 0.601 | 0.757 |
| lnc-FAM46C-3:1 | SEQ0794 | 0.03872 | 0.755 | 0.75 |
| lnc-FAM49B-8:1 | SEQ0010 | 0.0005 | 1.758 | 0.104 |
| lnc-FAM71F2-5:1 | SEQ0425 | 0.02049 | 0.642 | 0.778 |
| lnc-FAM72B-6:3 | SEQ0606 | 0.02842 | 1.327 | 0.236 |
| lnc-FAM84A-5:1 | SEQ0607 | 0.02842 | 0.697 | 0.764 |
| lnc-FAM84B-17:4 | SEQ0608 | 0.02842 | 0.741 | 0.764 |
| lnc-FAM84B-4:3 | SEQ0083 | 0.00364 | 0.803 | 0.84 |
| lnc-FAP-3:1 | SEQ0206 | 0.00829 | 0.749 | 0.813 |
| lnc-FARSB-6:1 | SEQ0232 | 0.01004 | 1.292 | 0.194 |
| lnc-FAT1-7:2 | SEQ0017 | 0.00066 | 1.383 | 0.111 |
| lnc-FAT4-6:1 | SEQ0609 | 0.02842 | 0.751 | 0.764 |
| lnc-FBRSL1-3:3 | SEQ0610 | 0.02842 | 1.645 | 0.236 |
| lnc-FCGR3B-4:11 | SEQ0513 | 0.02418 | 0.848 | 0.771 |
| lnc-FCGR3B-4:12 | SEQ0514 | 0.02418 | 0.848 | 0.771 |
| lnc-FER1L6-2:1 | SEQ0515 | 0.02418 | 0.779 | 0.771 |
| lnc-FGD4-8:1 | SEQ0233 | 0.01004 | 0.688 | 0.806 |
| lnc-FGD4-9:1 | SEQ0084 | 0.00364 | 0.711 | 0.84 |
| lnc-FILIP1L-3:1 | SEQ0058 | 0.00232 | 0.867 | 0.854 |
| lnc-FNBP1L-1:11 | SEQ0006 | 0.00027 | 0.743 | 0.91 |
| lnc-FOXC1-6:2 | SEQ0516 | 0.02418 | 0.736 | 0.771 |
| lnc-FOXD4L5-35:1 | SEQ0152 | 0.00681 | 1.878 | 0.181 |
| lnc-FOXO1-2:8 | SEQ0611 | 0.02842 | 1.402 | 0.236 |
| lnc-FRG2-13:3 | SEQ0275 | 0.01209 | 0.908 | 0.799 |
| lnc-FSIP1-6:4 | SEQ0795 | 0.03872 | 1.401 | 0.25 |
| lnc-FSIP2-2:1 | SEQ0921 | 0.0449 | 0.76 | 0.743 |
| lnc-FTCD-5:1 | SEQ0796 | 0.03872 | 0.722 | 0.75 |
| lnc-FTMT-2:14 | SEQ0517 | 0.02418 | 0.792 | 0.771 |
| lnc-GALC-9:8 | SEQ0234 | 0.01004 | 0.557 | 0.806 |
| lnc-GALNT2-1:1 | SEQ0426 | 0.02049 | 0.729 | 0.778 |
| lnc-GALNTL5-3:1 | SEQ0693 | 0.03324 | 0.759 | 0.757 |
| lnc-GCLC-1:13 | SEQ0922 | 0.0449 | 0.597 | 0.743 |
| lnc-GDPD5-6:1 | SEQ0153 | 0.00681 | 0.799 | 0.819 |
| lnc-GFI1B-2:3 | SEQ0797 | 0.03872 | 0.681 | 0.75 |
| lnc-GGH-3:1 | SEQ0798 | 0.03872 | 0.782 | 0.75 |
| lnc-GHR-1:1 | SEQ0003 | 0.0002 | 0.787 | 0.917 |
| lnc-GJC1-2:2 | SEQ0799 | 0.03872 | 0.832 | 0.75 |
| lnc-GJC1-2:3 | SEQ0800 | 0.03872 | 0.832 | 0.75 |
| lnc-GLIPR1-3:2 | SEQ0923 | 0.0449 | 0.923 | 0.743 |
| lnc-GLIPR1L1-2:3 | SEQ0427 | 0.02049 | 1.26 | 0.222 |
| lnc-GMDS-6:8 | SEQ0694 | 0.03324 | 0.721 | 0.757 |
| lnc-GNG5-8:1 | SEQ0695 | 0.03324 | 0.771 | 0.757 |
| lnc-GOLGA4-4:7 | SEQ0365 | 0.01727 | 0.855 | 0.785 |
| lnc-GOLGA6L6-9:1 | SEQ0069 | 0.00291 | 0.711 | 0.847 |
| lnc-GOLGA8F-2:1 | SEQ0235 | 0.01004 | 0.756 | 0.806 |
| lnc-GOLGA8O-5:6 | SEQ0428 | 0.02049 | 0.715 | 0.778 |
| lnc-GPAT4-1:3 | SEQ0316 | 0.01449 | 1.56 | 0.208 |
| lnc-GPATCH11-1:1 | SEQ0612 | 0.02842 | 0.703 | 0.764 |
| lnc-GPATCH2L-2:1 | SEQ0317 | 0.01449 | 0.85 | 0.792 |
| lnc-GPC2-2:5 | SEQ0518 | 0.02418 | 1.355 | 0.229 |
| lnc-GPR157-6:1 | SEQ0924 | 0.0449 | 0.827 | 0.743 |
| lnc-GPR161-4:1 | SEQ0070 | 0.00291 | 0.726 | 0.847 |
| lnc-GPR27-18:1 | SEQ0925 | 0.0449 | 0.774 | 0.743 |
| lnc-GPR33-14:1 | SEQ0236 | 0.01004 | 0.828 | 0.806 |
| lnc-GPR37-1:1 | SEQ0926 | 0.0449 | 0.793 | 0.743 |
| lnc-GPR39-10:2 | SEQ0154 | 0.00681 | 1.393 | 0.181 |
| lnc-GPRC5A-4:1 | SEQ0613 | 0.02842 | 0.717 | 0.764 |
| lnc-GPRC6A-2:1 | SEQ0927 | 0.0449 | 0.865 | 0.743 |
| lnc-GPSM1-3:3 | SEQ0928 | 0.0449 | 0.64 | 0.743 |
| lnc-GRAMD2B-4:1 | SEQ0801 | 0.03872 | 0.879 | 0.75 |
| lnc-GRIP1-1:2 | SEQ0429 | 0.02049 | 1.564 | 0.222 |
| lnc-GRIP1-5:2 | SEQ0519 | 0.02418 | 0.914 | 0.771 |
| lnc-GRIP1-8:1 | SEQ0802 | 0.03872 | 1.339 | 0.25 |
| lnc-GRM1-1:19 | SEQ0929 | 0.0449 | 1.338 | 0.257 |
| lnc-GRM1-1:31 | SEQ0155 | 0.00681 | 0.864 | 0.819 |
| lnc-GRM1-1:32 | SEQ0156 | 0.00681 | 0.864 | 0.819 |
| lnc-GRM8-2:2 | SEQ0430 | 0.02049 | 0.902 | 0.778 |
| lnc-GSN-2:4 | SEQ0930 | 0.0449 | 0.94 | 0.743 |
| lnc-GSN-2:5 | SEQ0803 | 0.03872 | 0.955 | 0.75 |
| lnc-GTDC1-28:5 | SEQ0157 | 0.00681 | 0.725 | 0.819 |
| lnc-GUCY1A3-1:1 | SEQ0520 | 0.02418 | 0.724 | 0.771 |
| lnc-GUSB-1:1 | SEQ0931 | 0.0449 | 0.829 | 0.743 |
| lnc-HECA-3:13 | SEQ0237 | 0.01004 | 0.8 | 0.806 |
| lnc-HECA-6:1 | SEQ0007 | 0.00037 | 0.723 | 0.903 |
| lnc-HELT-6:1 | SEQ0932 | 0.0449 | 0.784 | 0.743 |
| lnc-HHATL-2:1 | SEQ0933 | 0.0449 | 1.127 | 0.257 |
| lnc-HHLA2-2:1 | SEQ0696 | 0.03324 | 1.238 | 0.243 |
| lnc-HJURP-7:1 | SEQ0431 | 0.02049 | 0.776 | 0.778 |
| lnc-HLCS-5:1 | SEQ0238 | 0.01004 | 0.866 | 0.806 |
| lnc-HMG20A-1:2 | SEQ0432 | 0.02049 | 0.513 | 0.778 |
| lnc-HMGA1-2:3 | SEQ0804 | 0.03872 | 1.288 | 0.25 |
| lnc-HMGN1-2:1 | SEQ0433 | 0.02049 | 1.424 | 0.222 |
| lnc-HOMEZ-4:1 | SEQ0434 | 0.02049 | 0.848 | 0.778 |
| lnc-HOXC4-1:3 | SEQ0805 | 0.03872 | 0.845 | 0.75 |
| lnc-HS3ST3A1-1:1 | SEQ0239 | 0.01004 | 0.75 | 0.806 |
| lnc-HS6ST1-8:1 | SEQ0697 | 0.03324 | 1.344 | 0.243 |
| lnc-HSCB-2:1 | SEQ0614 | 0.02842 | 0.742 | 0.764 |
| lnc-HSD17B11-2:1 | SEQ0276 | 0.01209 | 0.792 | 0.799 |
| lnc-IFRD2-6:1 | SEQ0806 | 0.03872 | 1.31 | 0.25 |
| lnc-IFT80-8:1 | SEQ0934 | 0.0449 | 0.916 | 0.743 |
| lnc-IL6-8:4 | SEQ0318 | 0.01449 | 0.77 | 0.792 |
| lnc-IPO5-7:1 | SEQ0521 | 0.02418 | 0.869 | 0.771 |
| lnc-IQCF6-2:3 | SEQ0807 | 0.03872 | 2.026 | 0.25 |
| lnc-IRF2BP2-11:3 | SEQ0103 | 0.00451 | 1.403 | 0.167 |
| lnc-IRF6-1:1 | SEQ0808 | 0.03872 | 0.894 | 0.75 |
| lnc-IRS1-2:5 | SEQ0615 | 0.02842 | 1.878 | 0.236 |

TABLE 5-continued

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| lnc-IRS1-6:1 | SEQ0037 | 0.00143 | 0.804 | 0.868 |
| lnc-IRS1-7:3 | SEQ0522 | 0.02418 | 1.153 | 0.229 |
| lnc-IRX2-10:1 | SEQ0698 | 0.03324 | 0.744 | 0.757 |
| lnc-ITGB8-2:8 | SEQ0616 | 0.02842 | 0.805 | 0.764 |
| lnc-JMJD4-2:1 | SEQ0435 | 0.02049 | 0.736 | 0.778 |
| lnc-JRK-2:1 | SEQ0935 | 0.0449 | 1.162 | 0.257 |
| lnc-JRK-2:2 | SEQ0699 | 0.03324 | 0.764 | 0.757 |
| lnc-KAT5-2:1 | SEQ0936 | 0.0449 | 0.769 | 0.743 |
| lnc-KBTBD7-1:1 | SEQ0523 | 0.02418 | 0.742 | 0.771 |
| lnc-KBTBD8-4:3 | SEQ0366 | 0.01727 | 1.457 | 0.215 |
| lnc-KCNA1-1:23 | SEQ0122 | 0.00556 | 0.633 | 0.826 |
| lnc-KCND3-1:1 | SEQ0085 | 0.00364 | 0.808 | 0.84 |
| lnc-KCNE1B-15:1 | SEQ0319 | 0.01449 | 0.823 | 0.792 |
| lnc-KCNS3-9:1 | SEQ0320 | 0.01449 | 1.265 | 0.208 |
| lnc-KCTD13-3:1 | SEQ0700 | 0.03324 | 0.709 | 0.757 |
| lnc-KCTD19-1:1 | SEQ0701 | 0.03324 | 0.761 | 0.757 |
| lnc-KDM3A-1:4 | SEQ0104 | 0.00451 | 0.731 | 0.833 |
| lnc-KDM8-3:1 | SEQ0436 | 0.02049 | 0.758 | 0.778 |
| lnc-KIAA0141-3:1 | SEQ0702 | 0.03324 | 1.15 | 0.243 |
| lnc-KIF21B-2:1 | SEQ0937 | 0.0449 | 0.873 | 0.743 |
| lnc-KIN-5:1 | SEQ0703 | 0.03324 | 0.835 | 0.757 |
| lnc-KLF11-1:8 | SEQ0704 | 0.03324 | 0.286 | 0.757 |
| lnc-KLF12-4:1 | SEQ0938 | 0.0449 | 0.806 | 0.743 |
| lnc-KLF12-7:1 | SEQ0240 | 0.01004 | 0.88 | 0.806 |
| lnc-KLHL24-2:1 | SEQ0321 | 0.01449 | 1.206 | 0.208 |
| lnc-KLK2-4:3 | SEQ0524 | 0.02418 | 0.881 | 0.771 |
| lnc-KLRG1-8:1 | SEQ0809 | 0.03872 | 1.222 | 0.25 |
| lnc-KREMEN2-1:1 | SEQ0705 | 0.03324 | 1.279 | 0.243 |
| lnc-KRR1-4:7 | SEQ0706 | 0.03324 | 0.801 | 0.757 |
| lnc-KY-4:1 | SEQ0123 | 0.00556 | 0.708 | 0.826 |
| lnc-L3MBTL2-1:1 | SEQ0367 | 0.01727 | 1.259 | 0.215 |
| lnc-LARP1B-1:15 | SEQ0277 | 0.01209 | 0.786 | 0.799 |
| lnc-LARP1B-1:17 | SEQ0278 | 0.01209 | 0.786 | 0.799 |
| lnc-LARP1B-1:18 | SEQ0279 | 0.01209 | 1.214 | 0.201 |
| lnc-LARP4-6:1 | SEQ0368 | 0.01727 | 0.803 | 0.785 |
| lnc-LBH-4:1 | SEQ0707 | 0.03324 | 1.312 | 0.243 |
| lnc-LBX1-1:1 | SEQ0241 | 0.01004 | 0.788 | 0.806 |
| lnc-LEPROTL1-12:1 | SEQ0011 | 0.0005 | 0.749 | 0.896 |
| lnc-LIMS3-1:10 | SEQ0086 | 0.00364 | 2.27 | 0.16 |
| lnc-LINC00675-1:3 | SEQ0810 | 0.03872 | 0.669 | 0.75 |
| lnc-LINS1-2:1 | SEQ0811 | 0.03872 | 0.81 | 0.75 |
| lnc-LMBRD1-5:17 | SEQ0812 | 0.03872 | 0.574 | 0.75 |
| lnc-LMX1A-2:1 | SEQ0708 | 0.03324 | 0.786 | 0.757 |
| lnc-LONP2-6:10 | SEQ0280 | 0.01209 | 0.912 | 0.799 |
| lnc-LRCH1-1:1 | SEQ0437 | 0.02049 | 0.793 | 0.778 |
| lnc-LRP12-4:3 | SEQ0939 | 0.0449 | 1.165 | 0.257 |
| lnc-LRP5L-2:14 | SEQ0940 | 0.0449 | 1.203 | 0.257 |
| lnc-LRR1-1:2 | SEQ0813 | 0.03872 | 0.729 | 0.75 |
| lnc-LRR1-1:3 | SEQ0814 | 0.03872 | 0.725 | 0.75 |
| lnc-LRRC1-5:2 | SEQ0087 | 0.00364 | 0.649 | 0.84 |
| lnc-LRRC3B-1:3 | SEQ0941 | 0.0449 | 0.463 | 0.743 |
| lnc-LRRC41-3:2 | SEQ0942 | 0.0449 | 1.272 | 0.257 |
| lnc-LRRC4C-7:1 | SEQ0815 | 0.03872 | 0.818 | 0.75 |
| lnc-LRRFIP2-3:4 | SEQ0617 | 0.02842 | 0.74 | 0.764 |
| lnc-LRRK1-3:4 | SEQ0242 | 0.01004 | 0.79 | 0.806 |
| lnc-LRRK2-1:10 | SEQ0369 | 0.01727 | 0.86 | 0.785 |
| lnc-LRRK2-1:9 | SEQ0370 | 0.01727 | 0.86 | 0.785 |
| lnc-LRRTM4-3:2 | SEQ0618 | 0.02842 | 0.865 | 0.764 |
| lnc-LY9-3:1 | SEQ0207 | 0.00829 | 1.317 | 0.188 |
| lnc-LYN-8:1 | SEQ0619 | 0.02842 | 1.516 | 0.236 |
| lnc-MAFB-1:4 | SEQ0525 | 0.02418 | 0.839 | 0.771 |
| lnc-MAMDC2-1:1 | SEQ0526 | 0.02418 | 0.828 | 0.771 |
| lnc-MAML3-2:1 | SEQ0438 | 0.02049 | 0.768 | 0.778 |
| lnc-MAN1A1-1:3 | SEQ0158 | 0.00681 | 0.722 | 0.819 |
| lnc-MAP9-6:1 | SEQ0281 | 0.01209 | 0.741 | 0.799 |
| lnc-MARCH4-2:7 | SEQ0088 | 0.00364 | 2 | 0.16 |
| lnc-MARCKS-1:9 | SEQ0527 | 0.02418 | 0.717 | 0.771 |
| lnc-MASTL-2:1 | SEQ0943 | 0.0449 | 0.756 | 0.743 |
| lnc-MB-3:1 | SEQ0944 | 0.0449 | 1.302 | 0.257 |
| lnc-MBP-16:2 | SEQ0208 | 0.00829 | 1.204 | 0.188 |
| lnc-MC5R-5:1 | SEQ0945 | 0.0449 | 0.742 | 0.743 |
| lnc-MC5R-6:2 | SEQ0243 | 0.01004 | 0.626 | 0.806 |
| lnc-MDM4-8:1 | SEQ0816 | 0.03872 | 0.791 | 0.75 |
| lnc-ME3-1:1 | SEQ0946 | 0.0449 | 1.353 | 0.257 |
| lnc-MED10-23:1 | SEQ0209 | 0.00829 | 1.295 | 0.188 |
| lnc-MED15-1:2 | SEQ0620 | 0.02842 | 1.191 | 0.236 |
| lnc-MESD-6:1 | SEQ0947 | 0.0449 | 0.762 | 0.743 |
| lnc-MEST-6:1 | SEQ0124 | 0.00556 | 0.817 | 0.826 |
| lnc-METTL22-11:1 | SEQ0709 | 0.03324 | 0.747 | 0.757 |
| lnc-MFSD8-6:3 | SEQ0528 | 0.02418 | 0.845 | 0.771 |
| lnc-MFSD8-6:8 | SEQ0371 | 0.01727 | 0.794 | 0.785 |
| lnc-MGST3-1:3 | SEQ0043 | 0.00183 | 1.664 | 0.139 |
| lnc-MIB1-1:1 | SEQ0159 | 0.00681 | 0.68 | 0.819 |
| lnc-MNX1-10:1 | SEQ0322 | 0.01449 | 1.204 | 0.208 |
| lnc-MOGAT1-3:2 | SEQ0948 | 0.0449 | 0.703 | 0.743 |
| lnc-MPLKIP-3:1 | SEQ0710 | 0.03324 | 0.867 | 0.757 |
| lnc-MPP4-3:1 | SEQ0817 | 0.03872 | 0.813 | 0.75 |
| lnc-MRC2-2:1 | SEQ0818 | 0.03872 | 0.835 | 0.75 |
| lnc-MRGPRD-2:1 | SEQ0244 | 0.01004 | 0.79 | 0.806 |
| lnc-MRGPRF-4:4 | SEQ0105 | 0.00451 | 0.604 | 0.833 |
| lnc-MROH7-2:1 | SEQ0529 | 0.02418 | 0.844 | 0.771 |
| lnc-MRPL57-5:8 | SEQ0621 | 0.02842 | 0.855 | 0.764 |
| lnc-MRPS30-13:1 | SEQ0819 | 0.03872 | 0.814 | 0.75 |
| lnc-MSH2-3:2 | SEQ0711 | 0.03324 | 1.401 | 0.243 |
| lnc-MTRNR2L1-3:1 | SEQ0530 | 0.02418 | 1.325 | 0.229 |
| lnc-MVB12B-6:1 | SEQ0531 | 0.02418 | 0.811 | 0.771 |
| lnc-MYC-12:1 | SEQ0622 | 0.02842 | 1.418 | 0.236 |
| lnc-MYO18B-2:3 | SEQ0323 | 0.01449 | 0.833 | 0.792 |
| lnc-MYO18B-3:3 | SEQ0160 | 0.00681 | 0.762 | 0.819 |
| lnc-MYOCOS-2:1 | SEQ0439 | 0.02049 | 0.891 | 0.778 |
| lnc-NAA38-3:1 | SEQ0532 | 0.02418 | 0.854 | 0.771 |
| lnc-NAALADL2-8:1 | SEQ0324 | 0.01449 | 0.864 | 0.792 |
| lnc-NANOS1-3:1 | SEQ0712 | 0.03324 | 1.277 | 0.243 |
| lnc-NAXD-6:5 | SEQ0125 | 0.00556 | 0.479 | 0.826 |
| lnc-NBPF14-1:2 | SEQ0089 | 0.00364 | 0.815 | 0.84 |
| lnc-NBPF14-3:1 | SEQ0623 | 0.02842 | 0.889 | 0.764 |
| lnc-NCR3LG1-3:1 | SEQ0018 | 0.00066 | 0.837 | 0.889 |
| lnc-NDFIP2-7:13 | SEQ0820 | 0.03872 | 0.775 | 0.75 |
| lnc-NDFIP2-7:14 | SEQ0440 | 0.02049 | 0.77 | 0.778 |
| lnc-NDRG2-5:1 | SEQ0949 | 0.0449 | 0.773 | 0.743 |
| lnc-NDUFA10-6:1 | SEQ0161 | 0.00681 | 0.712 | 0.819 |
| lnc-NDUFB9-2:2 | SEQ0713 | 0.03324 | 1.345 | 0.243 |
| lnc-NDUFS6-15:1 | SEQ0950 | 0.0449 | 0.805 | 0.743 |
| lnc-NEUROD2-4:1 | SEQ0071 | 0.00291 | 0.772 | 0.847 |
| lnc-NKAIN2-5:1 | SEQ0821 | 0.03872 | 0.794 | 0.75 |
| lnc-NKX6-1-2:1 | SEQ0282 | 0.01209 | 0.773 | 0.799 |
| lnc-NOC2L-1:21 | SEQ0245 | 0.01004 | 1.382 | 0.194 |
| lnc-NOC2L-12:1 | SEQ0372 | 0.01727 | 1.479 | 0.215 |
| lnc-NOS2-7:1 | SEQ0951 | 0.0449 | 1.203 | 0.257 |
| lnc-NPBWR1-2:2 | SEQ0952 | 0.0449 | 1.517 | 0.257 |
| lnc-NPIPB12-1:1 | SEQ0822 | 0.03872 | 1.13 | 0.25 |
| lnc-PAPPA-1:3 | SEQ0720 | 0.03324 | 2.192 | 0.243 |
| lnc-PAPPA-1:4 | SEQ0721 | 0.03324 | 0.814 | 0.757 |
| lnc-PAPPA2-1:10 | SEQ0246 | 0.01004 | 0.753 | 0.806 |
| lnc-PAPPA2-7:1 | SEQ0165 | 0.00681 | 0.839 | 0.819 |
| lnc-PATE2-1:1 | SEQ0247 | 0.01004 | 0.728 | 0.806 |
| lnc-PAX8-6:2 | SEQ0538 | 0.02418 | 1.413 | 0.229 |
| lnc-PAXIP1-8:1 | SEQ0957 | 0.0449 | 0.731 | 0.743 |
| lnc-PCDH10-11:1 | SEQ0958 | 0.0449 | 0.719 | 0.743 |
| lnc-PCDH8-12:1 | SEQ0166 | 0.00681 | 0.742 | 0.819 |
| lnc-PCOLCE2-1:1 | SEQ0959 | 0.0449 | 0.909 | 0.743 |
| lnc-PCSK9-4:6 | SEQ0327 | 0.01449 | 1.154 | 0.208 |
| lnc-PCSK9-4:9 | SEQ0328 | 0.01449 | 1.154 | 0.208 |
| lnc-PDLIM1-3:1 | SEQ0960 | 0.0449 | 0.837 | 0.743 |
| lnc-PFKP-16:15 | SEQ0628 | 0.02842 | 0.662 | 0.764 |
| lnc-PFKP-17:1 | SEQ0445 | 0.02049 | 0.834 | 0.778 |
| lnc-PHF14-14:19 | SEQ0825 | 0.03872 | 0.678 | 0.75 |
| lnc-PIGB-1:5 | SEQ0539 | 0.02418 | 0.691 | 0.771 |
| lnc-PIGM-4:1 | SEQ0248 | 0.01004 | 0.715 | 0.806 |
| lnc-PINX1-7:1 | SEQ0329 | 0.01449 | 1.307 | 0.208 |
| lnc-PLA2G2F-1:2 | SEQ0285 | 0.01209 | 1.224 | 0.201 |
| lnc-PLA2G4A-7:5 | SEQ0446 | 0.02049 | 0.865 | 0.778 |
| lnc-PLA2G4A-7:8 | SEQ0826 | 0.03872 | 0.74 | 0.75 |
| lnc-PLAT-1:3 | SEQ0961 | 0.0449 | 0.738 | 0.743 |
| lnc-PLCB1-7:2 | SEQ0827 | 0.03872 | 0.854 | 0.75 |
| lnc-PLEKHA8-3:5 | SEQ0962 | 0.0449 | 0.793 | 0.743 |
| lnc-PLK1-1:6 | SEQ0963 | 0.0449 | 0.663 | 0.743 |
| lnc-PLN-2:1 | SEQ0722 | 0.03324 | 0.781 | 0.757 |

TABLE 5-continued

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| lnc-PLSCR2-2:1 | SEQ0964 | 0.0449 | 0.813 | 0.743 |
| lnc-POC5-3:1 | SEQ0629 | 0.02842 | 0.747 | 0.764 |
| lnc-POLE4-3:1 | SEQ0330 | 0.01449 | 0.798 | 0.792 |
| lnc-POU2AF1-1:2 | SEQ0447 | 0.02049 | 0.874 | 0.778 |
| lnc-PPIAL4F-3:2 | SEQ0828 | 0.03872 | 1.302 | 0.25 |
| lnc-PPM1D-1:8 | SEQ0540 | 0.02418 | 0.8 | 0.771 |
| lnc-PPP2R3C-4:1 | SEQ0025 | 0.00086 | 0.879 | 0.882 |
| lnc-PPP5C-4:1 | SEQ0723 | 0.03324 | 0.757 | 0.757 |
| lnc-PRDM9-19:2 | SEQ0829 | 0.03872 | 0.709 | 0.75 |
| lnc-PRDM9-20:1 | SEQ0376 | 0.01727 | 0.678 | 0.785 |
| lnc-PRELID2-1:2 | SEQ0541 | 0.02418 | 1.232 | 0.229 |
| lnc-PRKACG-1:2 | SEQ0724 | 0.03324 | 0.738 | 0.757 |
| lnc-PRKACG-2:1 | SEQ0630 | 0.02842 | 1.186 | 0.236 |
| lnc-PRKCH-1:1 | SEQ0286 | 0.01209 | 0.904 | 0.799 |
| lnc-PRKN-8:1 | SEQ0212 | 0.00829 | 1.368 | 0.188 |
| lnc-PRND-2:1 | SEQ0287 | 0.01209 | 0.798 | 0.799 |
| lnc-PRR11-1:4 | SEQ0288 | 0.01209 | 0.862 | 0.799 |
| lnc-PRR5-5:1 | SEQ0167 | 0.00681 | 0.703 | 0.819 |
| lnc-PRSS54-2:2 | SEQ0168 | 0.00681 | 0.769 | 0.819 |
| lnc-PSMB1-6:4 | SEQ0331 | 0.01449 | 2.134 | 0.208 |
| lnc-PTDSS1-1:2 | SEQ0448 | 0.02049 | 1.246 | 0.222 |
| lnc-PTP4A2-1:2 | SEQ0725 | 0.03324 | 1.223 | 0.243 |
| lnc-PTPN14-11:1 | SEQ0449 | 0.02049 | 1.341 | 0.222 |
| lnc-PTPN4-1:1 | SEQ0631 | 0.02842 | 0.755 | 0.764 |
| lnc-QRFP-5:1 | SEQ0019 | 0.00066 | 2.17 | 0.111 |
| lnc-RAB3B-1:1 | SEQ0965 | 0.0449 | 0.843 | 0.743 |
| lnc-RAB6C-3:1 | SEQ0966 | 0.0449 | 0.836 | 0.743 |
| lnc-RAI14-3:1 | SEQ0542 | 0.02418 | 0.835 | 0.771 |
| lnc-RALGAPA1-1:2 | SEQ0726 | 0.03324 | 0.86 | 0.757 |
| lnc-RALGAPA2-2:4 | SEQ0967 | 0.0449 | 0.805 | 0.743 |
| lnc-RARRES1-3:2 | SEQ0632 | 0.02842 | 0.84 | 0.764 |
| lnc-RASGRP1-3:3 | SEQ0968 | 0.0449 | 0.796 | 0.743 |
| lnc-RBFOX1-2:1 | SEQ0377 | 0.01727 | 1.269 | 0.215 |
| lnc-RBKS-6:1 | SEQ0128 | 0.00556 | 0.802 | 0.826 |
| lnc-RBM11-11:1 | SEQ0450 | 0.02049 | 0.714 | 0.778 |
| lnc-RBM25-1:1 | SEQ0969 | 0.0449 | 0.89 | 0.743 |
| lnc-RBM33-3:1 | SEQ0727 | 0.03324 | 0.762 | 0.757 |
| lnc-RBM45-7:1 | SEQ0830 | 0.03872 | 0.792 | 0.75 |
| lnc-RBMS1-7:1 | SEQ0249 | 0.01004 | 0.778 | 0.806 |
| lnc-RCSD1-4:1 | SEQ0831 | 0.03872 | 0.831 | 0.75 |
| lnc-RDH13-1:2 | SEQ0250 | 0.01004 | 0.635 | 0.806 |
| lnc-RGMA-28:2 | SEQ0378 | 0.01727 | 0.875 | 0.785 |
| lnc-RGS9-15:6 | SEQ0970 | 0.0449 | 0.705 | 0.743 |
| lnc-RHNO1-1:1 | SEQ0026 | 0.00086 | 1.248 | 0.118 |
| lnc-RHOB-1:3 | SEQ0451 | 0.02049 | 0.612 | 0.778 |
| lnc-RHOB-21:1 | SEQ0971 | 0.0449 | 0.817 | 0.743 |
| lnc-RHOBTB2-4:1 | SEQ0213 | 0.00829 | 0.839 | 0.813 |
| lnc-RIPPLY3-1:3 | SEQ0832 | 0.03872 | 0.889 | 0.75 |
| lnc-RIT2-5:1 | SEQ0289 | 0.01209 | 1.302 | 0.201 |
| lnc-RNF6-2:1 | SEQ0059 | 0.00232 | 0.692 | 0.854 |
| lnc-RNFT2-1:5 | SEQ0379 | 0.01727 | 0.8 | 0.785 |
| lnc-RNLS-1:1 | SEQ0972 | 0.0449 | 0.829 | 0.743 |
| lnc-ROBO2-16:1 | SEQ0251 | 0.01004 | 0.799 | 0.806 |
| lnc-RPE65-4:2 | SEQ0129 | 0.00556 | 0.857 | 0.826 |
| lnc-RPIA-25:1 | SEQ0130 | 0.00556 | 0.866 | 0.826 |
| lnc-RPL10L-5:1 | SEQ0452 | 0.02049 | 0.77 | 0.778 |
| lnc-RPL24-6:1 | SEQ0728 | 0.03324 | 1.245 | 0.243 |
| lnc-RPL35-2:1 | SEQ0543 | 0.02418 | 0.812 | 0.771 |
| lnc-RPL37-2:1 | SEQ0214 | 0.00829 | 1.309 | 0.188 |
| lnc-RPRM-7:1 | SEQ0380 | 0.01727 | 0.679 | 0.785 |
| lnc-RPS12-4:1 | SEQ0633 | 0.02842 | 0.806 | 0.764 |
| lnc-RPS21-4:2 | SEQ0027 | 0.00086 | 0.664 | 0.882 |
| lnc-RRM1-2:5 | SEQ0973 | 0.0449 | 0.934 | 0.743 |
| lnc-RSL1D1-2:1 | SEQ0215 | 0.00829 | 0.762 | 0.813 |
| lnc-RTL1-3:9 | SEQ0544 | 0.02418 | 0.848 | 0.771 |
| lnc-RUBCN-1:1 | SEQ0833 | 0.03872 | 0.788 | 0.75 |
| lnc-S1PR1-13:1 | SEQ0381 | 0.01727 | 0.686 | 0.785 |
| lnc-SAMD11-1:1 | SEQ0729 | 0.03324 | 1.247 | 0.243 |
| lnc-SAMD5-1:10 | SEQ0090 | 0.00364 | 0.708 | 0.84 |
| lnc-SC5D-4:1 | SEQ0730 | 0.03324 | 1.249 | 0.243 |
| lnc-SCD-7:1 | SEQ0974 | 0.0449 | 0.731 | 0.743 |
| lnc-SCGB1C2-8:1 | SEQ0975 | 0.0449 | 0.776 | 0.743 |
| lnc-SCNN1B-3:1 | SEQ0976 | 0.0449 | 1.155 | 0.257 |
| lnc-SCTR-2:4 | SEQ0634 | 0.02842 | 0.852 | 0.764 |
| lnc-SEPT14-6:1 | SEQ0545 | 0.02418 | 0.878 | 0.771 |
| lnc-SERHL2-1:8 | SEQ0546 | 0.02418 | 1.483 | 0.229 |
| lnc-SERINC1-8:3 | SEQ0731 | 0.03324 | 0.827 | 0.757 |
| lnc-SERP1-4:6 | SEQ0072 | 0.00291 | 0.719 | 0.847 |
| lnc-SERP1-4:8 | SEQ0977 | 0.0449 | 0.831 | 0.743 |
| lnc-SERPINI1-14:1 | SEQ0978 | 0.0449 | 0.85 | 0.743 |
| lnc-SERTM1-1:1 | SEQ0290 | 0.01209 | 0.817 | 0.799 |
| lnc-SFPQ-2:1 | SEQ0169 | 0.00681 | 0.72 | 0.819 |
| lnc-SGCG-7:2 | SEQ0453 | 0.02049 | 0.733 | 0.778 |
| lnc-SGK1-3:14 | SEQ0979 | 0.0449 | 1.836 | 0.257 |
| lnc-SGMS1-4:1 | SEQ0834 | 0.03872 | 0.793 | 0.75 |
| lnc-SH3BGRL2-4:1 | SEQ0980 | 0.0449 | 1.174 | 0.257 |
| lnc-SKIL-2:3 | SEQ0981 | 0.0449 | 1.222 | 0.257 |
| lnc-SLC1A3-1:1 | SEQ0547 | 0.02418 | 0.791 | 0.771 |
| lnc-SLC22A23-11:2 | SEQ0732 | 0.03324 | 1.239 | 0.243 |
| lnc-SLC25A21-1:1 | SEQ0733 | 0.03324 | 0.77 | 0.757 |
| lnc-SLC25A24-2:1 | SEQ0548 | 0.02418 | 0.883 | 0.771 |
| lnc-SLC25A30-2:4 | SEQ0291 | 0.01209 | 1.539 | 0.201 |
| lnc-SLC2A10-1:1 | SEQ0549 | 0.02418 | 0.788 | 0.771 |
| lnc-SLC38A2-1:11 | SEQ0252 | 0.01004 | 0.892 | 0.806 |
| lnc-SLC38A2-1:15 | SEQ0332 | 0.01449 | 1.425 | 0.208 |
| lnc-SLC39A11-10:11 | SEQ0292 | 0.01209 | 4.38 | 0.201 |
| lnc-SLC46A3-7:1 | SEQ0550 | 0.02418 | 0.858 | 0.771 |
| lnc-SLCO6A1-2:1 | SEQ0635 | 0.02842 | 0.775 | 0.764 |
| lnc-SLITRK5-17:1 | SEQ0293 | 0.01209 | 0.636 | 0.799 |
| lnc-SLTM-1:2 | SEQ0982 | 0.0449 | 0.9 | 0.743 |
| lnc-SMARCA5-4:18 | SEQ0253 | 0.01004 | 0.825 | 0.806 |
| lnc-SMIM14-4:1 | SEQ0454 | 0.02049 | 0.788 | 0.778 |
| lnc-SMIM17-5:4 | SEQ0734 | 0.03324 | 0.715 | 0.757 |
| lnc-SNAPC3-12:5 | SEQ0455 | 0.02049 | 1.387 | 0.222 |
| lnc-SNCA-3:1 | SEQ0551 | 0.02418 | 0.498 | 0.771 |
| lnc-SNRPB2-2:4 | SEQ0254 | 0.01004 | 1.727 | 0.194 |
| lnc-SNX10-6:1 | SEQ0636 | 0.02842 | 0.764 | 0.764 |
| lnc-SNX13-2:6 | SEQ0456 | 0.02049 | 1.576 | 0.222 |
| lnc-SNX16-6:1 | SEQ0983 | 0.0449 | 0.83 | 0.743 |
| lnc-SNX17-1:13 | SEQ0333 | 0.01449 | 1.985 | 0.208 |
| lnc-SNX17-1:8 | SEQ0984 | 0.0449 | 0.754 | 0.743 |
| lnc-SNX19-6:1 | SEQ0835 | 0.03872 | 1.249 | 0.25 |
| lnc-SNX19-9:1 | SEQ0836 | 0.03872 | 0.837 | 0.75 |
| lnc-SNX20-8:5 | SEQ0985 | 0.0449 | 0.933 | 0.743 |
| lnc-SOX11-5:1 | SEQ0382 | 0.01727 | 1.216 | 0.215 |
| lnc-SOX14-2:1 | SEQ0045 | 0.00183 | 0.837 | 0.861 |
| lnc-SPAG9-2:1 | SEQ0383 | 0.01727 | 0.851 | 0.785 |
| lnc-SPAG9-2:2 | SEQ0384 | 0.01727 | 0.851 | 0.785 |
| lnc-SPATA31A6-10:1 | SEQ0837 | 0.03872 | 0.804 | 0.75 |
| lnc-SPATA31D4-1:6 | SEQ0838 | 0.03872 | 0.718 | 0.75 |
| lnc-SPP1-1:1 | SEQ0046 | 0.00183 | 0.846 | 0.861 |
| lnc-SPRY1-9:1 | SEQ0839 | 0.03872 | 0.767 | 0.75 |
| lnc-SPTSSA-5:2 | SEQ0552 | 0.02418 | 1.31 | 0.229 |
| lnc-SRCIN1-1:18 | SEQ0553 | 0.02418 | 0.798 | 0.771 |
| lnc-SRSF2-2:5 | SEQ0735 | 0.03324 | 0.633 | 0.757 |
| lnc-ST8SIA4-3:5 | SEQ0457 | 0.02049 | 1.584 | 0.222 |
| lnc-STARD10-1:6 | SEQ0840 | 0.03872 | 1.156 | 0.25 |
| lnc-STAT1-2:3 | SEQ0986 | 0.0449 | 0.832 | 0.743 |
| lnc-STK32B-2:1 | SEQ0170 | 0.00681 | 0.807 | 0.819 |
| lnc-STOML3-6:1 | SEQ0038 | 0.00143 | 0.731 | 0.868 |
| lnc-STPG1-1:1 | SEQ0637 | 0.02842 | 0.82 | 0.764 |
| lnc-STRADB-6:2 | SEQ0987 | 0.0449 | 0.723 | 0.743 |
| lnc-SUCLA2-13:2 | SEQ0736 | 0.03324 | 1.22 | 0.243 |
| lnc-SUCLA2-13:3 | SEQ0737 | 0.03324 | 1.22 | 0.243 |
| lnc-SUGT1-3:1 | SEQ0131 | 0.00556 | 2.047 | 0.174 |
| lnc-SULT1A4-1:27 | SEQ0841 | 0.03872 | 1.274 | 0.25 |
| lnc-SULT1C2-3:1 | SEQ0842 | 0.03872 | 1.396 | 0.25 |
| lnc-SUSD1-1:5 | SEQ0638 | 0.02842 | 0.798 | 0.764 |
| lnc-SYCP1-4:1 | SEQ0843 | 0.03872 | 1.204 | 0.25 |
| lnc-TAAR9-3:2 | SEQ0738 | 0.03324 | 0.806 | 0.757 |
| lnc-TAB2-1:4 | SEQ0988 | 0.0449 | 0.846 | 0.743 |
| lnc-TACC2-8:6 | SEQ0171 | 0.00681 | 0.869 | 0.819 |
| lnc-TACSTD2-2:4 | SEQ0020 | 0.00066 | 0.757 | 0.889 |
| lnc-TADA2B-6:1 | SEQ0554 | 0.02418 | 1.467 | 0.229 |
| lnc-TAF9-10:1 | SEQ0639 | 0.02842 | 0.825 | 0.764 |
| lnc-TASP1-11:1 | SEQ0989 | 0.0449 | 1.217 | 0.257 |
| lnc-TBC1D22A-4:12 | SEQ0739 | 0.03324 | 0.969 | 0.757 |
| lnc-TBC1D3H-1:1 | SEQ0334 | 0.01449 | 0.729 | 0.792 |

TABLE 5-continued

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| lnc-TBC1D3H-3:1 | SEQ0294 | 0.01209 | 0.72 | 0.799 |
| lnc-TBL1XR1-7:1 | SEQ0458 | 0.02049 | 0.754 | 0.778 |
| lnc-TCEANC2-3:1 | SEQ0106 | 0.00451 | 0.549 | 0.833 |
| lnc-TCEANC2-3:2 | SEQ0385 | 0.01727 | 1.882 | 0.215 |
| lnc-TCF19-1:80 | SEQ0740 | 0.03324 | 1.351 | 0.243 |
| lnc-TCF7-1:3 | SEQ0990 | 0.0449 | 0.866 | 0.743 |
| lnc-TCP10-2:1 | SEQ0991 | 0.0449 | 0.876 | 0.743 |
| lnc-TCP11-2:3 | SEQ0640 | 0.02842 | 0.67 | 0.764 |
| lnc-TCP11L2-1:4 | SEQ0741 | 0.03324 | 0.74 | 0.757 |
| lnc-TDO2-6:1 | SEQ0641 | 0.02842 | 0.758 | 0.764 |
| lnc-TDP2-1:1 | SEQ0335 | 0.01449 | 1.29 | 0.208 |
| lnc-TEAD4-1:1 | SEQ0992 | 0.0449 | 1.868 | 0.257 |
| lnc-TEFM-10:2 | SEQ0993 | 0.0449 | 0.736 | 0.743 |
| lnc-TEKT3-3:1 | SEQ0844 | 0.03872 | 0.744 | 0.75 |
| lnc-TEKT4-4:1 | SEQ0132 | 0.00556 | 1.332 | 0.174 |
| lnc-TENM3-3:3 | SEQ0001 | 0.00007 | 0.717 | 0.938 |
| lnc-TENM3-3:4 | SEQ0008 | 0.00037 | 1.947 | 0.097 |
| lnc-TENM3-3:5 | SEQ0009 | 0.00037 | 1.993 | 0.097 |
| lnc-TENM4-4:1 | SEQ0742 | 0.03324 | 2.209 | 0.243 |
| lnc-TEX10-1:1 | SEQ0459 | 0.02049 | 0.814 | 0.778 |
| lnc-TEX29-3:1 | SEQ0172 | 0.00681 | 0.767 | 0.819 |
| lnc-TEX49-4:1 | SEQ0994 | 0.0449 | 0.789 | 0.743 |
| lnc-TF-4:1 | SEQ0743 | 0.03324 | 0.898 | 0.757 |
| lnc-TFCP2L1-6:1 | SEQ0460 | 0.02049 | 0.743 | 0.778 |
| lnc-TGM6-2:1 | SEQ0216 | 0.00829 | 0.741 | 0.813 |
| lnc-THAP12-1:5 | SEQ0642 | 0.02842 | 1.427 | 0.236 |
| lnc-THOC5-3:1 | SEQ0133 | 0.00556 | 0.717 | 0.826 |
| lnc-THY1-3:1 | SEQ0995 | 0.0449 | 0.788 | 0.743 |
| lnc-THYN1-1:1 | SEQ0461 | 0.02049 | 1.173 | 0.222 |
| lnc-TLDC2-4:1 | SEQ0555 | 0.02418 | 1.214 | 0.229 |
| lnc-TLE4-7:1 | SEQ0255 | 0.01004 | 1.184 | 0.194 |
| lnc-TLK1-1:2 | SEQ0556 | 0.02418 | 0.76 | 0.771 |
| lnc-TLNRD1-3:1 | SEQ0462 | 0.02049 | 0.829 | 0.778 |
| lnc-TMEM126B-2:3 | SEQ0336 | 0.01449 | 0.508 | 0.792 |
| lnc-TMEM126B-2:4 | SEQ0643 | 0.02842 | 1.964 | 0.236 |
| lnc-TMEM132C-6:5 | SEQ0996 | 0.0449 | 1.222 | 0.257 |
| lnc-TMEM168-1:1 | SEQ0073 | 0.00291 | 0.761 | 0.847 |
| lnc-TMEM185B-12:1 | SEQ0173 | 0.00681 | 0.549 | 0.819 |
| lnc-TMEM185B-12:7 | SEQ0060 | 0.00232 | 1.694 | 0.146 |
| lnc-TMEM185B-2:3 | SEQ0386 | 0.01727 | 1.212 | 0.215 |
| lnc-TMEM211-2:8 | SEQ0644 | 0.02842 | 1.278 | 0.236 |
| lnc-TMEM242-6:1 | SEQ0463 | 0.02049 | 0.879 | 0.778 |
| lnc-TMEM248-4:11 | SEQ0845 | 0.03872 | 0.842 | 0.75 |
| lnc-TMEM70-7:1 | SEQ0217 | 0.00829 | 1.404 | 0.188 |
| lnc-TMX4-3:1 | SEQ0464 | 0.02049 | 0.776 | 0.778 |
| lnc-TNFRSF19-2:1 | SEQ0744 | 0.03324 | 1.177 | 0.243 |
| lnc-TNFSF4-3:3 | SEQ0337 | 0.01449 | 1.714 | 0.208 |
| lnc-TOGARAM2-1:5 | SEQ0645 | 0.02842 | 0.81 | 0.764 |
| lnc-TOGARAM2-1:6 | SEQ0646 | 0.02842 | 0.81 | 0.764 |
| lnc-TP53TG3-65:1 | SEQ0465 | 0.02049 | 1.227 | 0.222 |
| lnc-TP53TG3D-2:1 | SEQ0846 | 0.03872 | 0.9 | 0.75 |
| lnc-TP53TG3F-8:1 | SEQ0647 | 0.02842 | 1.33 | 0.236 |
| lnc-TPPP-1:2 | SEQ0002 | 0.00014 | 0.158 | 0.924 |
| lnc-TPPP-1:3 | SEQ0134 | 0.00556 | 1.834 | 0.174 |
| lnc-TRAM1-1:1 | SEQ0074 | 0.00291 | 0.59 | 0.847 |
| lnc-TRIB2-14:1 | SEQ0021 | 0.00066 | 0.788 | 0.889 |
| lnc-TRIM13-2:1 | SEQ0174 | 0.00681 | 0.739 | 0.819 |
| lnc-TRIM26-2:33 | SEQ0745 | 0.03324 | 0.782 | 0.757 |
| lnc-TRIM26-2:74 | SEQ0338 | 0.01449 | 1.231 | 0.208 |
| lnc-TRIM27-10:2 | SEQ0107 | 0.00451 | 1.227 | 0.167 |
| lnc-TRIM37-2:1 | SEQ0997 | 0.0449 | 1.221 | 0.257 |
| lnc-TRIM43B-1:2 | SEQ0387 | 0.01727 | 0.8 | 0.785 |
| lnc-TRIM49D1-4:1 | SEQ0175 | 0.00681 | 1.36 | 0.181 |
| lnc-TRIM77-7:1 | SEQ0847 | 0.03872 | 0.741 | 0.75 |
| lnc-TRIML2-11:1 | SEQ0557 | 0.02418 | 1.296 | 0.229 |
| lnc-TRMT11-4:1 | SEQ0218 | 0.00829 | 0.773 | 0.813 |
| lnc-TRPM1-3:1 | SEQ0388 | 0.01727 | 0.83 | 0.785 |
| lnc-TSC22D2-1:4 | SEQ0466 | 0.02049 | 0.633 | 0.778 |
| lnc-TSHB-2:3 | SEQ0295 | 0.01209 | 0.564 | 0.799 |
| lnc-TSHB-2:4 | SEQ0467 | 0.02049 | 1.766 | 0.222 |
| lnc-TSHB-2:5 | SEQ0468 | 0.02049 | 1.766 | 0.222 |
| lnc-TSHB-2:6 | SEQ0296 | 0.01209 | 0.564 | 0.799 |
| lnc-TSR3-1:2 | SEQ0339 | 0.01449 | 0.784 | 0.792 |
| lnc-TSTD2-4:3 | SEQ0848 | 0.03872 | 1.229 | 0.25 |
| lnc-TTC26-9:1 | SEQ0558 | 0.02418 | 0.686 | 0.771 |
| lnc-TTC38-7:1 | SEQ0849 | 0.03872 | 1.169 | 0.25 |
| lnc-TTF2-4:1 | SEQ0998 | 0.0449 | 0.848 | 0.743 |
| lnc-TUBA1C-1:12 | SEQ0999 | 0.0449 | 0.731 | 0.743 |
| lnc-TUBE1-6:1 | SEQ0850 | 0.03872 | 1.141 | 0.25 |
| lnc-TUBGCP3-11:1 | SEQ0469 | 0.02049 | 0.885 | 0.778 |
| lnc-TUSC5-3:1 | SEQ1000 | 0.0449 | 1.345 | 0.257 |
| lnc-TWSG1-2:1 | SEQ0047 | 0.00183 | 0.673 | 0.861 |
| lnc-UBE2QL1-4:1 | SEQ0648 | 0.02842 | 0.864 | 0.764 |
| lnc-UBE3C-10:1 | SEQ0075 | 0.00291 | 1.627 | 0.153 |
| lnc-UBLCP1-2:6 | SEQ0048 | 0.00183 | 0.755 | 0.861 |
| lnc-UCK1-2:1 | SEQ0851 | 0.03872 | 0.774 | 0.75 |
| lnc-UGCG-1:1 | SEQ0219 | 0.00829 | 0.802 | 0.813 |
| lnc-UGT1A8-3:1 | SEQ0649 | 0.02842 | 1.428 | 0.236 |
| lnc-UGT2B28-1:2 | SEQ1001 | 0.0449 | 0.818 | 0.743 |
| lnc-UGT2B28-2:1 | SEQ0559 | 0.02418 | 0.764 | 0.771 |
| lnc-UGT3A2-3:1 | SEQ0389 | 0.01727 | 0.855 | 0.785 |
| lnc-UNC93B1-1:5 | SEQ1002 | 0.0449 | 0.806 | 0.743 |
| lnc-UNCX-3:26 | SEQ0470 | 0.02049 | 0.493 | 0.778 |
| lnc-UPK3B-7:1 | SEQ0297 | 0.01209 | 0.607 | 0.799 |
| lnc-USP16-15:1 | SEQ0650 | 0.02842 | 0.811 | 0.764 |
| lnc-USP16-9:3 | SEQ0091 | 0.00364 | 0.834 | 0.84 |
| lnc-USP17L7-1:1 | SEQ0746 | 0.03324 | 1.48 | 0.243 |
| lnc-USP24-2:3 | SEQ0747 | 0.03324 | 0.694 | 0.757 |
| lnc-USP31-2:3 | SEQ0022 | 0.00066 | 0.685 | 0.889 |
| lnc-USP53-1:1 | SEQ0390 | 0.01727 | 0.824 | 0.785 |
| lnc-USP6NL-13:1 | SEQ0748 | 0.03324 | 1.209 | 0.243 |
| lnc-VGLL3-11:1 | SEQ0220 | 0.00829 | 0.81 | 0.813 |
| lnc-VPS8-2:4 | SEQ0852 | 0.03872 | 0.742 | 0.75 |
| lnc-VSTM2B-5:12 | SEQ0560 | 0.02418 | 0.771 | 0.771 |
| lnc-VWA5B1-2:1 | SEQ0391 | 0.01727 | 1.479 | 0.215 |
| lnc-WDR4-2:6 | SEQ1003 | 0.0449 | 0.929 | 0.743 |
| lnc-WDR63-6:2 | SEQ0471 | 0.02049 | 0.655 | 0.778 |
| lnc-WDR70-7:6 | SEQ1004 | 0.0449 | 0.929 | 0.743 |
| lnc-WDR7-11:1 | SEQ0749 | 0.03324 | 1.151 | 0.243 |
| lnc-WDYHV1-1:2 | SEQ0561 | 0.02418 | 0.912 | 0.771 |
| lnc-WISP1-17:2 | SEQ0135 | 0.00556 | 0.715 | 0.826 |
| lnc-WSB1-2:1 | SEQ0256 | 0.01004 | 1.293 | 0.194 |
| lnc-XCL2-4:1 | SEQ1005 | 0.0449 | 0.714 | 0.743 |
| lnc-XXYLT1-5:1 | SEQ0221 | 0.00829 | 0.681 | 0.813 |
| lnc-YPEL5-5:1 | SEQ0750 | 0.03324 | 1.357 | 0.243 |
| lnc-ZC3H12D-2:3 | SEQ0392 | 0.01727 | 0.831 | 0.785 |
| lnc-ZC3H15-2:1 | SEQ0012 | 0.0005 | 0.765 | 0.896 |
| lnc-ZFAT-1:3 | SEQ0562 | 0.02418 | 0.907 | 0.771 |
| lnc-ZFAT-1:8 | SEQ0393 | 0.01727 | 0.841 | 0.785 |
| lnc-ZFC3H1-16:2 | SEQ0651 | 0.02842 | 0.789 | 0.764 |
| lnc-ZFP57-15:1 | SEQ0177 | 0.00701 | 0.402 | 0.826 |
| lnc-ZFP90-3:6 | SEQ0563 | 0.02418 | 0.739 | 0.771 |
| lnc-ZMYM2-7:1 | SEQ0853 | 0.03872 | 1.335 | 0.25 |
| lnc-ZNF107-7:1 | SEQ0652 | 0.02842 | 0.735 | 0.764 |
| lnc-ZNF124-1:2 | SEQ0564 | 0.02418 | 0.827 | 0.771 |
| lnc-ZNF189-2:1 | SEQ0751 | 0.03324 | 0.903 | 0.757 |
| lnc-ZNF25-7:1 | SEQ0257 | 0.01004 | 1.37 | 0.194 |
| lnc-ZNF25-9:4 | SEQ0298 | 0.01209 | 0.663 | 0.799 |
| lnc-ZNF273-4:4 | SEQ0092 | 0.00364 | 0.742 | 0.84 |
| lnc-ZNF330-2:1 | SEQ0854 | 0.03872 | 0.833 | 0.75 |
| lnc-ZNF33A-14:1 | SEQ0049 | 0.00183 | 1.499 | 0.139 |
| lnc-ZNF33A-8:1 | SEQ1006 | 0.0449 | 1.115 | 0.257 |
| lnc-ZNF33B-3:11 | SEQ1007 | 0.0449 | 0.846 | 0.743 |
| lnc-ZNF33B-6:1 | SEQ0394 | 0.01727 | 2.524 | 0.215 |
| lnc-ZNF33B-6:3 | SEQ0299 | 0.01209 | 0.825 | 0.799 |
| lnc-ZNF385C-4:1 | SEQ0472 | 0.02049 | 1.311 | 0.222 |
| lnc-ZNF423-3:3 | SEQ1008 | 0.0449 | 1.258 | 0.257 |
| lnc-ZNF430-3:1 | SEQ0855 | 0.03872 | 0.797 | 0.75 |
| lnc-ZNF430-3:4 | SEQ0258 | 0.01004 | 0.788 | 0.806 |
| lnc-ZNF442-1:2 | SEQ0061 | 0.00232 | 0.683 | 0.854 |
| lnc-ZNF460-2:1 | SEQ0473 | 0.02049 | 0.842 | 0.778 |
| lnc-ZNF506-5:2 | SEQ0108 | 0.00451 | 0.684 | 0.833 |
| lnc-ZNF544-2:1 | SEQ0474 | 0.02049 | 0.805 | 0.778 |
| lnc-ZNF573-2:2 | SEQ0856 | 0.03872 | 0.823 | 0.75 |
| lnc-ZNF624-4:3 | SEQ0395 | 0.01727 | 1.241 | 0.215 |
| lnc-ZNF654-3:1 | SEQ0857 | 0.03872 | 0.869 | 0.75 |
| lnc-ZNF720-5:3 | SEQ0222 | 0.00829 | 1.313 | 0.188 |
| lnc-ZNF724-6:1 | SEQ0176 | 0.00681 | 0.729 | 0.819 |

TABLE 5-continued

The Sequence number, p value, mean +/− SD, fold change and AUC of the 1008 lncRNAs with differential expression in AD group versus healthy control group (p value < 0.05, Wilcoxon test)

| lncRNA | SEQ | p value | Fold change | AUC |
|---|---|---|---|---|
| lnc-ZNF726-1:3 | SEQ0259 | 0.01004 | 2.115 | 0.194 |
| lnc-ZNF827-2:1 | SEQ0653 | 0.02842 | 0.924 | 0.764 |
| lnc-ZNF99-3:2 | SEQ0396 | 0.01727 | 0.751 | 0.785 |
| lnc-ZRANB2-2:1 | SEQ0654 | 0.02842 | 0.801 | 0.764 |
| lnc-ZSWIM2-15:1 | SEQ0655 | 0.02842 | 0.696 | 0.764 |
| lnc-ZWINT-2:4 | SEQ0565 | 0.02418 | 0.637 | 0.771 |
| LRP4-AS1:5 | SEQ0766 | 0.03872 | 1.288 | 0.25 |
| LYRM4-AS1:17 | SEQ0485 | 0.02418 | 0.893 | 0.771 |
| MAPT-AS1:1 | SEQ0767 | 0.03872 | 0.785 | 0.75 |
| MCPH1-AS1:2 | SEQ0308 | 0.01449 | 1.321 | 0.208 |
| MDC1-AS1:5 | SEQ0486 | 0.02418 | 1.248 | 0.229 |
| MEF2C-AS1:25 | SEQ0582 | 0.02842 | 0.907 | 0.764 |
| MIR155HG:7 | SEQ0876 | 0.0449 | 0.606 | 0.743 |
| MIR29B2CHG:33 | SEQ0583 | 0.02842 | 0.624 | 0.764 |
| MIR29B2CHG:46 | SEQ0181 | 0.00829 | 1.522 | 0.188 |
| MIR31HG:9 | SEQ0768 | 0.03872 | 0.835 | 0.75 |
| MIR4290HG:1 | SEQ0405 | 0.02049 | 0.773 | 0.778 |
| MIR9-3HG:29 | SEQ0769 | 0.03872 | 0.557 | 0.75 |
| MIR99AHG:104 | SEQ0096 | 0.00451 | 0.871 | 0.833 |
| MIR99AHG:37 | SEQ0584 | 0.02842 | 0.879 | 0.764 |
| MIR99AHG:46 | SEQ0877 | 0.0449 | 2.516 | 0.257 |
| NAV2-AS5:1 | SEQ0051 | 0.00232 | 1.302 | 0.146 |
| NAV2-AS5:2 | SEQ0052 | 0.00232 | 1.302 | 0.146 |
| NBAT1:11 | SEQ0347 | 0.01727 | 1.738 | 0.215 |
| NIFK-AS1:25 | SEQ0487 | 0.02418 | 0.846 | 0.771 |
| NUTM2A-AS1:49 | SEQ0182 | 0.00829 | 0.633 | 0.813 |
| NUTM2B-AS1:40 | SEQ0348 | 0.01727 | 0.74 | 0.785 |
| NUTM2B-AS1:53 | SEQ0004 | 0.00027 | 0.655 | 0.91 |
| PACRG-AS3:1 | SEQ0666 | 0.03324 | 1.162 | 0.243 |
| PCBP1-AS1:250 | SEQ0770 | 0.03872 | 1.266 | 0.25 |
| PITRM1-AS1:10 | SEQ0488 | 0.02418 | 1.274 | 0.229 |
| PTPRG-AS1:14 | SEQ0183 | 0.00829 | 0.625 | 0.813 |
| PURPL:13 | SEQ0585 | 0.02842 | 1.386 | 0.236 |
| RAPGEF4-AS1:1 | SEQ0878 | 0.0449 | 0.824 | 0.743 |
| RFX3-AS1:22 | SEQ0586 | 0.02842 | 0.819 | 0.764 |
| RORB-AS1:6 | SEQ0116 | 0.00556 | 0.845 | 0.826 |
| SCHLAP1:9 | SEQ0144 | 0.00681 | 0.8 | 0.819 |
| SEC24B-AS1:19 | SEQ0406 | 0.02049 | 1.852 | 0.222 |
| SLC16A12-AS1:1 | SEQ0771 | 0.03872 | 0.773 | 0.75 |
| SMILR:3 | SEQ0040 | 0.00183 | 1.306 | 0.139 |
| SNCA-AS1:3 | SEQ0041 | 0.00183 | 0.777 | 0.861 |
| SPATA41:13 | SEQ0879 | 0.0449 | 1.607 | 0.257 |
| SRGAP3-AS2:10 | SEQ0349 | 0.01727 | 0.674 | 0.785 |
| SUCLG2-AS1:14 | SEQ0489 | 0.02418 | 0.92 | 0.771 |
| SUCLG2-AS1:9 | SEQ0490 | 0.02418 | 0.92 | 0.771 |
| TCL6:24 | SEQ0066 | 0.00291 | 1.448 | 0.153 |
| TM4SF19-AS1:10 | SEQ0184 | 0.00829 | 1.84 | 0.188 |
| TM4SF19-AS1:15 | SEQ0491 | 0.02418 | 0.853 | 0.771 |
| TMEM9B-AS1:11 | SEQ0185 | 0.00829 | 3.049 | 0.188 |
| TPT1-AS1:26 | SEQ0186 | 0.00829 | 0.763 | 0.813 |
| TRIM52-AS1:24 | SEQ0492 | 0.02418 | 1.183 | 0.229 |
| TRIM52-AS1:8 | SEQ0587 | 0.02842 | 1.272 | 0.236 |
| TTN-AS1:79 | SEQ0187 | 0.00829 | 0.829 | 0.813 |
| TTN-AS1:80 | SEQ0188 | 0.00829 | 0.829 | 0.813 |
| UCA1:7 | SEQ0078 | 0.00364 | 0.697 | 0.84 |
| UGDH-AS1:10 | SEQ0407 | 0.02049 | 0.541 | 0.778 |
| WDR86-AS1:15 | SEQ0588 | 0.02842 | 1.212 | 0.236 |
| WEE2-AS1:23 | SEQ0408 | 0.02049 | 0.704 | 0.778 |
| WT1-AS:9 | SEQ0117 | 0.00556 | 0.542 | 0.826 |
| YEATS2-AS1:3 | SEQ0772 | 0.03872 | 0.806 | 0.75 |
| ZNF528-AS1:1 | SEQ0773 | 0.03872 | 0.636 | 0.75 |
| ZNF529-AS1:21 | SEQ0880 | 0.0449 | 0.819 | 0.743 |

Out of the 1008 lncRNAs differentially expressed with a statistical significance (p value <0.05), 33 lncRNAs showed a fold change of >2 or <0.5 and are shown in the Table 6.

TABLE 6

Mean +/− SD of the 33 lncRNAs that shows a differential expression with both a statistically significance (p < 0.05, Wilcoxon test) and a fold change >2 or <0.5

| lncRNA | p value | Fold change | lncRNA | p value | Fold change |
|---|---|---|---|---|---|
| lnc-QRFP-5:1 | 0.00066 | 2.170 | MIR99AHG:46 | 0.04490 | 2.516 |
| lnc-C21orf58-1:2 | 0.00143 | 2.231 | lnc-CPM-2:11 | 0.04490 | 0.424 |
| ARRDC3-AS1:7 | 0.00232 | 0.441 | lnc-ERFE-1:1 | 0.04490 | 0.489 |
| lnc-CRYBB1-1:1 | 0.00232 | 0.487 | lnc-LRRC3B-1:3 | 0.04490 | 0.463 |
| lnc-LIMS3-1:10 | 0.00364 | 2.270 | LINC02177:8 | 0.03872 | 0.494 |
| lnc-MARCH4-2:7 | 0.00364 | 2.000 | lnc-KLF11-1:8 | 0.03324 | 0.286 |
| lnc-SUGT1-3:1 | 0.00556 | 2.047 | lnc-SNCA-3:1 | 0.02418 | 0.498 |
| DARS-AS1:47 | 0.00829 | 2.015 | lnc-UNCX-3:26 | 0.02049 | 0.493 |
| TMEM9B-AS1:11 | 0.00829 | 3.049 | BLACAT1:5 | 0.01727 | 0.424 |
| lnc-ZNF726-1:3 | 0.01004 | 2.115 | lnc-CHD1L-5:13 | 0.01449 | 0.370 |
| lnc-SLC39A11-10:11 | 0.01209 | 4.380 | lnc-EDDM13-5:11 | 0.01004 | 0.372 |
| lnc-PSMB1-6:4 | 0.01449 | 2.134 | lnc-EEF1AKMT1-3:6 | 0.00829 | 0.423 |
| DPH6-AS1:3 | 0.01727 | 2.004 | FLVCR1-AS1:13 | 0.00681 | 0.413 |
| lnc-ZNF33B-6:1 | 0.01727 | 2.524 | lnc-NAXD-6:5 | 0.00556 | 0.479 |
| lnc-PAPPA-1:3 | 0.03324 | 2.192 | lnc-ZFP57-15:1 | 0.00701 | 0.402 |
| lnc-TENM4-4:1 | 0.03324 | 2.209 | lnc-TPPP-1:2 | 0.00014 | 0.158 |
| lnc-IQCF6-2:3 | 0.03872 | 2.026 | | | |

Out of the 1008 lncRNAs differentially expressed with a statistical significance (p value <0.05), 60 lncRNAs showed an AUC of ≥0.85 and are shown in Table 7.

TABLE 7

60 lncRNAs with a p value < 0.05 and an individual AUC value AUC ≥0.85

| lncRNA | AUC |
| --- | --- |
| ARRDC3-AS1:7 | 0.854 |
| HAND2-AS1:70 | 0.861 |
| LINC00882:70 | 0.875 |
| LINC00882:71 | 0.875 |
| LINC01410:11 | 0.882 |
| LINC02345:11 | 0.111 |
| NAV2-AS5:1 | 0.146 |
| NAV2-AS5:2 | 0.146 |
| NUTM2B-AS1:53 | 0.910 |
| SMILR:3 | 0.139 |
| SNCA-AS1:3 | 0.861 |
| lnc-ABCA5-7:1 | 0.111 |
| lnc-ACOT12-9:1 | 0.854 |
| lnc-APLP2-4:1 | 0.854 |
| lnc-C21orf58-1:2 | 0.132 |
| lnc-CEP170-9:2 | 0.861 |
| lnc-CNDP1-7:1 | 0.882 |
| lnc-CRYBB1-1:1 | 0.854 |
| lnc-CSNK1A1-6:1 | 0.875 |
| lnc-DAZAP2-3:1 | 0.854 |
| lnc-DKK1-5:3 | 0.910 |
| lnc-DLG5-1:1 | 0.868 |
| lnc-DOCK7-7:1 | 0.889 |
| lnc-DUSP10-6:1 | 0.854 |
| lnc-DUSP26-3:2 | 0.875 |
| lnc-EBLN1-1:4 | 0.889 |
| lnc-EDDM13-5:3 | 0.132 |
| lnc-FAM133B-2:1 | 0.868 |
| lnc-FAM217A-1:2 | 0.875 |
| lnc-FAM49B-8:1 | 0.104 |
| lnc-FAT1-7:2 | 0.111 |
| lnc-FILIP1L-3:1 | 0.854 |
| lnc-FNBP1L-1:11 | 0.910 |
| lnc-GHR-1:1 | 0.917 |
| lnc-HECA-6:1 | 0.903 |
| lnc-IRS1-6:1 | 0.868 |
| lnc-LEPROTL1-12:1 | 0.896 |
| lnc-MGST3-1:3 | 0.139 |
| lnc-NCR3LG1-3:1 | 0.889 |
| lnc-OR4F29-3:11 | 0.861 |
| lnc-PPP2R3C-4:1 | 0.882 |
| lnc-QRFP-5:1 | 0.111 |
| lnc-RHNO1-1:1 | 0.118 |
| lnc-RNF6-2:1 | 0.854 |
| lnc-RPS21-4:2 | 0.882 |
| lnc-SOX14-2:1 | 0.861 |
| lnc-SPP1-1:1 | 0.861 |
| lnc-STOML3-6:1 | 0.868 |
| lnc-TACSTD2-2:4 | 0.889 |
| lnc-TENM3-3:3 | 0.938 |
| lnc-TENM3-3:4 | 0.097 |
| lnc-TENM3-3:5 | 0.097 |
| lnc-TMEM185B-12:7 | 0.146 |
| lnc-TPPP-1:2 | 0.924 |
| lnc-TRIB2-14:1 | 0.889 |
| lnc-TWSG1-2:1 | 0.861 |
| lnc-UBLCP1-2:6 | 0.861 |
| lnc-USP31-2:3 | 0.889 |
| lnc-ZC3H15-2:1 | 0.896 |
| lnc-ZNF33A-14:1 | 0.139 |
| lnc-ZNF442-1:2 | 0.854 |

The results from the predictive modelling based on the random forest algorithm to discriminate between AD patient and healthy control populations when using the selected miRNAs with a p value <0.05 comprising signatures of 2 or more miRNAs showed a good accuracy. For example, the signature comprising three miRNAs, miR1220.3p, miR378d and miR99a.5p, enabled a good AUC of 0.839 and an accuracy of 81.8%.

The predictive modelling based on the random forest algorithm to discriminate between AD patient and healthy control populations when using the total of the 19867 lncRNAs analyzed, enabled to show that the AUC in function of the number of lncRNA reached a plateau with the following 13 lncRNAs. These 13 lncRNAs were used to construct the model. The results show that this lncRNA signature enabled a discrimination between the 2 populations (mild AD patient and healthy control populations) with an AUC value=0.993, an accuracy=95.8%, sensitivity=100% and specificity=91.7%.

| lncRNA | Rank |
| --- | --- |
| lnc-DLG5-1:1 | 1 |
| lnc-EBLN1-1:4 | 2 |
| lnc-FAT1-7:2 | 3 |
| lnc-PRR5-5:1 | 4 |
| lnc-RBKS-6:1 | 5 |
| lnc-FOXD4L5-35:1 | 6 |
| lnc-TENM3-3:3 | 7 |
| lnc-FAM133B-2:1 | 8 |
| lnc-ZNF726-1:3 | 9 |
| lnc-AP3M1-1:1 | 10 |
| lnc-DUSP10-6:1 | 11 |
| lnc-TPPP-1:2 | 12 |
| LINC01206:20 | 13 |

Out of the 1008 lncRNAs differentially expressed with a statistical significance (p value <0.05), the 90 lncRNAs with a fold change of >2 (or <0.5) or an AUC of ≥0.85 (or ≤0.15) were used for the predictive modelling based on the random forest algorithm. The results show that with the following 7 top ranked candidates enabled a full discrimination between AD and HV groups, with an AUC value of 100% as well as 100% accuracy, 100% sensitivity and 100% specificity.

| lncRNA | Rank |
| --- | --- |
| LINC02345:11 | 1 |
| lnc-EBLN1-1:4 | 2 |
| lnc-TPPP-1:2 | 3 |
| lnc-TENM3-3:3 | 4 |
| lnc-FAT1-7:2 | 5 |
| lnc-DKK1-5:3 | 6 |
| lnc-TACSTD2-2:4 | 7 |

When applying another filter considering a list of the lncRNAs which have a fold change of >1.6 and an AUC of ≥0.85, the use of random forest algorithm enabled to select the following 12-top ranked lncRNAs to construct the model and this enabled to discriminate between the AD and HV populations with still an excellent AUC=0.979, excellent accuracy of 95.8% sensitivity of 91.7% and specificity of 100%.

| lncRNA | Rank |
| --- | --- |
| lnc-TPPP-1:2 | 1 |
| ARRDC3-AS1:7 | 2 |
| lnc-TENM3-3:5 | 3 |
| lnc-TENM3-3:4 | 4 |
| lnc-QRFP-5:1 | 5 |

-continued

| lncRNA | Rank |
| --- | --- |
| lnc-CRYBB1-1:1 | 6 |
| lnc-MGST3-1:3 | 7 |
| lnc-FAM49B-8:1 | 8 |
| HAND2-AS1:70 | 9 |
| lnc-TMEM185B-12:7 | 10 |
| lnc-CNDP1-7:1 | 11 |
| lnc-C21orf58-1:2 | 12 |

Further to select the best lncRNA candidates, modeling using Random Forest algorithm was applied to a specific set of lncRNA candidates having both a statistically significant differential expression in AD patients versus healthy control populations and a good correlation (Pearson R coefficient) with scores of neurocognitive tests including MMSE and/or MOCA out of 7 neuropsychological tests performed (Table 8): The results show that the signature of the following 3 top ranked lncRNAs enabled an excellent discrimination between AD patients and healthy control populations with AUC=0.953, accuracy, sensitivity and specificity of 91.7%, 91.7% and 91.7%.

| lncRNA | Rank |
| --- | --- |
| lnc-TENM3-3:3 | 1 |
| lnc-MARCH4-2:7 | 2 |
| lnc-LRRC1-5:2 | 3 |

Modeling using Random Forest algorithm was also applied to a specific set of lncRNA candidates from Table 9 having both a statistically significant differential expression in AD patients versus healthy control populations and a good correlation (Pearson) with neuroimaging scores (volume of brain structures of relevance for cognition and memory such as the mediotemporal area, left and right hippocampus, left and right amygdala, entorhinal cortex out of more than 120 structures measured): The results show that the signature of the following 7 top ranked lncRNAs enabled an excellent discrimination between AD patients and healthy control population with AUC=0.993, accuracy=95.8%, sensitivity=91.7% and specificity=100%.

| lncRNA | Rank |
| --- | --- |
| lnc-TPPP-1:2 | 1 |
| lnc-TENM3-3:3 | 2 |
| lnc-TMEM185B-12:7 | 3 |
| lnc-NAXD-6:5 | 4 |
| lnc-HECA-6:1 | 5 |
| lnc-COMMD6-10:1 | 6 |
| MIR29B2CHG:46 | 7 |

TABLE 8 lncRNAs of the present invention that correlate with neurocognitive tests, MoCA, MMSE. R: correlation coefficient (Pearson). HV: healthy control group, AD: mild to moderate AD group

| Cognitive test | lncRNA | R_HV + AD | R_HV | R_AD | p value | AUC |
| --- | --- | --- | --- | --- | --- | --- |
| MoCA | LINC00839:18 | −0.80 | 0.29 | −0.78 | 0.00556 | 0.83 |
| MoCA | LINC01087:1 | −0.74 | −0.13 | −0.89 | 0.00681 | 0.82 |
| MMSE | LINC01087:1 | −0.68 | 0.05 | −0.75 | 0.00681 | 0.82 |
| MMSE | lnc-ANAPC11-2:6 | 0.65 | 0.26 | 0.77 | 0.04490 | 0.26 |
| MoCA | lnc-ANAPC11-2:6 | 0.59 | −0.46 | 0.77 | 0.04490 | 0.26 |
| MoCA | lnc-ARHGAP26-4:33 | −0.64 | −0.66 | −0.72 | 0.03872 | 0.75 |
| MoCA | lnc-CCDC197-2:1 | −0.14 | −0.42 | 0.74 | 0.00291 | 0.85 |
| MMSE | lnc-CFAP36-3:2 | −0.62 | 0.05 | −0.75 | 0.03872 | 0.75 |
| MoCA | lnc-DHX38-25:1 | −0.69 | −0.60 | −0.77 | 0.01004 | 0.81 |
| MMSE | lnc-DHX38-25:1 | −0.65 | −0.57 | −0.71 | 0.01004 | 0.81 |
| MoCA | lnc-EZH2-3:1 | −0.69 | 0.18 | −0.78 | 0.01209 | 0.80 |
| MMSE | lnc-GNG5-8:1 | −0.72 | 0.32 | −0.71 | 0.03324 | 0.76 |
| MoCA | lnc-GPRC5A-4:1 | −0.65 | −0.02 | −0.74 | 0.02842 | 0.76 |
| MMSE | lnc-GRAMD2B-4:1 | −0.59 | 0.42 | −0.72 | 0.03872 | 0.75 |
| MMSE | lnc-GRIP1-8:1 | −0.03 | 0.30 | −0.73 | 0.03872 | 0.25 |
| MoCA | lnc-LYN-8:1 | 0.13 | 0.54 | −0.71 | 0.02842 | 0.24 |
| MMSE | lnc-MAP9-6:1 | −0.73 | −0.08 | −0.74 | 0.01209 | 0.80 |
| MMSE | lnc-NRP1-4:1 | −0.11 | 0.27 | −0.72 | 0.04490 | 0.26 |
| MoCA | lnc-RBFOX1-2:1 | 0.02 | 0.13 | −0.75 | 0.01727 | 0.22 |
| MoCA | lnc-RPL37-2:1 | 0.62 | −0.16 | 0.75 | 0.00829 | 0.19 |
| MMSE | lnc-RUBCN-1:1 | 0.11 | 0.33 | 0.72 | 0.03872 | 0.75 |
| MMSE | lnc-SNCA-3:1 | 0.08 | 0.12 | 0.76 | 0.02418 | 0.77 |
| MMSE | lnc-SRSF2-2:5 | 0.10 | 0.04 | 0.75 | 0.03324 | 0.76 |
| MoCA | lnc-SRSF2-2:5 | −0.05 | −0.32 | 0.73 | 0.03324 | 0.76 |
| MMSE | lnc-TMEM185B-12:7 | 0.06 | −0.14 | −0.73 | 0.00232 | 0.15 |
| MoCA | lnc-TRIB2-14:1 | −0.76 | −0.45 | −0.71 | 0.00066 | 0.89 |
| MMSE | lnc-TRIM43B-1:2 | −0.74 | −0.11 | −0.76 | 0.01727 | 0.78 |
| MoCA | lnc-TRIM43B-1:2 | −0.72 | −0.12 | −0.74 | 0.01727 | 0.78 |
| MMSE | lnc-ZNF189-2:1 | −0.70 | −0.35 | −0.74 | 0.03324 | 0.76 |
| MoCA | lnc-ZNF189-2:1 | −0.67 | 0.03 | −0.76 | 0.03324 | 0.76 |
| MMSE | lnc-ZRANB2-2:1 | −0.65 | −0.36 | −0.82 | 0.02842 | 0.76 |
| MoCA | lnc-ZRANB2-2:1 | −0.59 | 0.16 | −0.80 | 0.02842 | 0.76 |

TABLE 9 lncRNAs of the present invention that correlate with MRI (volumes
of the brain structures). R: correlation coefficient (Pearson).
HV: healthy control group, AD: mild to moderate AD group.

| MRI | lncRNA | R_HV + AD | R_HV | R_AD | p value | AUC |
|---|---|---|---|---|---|---|
| Left.Amygdala | CYTOR:18 | 0.71 | 0.30 | 0.69 | 0.00291 | 0.15 |
| Left.Hippocampus | DLGAP2-AS1:18 | −0.71 | −0.51 | −0.76 | 0.03324 | 0.76 |
| Left.Hippocampus | LINC00458:19 | −0.79 | −0.48 | −0.78 | 0.02842 | 0.76 |
| Mediotemporal | LINC00458:19 | −0.72 | −0.48 | −0.53 | 0.02842 | 0.76 |
| Left.Hippocampus | LINC00938:6 | −0.82 | −0.48 | −0.76 | 0.01209 | 0.80 |
| Mediotemporal | LINC00938:6 | −0.76 | −0.63 | −0.46 | 0.01209 | 0.80 |
| Right.Hippocampus | LINC00938:6 | −0.75 | −0.56 | −0.48 | 0.01209 | 0.80 |
| Left.Amygdala | LINC01629:11 | −0.78 | −0.53 | −0.83 | 0.02842 | 0.76 |
| Left.Hippocampus | lnc-AIG1-5:1 | −0.78 | −0.64 | −0.73 | 0.02418 | 0.77 |
| Left.Hippocampus | lnc-AKR1D1-5:2 | −0.74 | −0.47 | −0.69 | 0.00451 | 0.83 |
| Right.Hippocampus | lnc-AKR1D1-5:2 | −0.71 | −0.27 | −0.73 | 0.00451 | 0.83 |
| Mediotemporal | lnc-AKR1D1-5:2 | −0.71 | −0.26 | −0.72 | 0.00451 | 0.83 |
| Right.Amygdala | lnc-C3orf58-7:1 | −0.73 | −0.22 | −0.69 | 0.02842 | 0.76 |
| Left.Hippocampus | lnc-C5orf30-10:2 | −0.73 | −0.58 | −0.58 | 0.02842 | 0.76 |
| Right.Amygdala | lnc-CASP9-1:1 | 0.73 | 0.26 | 0.81 | 0.03872 | 0.25 |
| Right.Hippocampus | lnc-CHN1-5:11 | −0.72 | −0.44 | −0.67 | 0.02049 | 0.78 |
| Right.Amygdala | lnc-CLVS2-2:5 | −0.74 | −0.39 | −0.75 | 0.01727 | 0.78 |
| Left.Hippocampus | lnc-DAZAP2-3:1 | −0.72 | −0.53 | −0.58 | 0.00232 | 0.85 |
| Mediotemporal | lnc-DTWD2-14:1 | −0.75 | −0.49 | −0.79 | 0.01727 | 0.78 |
| Left.Amygdala | lnc-DTWD2-14:1 | −0.74 | −0.46 | −0.82 | 0.01727 | 0.78 |
| lh_entorhinal | lnc-DTWD2-14:1 | −0.74 | −0.59 | −0.61 | 0.01727 | 0.78 |
| Right.Hippocampus | lnc-ELFN2-1:3 | −0.77 | −0.26 | −0.76 | 0.00364 | 0.84 |
| Left.Amygdala | lnc-ELFN2-1:3 | −0.74 | −0.27 | −0.81 | 0.00364 | 0.84 |
| Mediotemporal | lnc-ELFN2-1:3 | −0.74 | −0.22 | −0.73 | 0.00364 | 0.84 |
| Right.Amygdala | lnc-ELFN2-1:3 | −0.74 | −0.37 | −0.61 | 0.00364 | 0.84 |
| Left.Hippocampus | lnc-FAM171B-1:6 | −0.72 | −0.28 | −0.62 | 0.00829 | 0.81 |
| Left.Hippocampus | lnc-FGD4-8:1 | −0.74 | −0.49 | −0.61 | 0.01004 | 0.81 |
| Left.Amygdala | lnc-FGD4-9:1 | −0.76 | −0.49 | −0.56 | 0.00364 | 0.84 |
| Right.Hippocampus | lnc-FGD4-9:1 | −0.74 | −0.19 | −0.64 | 0.00364 | 0.84 |
| Mediotemporal | lnc-FGD4-9:1 | −0.72 | −0.28 | −0.54 | 0.00364 | 0.84 |
| Left.Hippocampus | lnc-FGD4-9:1 | −0.71 | −0.33 | −0.52 | 0.00364 | 0.84 |
| lh_entorhinal | lnc-GPR39-10:2 | 0.77 | 0.68 | 0.49 | 0.00681 | 0.18 |
| Left.Amygdala | lnc-GPR39-10:2 | 0.72 | 0.54 | 0.37 | 0.00681 | 0.18 |
| Left.Hippocampus | lnc-GRM1-1:31 | −0.76 | −0.39 | −0.72 | 0.00681 | 0.82 |
| Right.Hippocampus | lnc-GRM1-1:31 | −0.71 | −0.38 | −0.56 | 0.00681 | 0.82 |
| Left.Hippocampus | lnc-GRM1-1:32 | −0.76 | −0.39 | −0.72 | 0.00681 | 0.82 |
| Right.Hippocampus | lnc-GRM1-1:32 | −0.71 | −0.38 | −0.56 | 0.00681 | 0.82 |
| Right.Hippocampus | lnc-HECA-3:13 | −0.72 | −0.31 | −0.67 | 0.01004 | 0.81 |
| Right.Amygdala | lnc-HJURP-7:1 | −0.77 | −0.46 | −0.77 | 0.02049 | 0.78 |
| Left.Hippocampus | lnc-HJURP-7:1 | −0.73 | −0.33 | −0.73 | 0.02049 | 0.78 |
| Right.Hippocampus | lnc-HJURP-7:1 | −0.73 | −0.02 | −0.93 | 0.02049 | 0.78 |
| Mediotemporal | lnc-HJURP-7:1 | −0.72 | −0.20 | −0.82 | 0.02049 | 0.78 |
| Left.Amygdala | lnc-IRS1-6:1 | −0.75 | −0.35 | −0.72 | 0.00143 | 0.87 |
| Right.Hippocampus | lnc-IRS1-6:1 | −0.73 | −0.36 | −0.56 | 0.00143 | 0.87 |
| Mediotemporal | lnc-IRS1-6:1 | −0.71 | −0.34 | −0.51 | 0.00143 | 0.87 |
| Right.Hippocampus | lnc-KDM3A-1:4 | −0.81 | −0.35 | −0.80 | 0.00451 | 0.83 |
| Mediotemporal | lnc-KDM3A-1:4 | −0.77 | −0.36 | −0.70 | 0.00451 | 0.83 |
| Left.Hippocampus | lnc-KDM3A-1:4 | −0.72 | −0.26 | −0.61 | 0.00451 | 0.83 |
| Left.Hippocampus | lnc-LARP1B-1:15 | −0.75 | −0.56 | −0.75 | 0.01209 | 0.80 |
| Right.Amygdala | lnc-LARP1B-1:15 | −0.75 | −0.63 | −0.71 | 0.01209 | 0.80 |
| Left.Hippocampus | lnc-LARP1B-1:17 | −0.75 | −0.56 | −0.75 | 0.01209 | 0.80 |
| Right.Amygdala | lnc-LARP1B-1:17 | −0.75 | −0.63 | −0.71 | 0.01209 | 0.80 |
| Right.Amygdala | lnc-MAMDC2-1:1 | −0.75 | −0.72 | −0.70 | 0.02418 | 0.77 |
| Left.Hippocampus | lnc-MAP9-6:1 | −0.79 | −0.43 | −0.87 | 0.01209 | 0.80 |
| Right.Hippocampus | lnc-NAALADL2-8:1 | −0.71 | −0.28 | −0.72 | 0.01449 | 0.79 |
| Right.Hippocampus | lnc-NBPF14-1:2 | −0.80 | −0.38 | −0.82 | 0.00364 | 0.84 |
| Mediotemporal | lnc-NBPF14-1:2 | −0.75 | −0.37 | −0.67 | 0.00364 | 0.84 |
| Right.Amygdala | lnc-NBPF14-1:2 | −0.73 | −0.40 | −0.60 | 0.00364 | 0.84 |
| Left.Hippocampus | lnc-NBPF14-1:2 | −0.72 | −0.48 | −0.52 | 0.00364 | 0.84 |
| Right.Hippocampus | lnc-PIGB-1:5 | −0.73 | −0.26 | −0.79 | 0.02418 | 0.77 |
| Right.Amygdala | lnc-PLN-2:1 | −0.77 | −0.66 | −0.72 | 0.03324 | 0.76 |
| Mediotemporal | lnc-PLN-2:1 | −0.76 | −0.66 | −0.67 | 0.03324 | 0.76 |
| Left.Hippocampus | lnc-PLN-2:1 | −0.75 | −0.67 | −0.64 | 0.03324 | 0.76 |
| Right.Hippocampus | lnc-PLN-2:1 | −0.73 | −0.54 | −0.68 | 0.03324 | 0.76 |
| Left.Hippocampus | lnc-PTPN4-1:1 | −0.74 | −0.59 | −0.69 | 0.02842 | 0.76 |
| Right.Amygdala | lnc-SLC38A2-1:11 | −0.76 | −0.73 | −0.57 | 0.01004 | 0.81 |
| Left.Amygdala | lnc-SLC38A2-1:11 | −0.73 | −0.57 | −0.38 | 0.01004 | 0.81 |
| Right.Amygdala | lnc-SMARCA5-4:18 | −0.72 | −0.35 | −0.78 | 0.01004 | 0.81 |
| Mediotemporal | lnc-SMARCA5-4:18 | −0.72 | −0.29 | −0.84 | 0.01004 | 0.81 |
| Left.Amygdala | lnc-SMARCA5-4:18 | −0.71 | −0.30 | −0.92 | 0.01004 | 0.81 |
| lh_entorhinal | lnc-TMEM242-6:1 | −0.77 | −0.64 | −0.78 | 0.02049 | 0.78 |
| Mediotemporal | lnc-TMEM242-6:1 | −0.72 | −0.62 | −0.63 | 0.02049 | 0.78 |
| Right.Hippocampus | lnc-TPPP-1:2 | −0.73 | −0.03 | −0.42 | 0.00014 | 0.92 |
| Left.Hippocampus | lnc-TRIM43B-1:2 | −0.75 | −0.47 | −0.72 | 0.01727 | 0.78 |

TABLE 9-continued lncRNAs of the present invention that correlate with MRI (volumes of the brain structures). R: correlation coefficient (Pearson). HV: healthy control group, AD: mild to moderate AD group.

| MRI | lncRNA | R_HV + AD | R_HV | R_AD | p value | AUC |
|---|---|---|---|---|---|---|
| lh_entorhinal | lnc-TRMT11-4:1 | −0.80 | −0.86 | −0.30 | 0.00829 | 0.81 |
| Mediotemporal | lnc-TRMT11-4:1 | −0.74 | −0.73 | −0.30 | 0.00829 | 0.81 |
| Left.Amygdala | lnc-TRMT11-4:1 | −0.73 | −0.58 | −0.35 | 0.00829 | 0.81 |
| Left.Hippocampus | lnc-USP53-1:1 | −0.75 | −0.24 | −0.84 | 0.01727 | 0.78 |
| Left.Hippocampus | lnc-ZNF33B-6:3 | −0.78 | −0.40 | −0.81 | 0.01209 | 0.80 |
| Right.Amygdala | lnc-ZNF33B-6:3 | −0.74 | −0.47 | −0.65 | 0.01209 | 0.80 |
| Right.Amygdala | MIR29B2CHG:46 | 0.74 | 0.35 | 0.82 | 0.00829 | 0.19 |
| rh_entorhinal | MIR29B2CHG:46 | 0.71 | 0.45 | 0.80 | 0.00829 | 0.19 |
| Right.Amygdala | PCBP1-AS1:250 | 0.73 | 0.20 | 0.71 | 0.03872 | 0.25 |
| Mediotemporal | PCBP1-AS1:250 | 0.71 | 0.19 | 0.70 | 0.03872 | 0.25 |

Modeling using Random Forest algorithm was also applied to a specific set of lncRNA candidates from Table 10 having both a statistically significant differential expression in AD patients versus healthy control populations and a good correlation (Pearson) with level of the CSF biomarkers of high relevance to AD pathology: Aβ42, tau or phosphorylated-tau: The results show that the signature of the following 18 top ranked lncRNAs enabled an excellent discrimination between AD patients and healthy control population with AUC=0.972 accuracy=0,917 sensitivity=0.83 and specificity=1.

| lncRNA | Rank |
|---|---|
| lnc-TPPP-1:2 | 1 |
| LINC02345:11 | 2 |
| lnc-ZNF273-4:4 | 3 |
| lnc-TACC2-8:6 | 4 |
| LINC01206:20 | 5 |
| lnc-C5orf67-3:1 | 6 |
| HAND2-AS1:58 | 7 |
| lnc-PRDM9-20:1 | 8 |
| lnc-CLK1-1:7 | 9 |
| lnc-DNALI1-5:4 | 10 |
| RORB-AS1:6 | 11 |
| lnc-TPPP-1:3 | 12 |
| lnc-BMS1-2:1 | 13 |
| lnc-ADRB1-4:1 | 14 |
| lnc-XXYLT1-5:1 | 15 |
| MIR99AHG:104 | 16 |
| LINC01748:17 | 17 |
| lnc-AKR1E2-15:1 | 18 |

TABLE 10 lncRNAs of the present invention that correlate with CSF biomarkers

| CSF BM | lncRNA | R_AD | PValue | AUC |
|---|---|---|---|---|
| Aβ42 | LINC01748:17 | −0.73 | 0.0242 | 0.77 |
| Aβ42 | lnc-C5orf67-3:1 | 0.72 | 0.0068 | 0.82 |
| Aβ42 | lnc-CYP2E1-1:1 | −0.74 | 0.0332 | 0.24 |
| Aβ42 | lnc-FAP-3:1 | −0.72 | 0.0083 | 0.81 |
| Aβ42 | lnc-FGD4-9:1 | −0.73 | 0.0036 | 0.84 |
| Aβ42 | lnc-GLIPR1L1-2:3 | 0.72 | 0.0205 | 0.22 |
| Aβ42 | lnc-KDM3A-1:4 | −0.77 | 0.0045 | 0.83 |
| Aβ42 | lnc-LRCH1-1:1 | −0.75 | 0.0205 | 0.78 |
| Aβ42 | lnc-NPBWR1-2:2 | 0.81 | 0.0449 | 0.26 |
| Aβ42 | lnc-PLA2G2F-1:2 | −0.74 | 0.0121 | 0.20 |
| Aβ42 | lnc-POU2AF1-1:2 | −0.84 | 0.0205 | 0.78 |
| Aβ42 | lnc-RCSD1-4:1 | −0.72 | 0.0387 | 0.75 |
| Aβ42 | lnc-SERPINI1-14:1 | −0.74 | 0.0449 | 0.74 |
| Aβ42 | lnc-TAF9-10:1 | −0.75 | 0.0284 | 0.76 |
| Aβ42 | lnc-TNFRSF19-2:1 | 0.71 | 0.0332 | 0.24 |

TABLE 10-continued lncRNAs of the present invention that correlate with CSF biomarkers

| CSF BM | lncRNA | R_AD | PValue | AUC |
|---|---|---|---|---|
| Aβ42 | lnc-TPPP-1:2 | −0.86 | 0.0001 | 0.92 |
| Aβ42 | lnc-TPPP-1:3 | 0.8 | 0.0056 | 0.17 |
| Aβ42 | lnc-ZNF273-4:4 | −0.87 | 0.0036 | 0.84 |
| T-tau | HAND2-AS1:58 | 0.92 | 0.0045 | 0.83 |
| T-tau | HAND2-AS1:59 | 0.9 | 0.0056 | 0.83 |
| T-tau | HAND2-AS1:70 | 0.8 | 0.0018 | 0.86 |
| T-tau | HAND2-AS1:71 | 0.8 | 0.0036 | 0.84 |
| T-tau | LINC00200:6 | 0.71 | 0.0029 | 0.15 |
| T-tau | LINC00649:23 | −0.74 | 0.0036 | 0.84 |
| T-tau | LINC01206:11 | −0.74 | 0.0332 | 0.76 |
| T-tau | LINC01355:9 | 0.83 | 0.0332 | 0.76 |
| T-tau | lnc-ADRB1-4:1 | 0.8 | 0.0056 | 0.83 |
| T-tau | lnc-AKR1E2-15:1 | 0.75 | 0.0205 | 0.22 |
| T-tau | lnc-APBA1-5:1 | 0.8 | 0.0284 | 0.76 |
| T-tau | lnc-BMS1-2:1 | 0.76 | 0.0332 | 0.24 |
| T-tau | lnc-CA7-2:2 | −0.73 | 0.0332 | 0.76 |
| T-tau | lnc-CLK1-1:7 | −0.83 | 0.0083 | 0.81 |
| T-tau | lnc-DAPP1-2:11 | 0.8 | 0.0242 | 0.77 |
| T-tau | lnc-DNALI1-5:4 | −0.76 | 0.0045 | 0.83 |
| T-tau | lnc-ELF1-5:1 | 0.86 | 0.0242 | 0.77 |
| T-tau | lnc-LBH-4:1 | −0.79 | 0.0332 | 0.24 |
| T-tau | lnc-MVB12B-6:1 | 0.89 | 0.0242 | 0.77 |
| T-tau | lnc-MYO18B-2:3 | −0.72 | 0.0145 | 0.79 |
| T-tau | lnc-OR8G5-7:2 | −0.81 | 0.0284 | 0.76 |
| T-tau | lnc-PAX8-6:2 | 0.71 | 0.0242 | 0.23 |
| T-tau | lnc-POLE4-3:1 | 0.71 | 0.0145 | 0.79 |
| T-tau | lnc-SERTM1-1:1 | −0.72 | 0.0121 | 0.80 |
| T-tau | lnc-SOX14-2:1 | 0.71 | 0.0018 | 0.86 |
| T-tau | lnc-SYCP1-4:1 | −0.83 | 0.0387 | 0.25 |
| T-tau | lnc-TACC2-8:6 | −0.78 | 0.0068 | 0.82 |
| T-tau | lnc-TEAD4-1:1 | −0.71 | 0.0449 | 0.26 |
| T-tau | lnc-TF-4:1 | 0.82 | 0.0332 | 0.76 |
| T-tau | lnc-TTF2-4:1 | −0.8 | 0.0449 | 0.74 |
| T-tau | lnc-XXYLT1-5:1 | −0.71 | 0.0083 | 0.81 |
| T-tau | lnc-ZC3H12D-2:3 | −0.72 | 0.0173 | 0.78 |
| T-tau | lnc-ZNF430-3:4 | −0.79 | 0.01 | 0.81 |
| T-tau | MIR99AHG:104 | 0.9 | 0.0045 | 0.83 |
| T-tau | PITRM1-AS1:10 | 0.91 | 0.0242 | 0.23 |
| T-tau | RORB-AS1:6 | 0.73 | 0.0056 | 0.83 |
| T-tau | SEC24B-AS1:19 | −0.93 | 0.0205 | 0.22 |
| T-tau | ZNF528-AS1:1 | −0.74 | 0.0387 | 0.75 |
| p-tau | BLACAT1:3 | −0.71 | 0.0145 | 0.21 |
| p-tau | HAND2-AS1:58 | 0.71 | 0.0045 | 0.83 |
| p-tau | KAZN-AS1:4 | −0.73 | 0.0205 | 0.78 |
| p-tau | LINC00649:23 | −0.71 | 0.0036 | 0.84 |
| p-tau | LINC01206:11 | −0.77 | 0.0332 | 0.76 |
| p-tau | LINC01206:20 | 0.84 | 0.0205 | 0.22 |
| p-tau | LINC01684:16 | 0.71 | 0.0242 | 0.77 |
| p-tau | LINC02246:11 | 0.74 | 0.0173 | 0.78 |
| p-tau | LINC02345:11 | −0.75 | 0.0007 | 0.11 |
| p-tau | lnc-AQP8-2:7 | −0.82 | 0.0173 | 0.22 |
| p-tau | lnc-AUH-2:9 | −0.78 | 0.0332 | 0.24 |
| p-tau | lnc-CA7-2:2 | −0.79 | 0.0332 | 0.76 |

TABLE 10-continued lncRNAs of the present invention that correlate with CSF biomarkers

| CSF BM | lncRNA | R_AD | PValue | AUC |
|---|---|---|---|---|
| p-tau | lnc-CLK1-1:7 | −0.73 | 0.0083 | 0.81 |
| p-tau | lnc-ELF1-5:1 | 0.74 | 0.0242 | 0.77 |
| p-tau | lnc-FER1L6-2:1 | 0.83 | 0.0242 | 0.77 |
| p-tau | lnc-HS3ST3A1-1:1 | 0.77 | 0.01 | 0.81 |
| p-tau | lnc-KCTD19-1:1 | 0.78 | 0.0332 | 0.76 |
| p-tau | lnc-LMBRD1-5:17 | −0.73 | 0.0387 | 0.75 |
| p-tau | lnc-MVB12B-6:1 | 0.72 | 0.0242 | 0.77 |
| p-tau | lnc-NKX6-1-2:1 | 0.79 | 0.0121 | 0.80 |
| p-tau | lnc-OR8G5-7:2 | −0.85 | 0.0284 | 0.76 |
| p-tau | lnc-PACRGL-5:1 | 0.71 | 0.0332 | 0.76 |
| p-tau | lnc-PRDM9-20:1 | 0.73 | 0.0173 | 0.78 |
| p-tau | lnc-RHOB-1:3 | −0.76 | 0.0205 | 0.78 |
| p-tau | lnc-RPE65-4:2 | −0.79 | 0.0056 | 0.83 |
| p-tau | lnc-SERTM1-1:1 | −0.82 | 0.0121 | 0.80 |
| p-tau | lnc-SOX14-2:1 | 0.76 | 0.0018 | 0.86 |
| p-tau | lnc-SPAG9-2:1 | 0.71 | 0.0173 | 0.78 |
| p-tau | lnc-SPAG9-2:2 | 0.71 | 0.0173 | 0.78 |
| p-tau | lnc-SYCP1-4:1 | −0.76 | 0.0387 | 0.25 |
| p-tau | lnc-TACC2-8:6 | −0.75 | 0.0068 | 0.82 |
| p-tau | lnc-TEKT3-3:1 | −0.84 | 0.0387 | 0.75 |
| p-tau | lnc-TF-4:1 | 0.73 | 0.0332 | 0.76 |
| p-tau | lnc-TP53TG3D-2:1 | 0.71 | 0.0387 | 0.75 |
| p-tau | MIR99AHG:104 | 0.92 | 0.0045 | 0.83 |
| p-tau | RORB-AS1:6 | 0.81 | 0.0056 | 0.83 |
| p-tau | SEC24B-AS1:19 | −0.75 | 0.0205 | 0.22 |
| p-tau | TM4SF19-AS1:10 | 0.76 | 0.0083 | 0.19 |

MATERIALS AND METHODS

To identify miRNA in plasma or serum or whole blood samples of human subjects, miRNA profiling of 2083 miRNAs was performed using HTG EdgeSeq miRNA whole transcriptome V2 targeted sequencing assay (HTG WTA V2, HTG Molecular, Tucson, United States). This technology is based on nuclease protection targeted RNA sequencing assay that uses an extraction free lysis process followed by a nuclease protection assay (NPA) to prepare a stoichiometric library of nuclease protection probes (NPP) for measurement.

To identify lncRNAs in serum, plasma or whole blood samples of human subjects, circulating total RNA was first extracted and sequencing libraries were prepared by removal of ribosomic RNA (RiboZero TruSeq library preparation kit, Illumina Inc. San Diego, USA) and sequenced on Illumina NextSeq500 with 2×75 bp read length.

ncRNA (miRNA and lncRNA) were also measured by qPCR using specific primers. For this, circulating total RNA was first extracted, reverse transcription and real time PCR using specific primers were performed. Using FiMAP, a proprietary platform based on hybridization of PCR products on coated microdiscs with complementary oligonucleotide coupled to detection probes. Total RNA was extracted followed by reverse transcription and PCR step allowing multiplexing of several targets using specific primers to the ncRNAs. Quantification was therefore performed on the FiMAP platform using coded microdiscs specific of each ncRNA.

Patient population and samples Serum or plasma samples were prepared from blood samples collected in lithium-heparin tubes and whole blood samples were collected in Paxgene RNA tubes. Samples were from healthy volunteers (HV), donors at the "Etablissement Français du Sang" (EFS) of Mulhouse, France, and from cognitively intact healthy control subjects and patients with mild cognitive impairment or with different stages of Alzheimer's disease (AD) recruited according to the protocols of the Amoneta Diagnostics sponsored prospective studies registered to the Agence Nationale de Sécurité du Médicament et des Produits de Santé (ANSM) including ADKIT study under the ID RCB: 2015-A00118-41 on Jan. 22, 2015, the chronobiological study under the ID RCB: 2016-A200227-44 on Feb. 4, 2016.

Method for miRNAs

HTG EdgeSeq Run

HTG whole transcriptome miRNA (WTA) kit was used (HTG WTA V2, HTG Molecular, Tucson, United States). Samples were prepared accordingly to the following protocol: 15 µl of plasma lysis buffer and 15 µl of plasma sample and 3 µl of Proteinase K are mixed and incubated at 50° C. for 60 min with orbital shaking. 25 µl of the mix is transferred to the HTG sample plate and loaded into the HTG processor to perform the nuclease protection assay and prepare the stoichiometric NPP.

Molecular Barcoding and Adapter Addition

For plasma samples, barcoding is performed using Hemo KlenTaq (M0332S, NEB, Evry, France) enzyme. For each sample, we mix 2.4 µl of Hemo KlenTaq, 0.6 µl of dNTPs (10 nM) (NEB, N0447S), 6 µl of OneTaq PCR GC Buffer 5× (B9023S, NEB, Evry, France), 3 µl of Forward and Reverse Primers (HTG WTA, HTG Molecular, Tucson, United States), 3 µl of sample preparation and 12 µl of H20. PCR step was performed on ABI 2720 Thermocycler using the following cycling profile: 95° C. for 4 min followed by 16 cycles of 95° C. for 15 sec, 55° C. for 45 sec and 68° C. for 45 sec. Protocol is ended with 68° C. for 10 min.

PCR Clean Up

In order to remove excess of primer from the library, Agentcour AMPure XP beads (A63880, Beckmancoulter, Villepinte, France) were used. For each sample, 37.5 µl of AMPure XP beads are used in combination with 15 µl of the PCR product. After mixing 10 times with pipette, the solution is incubated for 5 min at room temperature and then placed on the magnetic stand. After 2 minutes to separate beads, the cleared solution is carefully removed without disturbing the beads. Beads are washed 2 times with 200 µl of Ethanol 80%. Elution of PCR product link to the beads is performed with 25 µl of H20. The purified solution of PCR product is place in a new tube while the plate is on the magnetic stand to separate PCR products and beads.

Determination of Library Concentration:

To determine concentration of library for each sample, Kapa Biosystems qPCR Kit (KK4824, Cliniscience, Nanterre, France) is used. For each reaction, the mix is composed of 12 µl of Mastermix, 0.4 µl of ROX dye, 3.6 µl of H20 and 4 µl of template (standards or library diluted at 1/10000). The samples were run on a ABI PRISM 7900HT (High ROX) will the following cycles: 95° C. for 5 min, 35 cycles of 95° C. for 30 sec and 65° C. for 45° C. with data collection followed by a dissociation curve. Standards are corresponding to an amplicon of 452 bp whereas the amplicon of NPP with barcode correspond to 115 bp. The ratio is applied to determine the concentration of each library.

Sample Pooling and Sequencing

Each sample are pooled in order to generate a pooled library at 4 nM. From this pooled library, 5 µl where mixed with 0.2N NaOH freshly prepared and incubated for 2 min. The solution was vortexed briefly and centrifuged at 280 g for 1 minute and mixed with 990 µl of pre-chiller HT1 buffer (Illumina NextSeq Reagent v2 kit, Illumina, Paris, France). 15% PhiX (PhiX control v3, Illumina, Paris, France) at 20 pM was prepared. 260 µl of prepared denatured library at 20 pM was mix with 39 µl of 20 pM PhiX and 1001 µl of HT1

Buffer was loaded into Illumina NextSeq500 Mid Output V2 150 cycles kit and sequenced.

Sequence Analysis

Data reconstruction and analysis was performed using directly FASTQ files from the Illumina Sequencer and processed by the HTG Parser software.

Statistics

The data are normalized using the method recommended by the supplier. This normalization is based on total count of sequences after filtering out all values below 70 (threshold recommended by the supplier). After normalization, all miRNAs with 75th percentile of this threshold are considered as noise and have been deleted.

In order to determine miRNAs that discriminate Alzheimer disease patients from healthy control subjects, the following statistical methods are applied to the normalized data: two-tailed Welch t test and computation fold change were performed on normalized data. Individual ROC Curve was performed for each miRNA detected in the samples. The random Forest algorithm with the best miRNA in term of AUROC was performed to establish a predictive model for the diagnosis of Alzheimer disease.

The final list of miRNAs of interest was chosen with p value <0.05 or fold change >1.49 or <0.75 in Log 2 and/or individual AUC determined by the selection of all the miRNAs that are at least in one of the three lists of selected biomarkers (tables 1, 2 and 3).

Method for lncRNA

Samples Sequencing

Ribonucleic acid (RNA) extraction is performed starting from 1.5 ml of serum, using Norgen Serum/plasma extraction and RNA Clean-Up and Concentration Micro-Elute Kits according to the manufacturer's instructions.

Sequencing libraries are prepared from the total amount of extracted RNA, using the Illumina TruSeq stranded total RNA library preparation kit combined with the human/mouse/rat RiboZero rRNA removal kit (Illumina Inc. San Diego, USA, C). All steps are performed with the low-throughput protocol and according to the manufacturer's instructions, with no fragmentation step. Briefly, cytoplasmic ribosomal RNA (rRNA) are hybridized to biotinylated target-specific oligos and removed using streptavidin coated magnetic beads. rRNA depleted RNA samples are then reverse transcribed into complementary deoxyribonucleic acid (cDNA). To ensure strand specificity, single stranded cDNA is first synthetized using Super-Script II reverse transcriptase (Invitrogen) and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3'end adenylation step, Illumina's adapters ligation is performed. So, obtained singled indexed libraries are washed twice using AMPure XP beads to remove excess adapters and enriched by PCR (15 cycles). PCR products are purified with a final AM Pure XP beads wash and sequencing ready libraries are eluted in 30 µl of resuspension buffer. For quality control, 1 µl of each library is run on the Agilent Technologies 2100 Bioanalyzer using a DNA 1000 chip according to the manufacturer's recommendations. Absence of adapter dimers is checked and the average library size is determined by a region table.

Libraries are quantified on Qubit 2.0 using Qubit dsDNA High Sensitivity assay kit (Invitrogen). Library size previously determined on the Bioanalyzer is used to calculate molar concentrations from mass concentrations.

All libraries are sequenced with the Illumina NextSeq500 (2×75 bp).

Bioinformatic Analysis

RNA-seq data analysis is performed using Partek Flow (Partek Inc., St Louis, Mo., USA build 6). The pre-alignment QA/QC module of Partek Flow is used to visualize the read quality of the FASTQ files. All reads are examined. The raw FASTQ files are trimmed at the 3' end in function of their quality score (Phred score). The parameters used are an end minimum quality level of 30 and a minimum trimmed read length of 50. Unaligned reads are mapped using the *Homo sapiens* hg19 genome. This mapping is done using the software STAR version 2.5.3 (Dobin, A., Davis, C. A., Schlesinger, F., Drenkow, J., Zaleski, C., Jha, S., Batut, P., Chaisson, M., and Gingeras, T. R. (2013). STAR: ultrafast universal RNA-seq aligner. Bioinforma. Oxf. Engl. 29, 15-21). The default parameters are used. The post-alignment QC module of Partek Flow was used to visualize the average base quality score per position as well as the mapping quality per alignment. The mapped reads were quantified using the GTF file with the patented lncRNA annotation for quantification using the Partek Expectation/Maximization (E/M) algorithm (Xing, Y., Yu, T., Wu, Y. N., Roy, M., Kim, J., and Lee, C. (2006). An expectation-maximization algorithm for probabilistic reconstructions of full-length isoforms from splice graphs. Nucleic Acids Res. 34, 3150-3160). The default parameters are used. The transcripts where their medians are under the median read density in intergenic regions are discarded for the next steps of the analysis. The transcript counts were normalized by CPM (counts per million). Only transcripts showing high expression (CPM 10) in at least half the samples of one group are considered.

Statistical Analysis and Predictive Modelling

To determine differentially expressed lncRNA, a statistical analysis is performed using Wilcoxon Mann-Whitney parametric test. A lncRNA with a p value 0.05 is considered as differentially expressed. In order to build classification models for the 2 classifications, the Classification for MicroArrays (CMA) package of R (Slawski M, Daumer M, Boulesteix A L. CMA: a comprehensive Bioconductor package for supervised classification with high dimensional data. BMC Bioinformatics 2008, 9:439) with a leave-one-out cross-validation has been used. The algorithms used for this predictive modelling are (a) random forest, (b) linear discriminant analysis and (c) naïve Bayes (Breiman L. Random forests. Machine Learning, 45(1): 5-32, 2001).

The rank of the RNA candidate in a model was calculated by the mean rank of 10 candidates selections (per CV-fold). Per model (and RNA selection method) the AUC was plotted as a function of the number of RNAs in the model. The optimal number of RNAs per model was determined graphically. ROC curves and confusion matrices were generated to assess the predictive performance of our models. The values of AUC, accuracy, sensitivity, specificity, positive and negative predictive values are reported.

Additional Method for Quantification of miRNA and lncRNA

Total RNA Extraction

Total RNA was extracted using Paxgene Blood RNA kit (Qiagen, France) and Serum/Plasma mini kit (Norgen Biotek, Canada) respectively, according to manufacturer's instructions. RNA quality was examined on an Agilent 2100 Bioanalyzer with the RNA 6000 Nano Kits (Agilent, France). RNA quantity was measured on Qubit 3.0 fluorometer using RNA High sensitivity kit (Fisher Scientific, France).

cDNA Synthesis

Total RNA was used for miRNA and lncRNA cDNA synthesis as follows. For miRNA, 100 ng of RNA was reverse transcribed in a final volume of 10 µl including 1 µl of 10× poly(A) polymerase buffer, 0.1 mM of ATP, 1 µM of universal miRNA RT-primer, 0.1 mM of each deoxynucleotide (dATP, dCTP, dGTP and dTTP), 100 units of MuLV reverse transcriptase (New England Biolabs, USA) and 1 unit of poly(A) polymerase (New England Biolabs, USA) was incubated at 42° C. for 1 hour followed by enzyme inactivation at 95° C. for 5 minutes. The sequence of the RT-primer was 5'-CAGGTCCAGTTTT TTTTTTT-TTTTVN, where V is A, C and G and N is A, C, G and T. The primer was purchased from IDT (Integrated DNA Technologies, Belgium).

For lncRNAs, Reverse transcription was performed using high capacity cDNA reverse transcription kit (Fisher scientific, France) according to the manufacturer instructions.

qPCR Quantification

For lncRNA, preamplification reactions were prepared using Applied Biosystems preamplification master mix with 0.1× (100 nM) of each of the primers pairs corresponding to the lncRNAs. 16 preamplification cycles were performed as preconized by the furnisher (50° C. 2 minutes, 96° C. 10 minutes, 40 cycles at 95° C. for 15 seconds and 60° C. for 1 minute). For miRNA amplification, primers were designed using miR primer tool (PMID: 24472427). Quantitative PCR of biological samples was done in 10 µl total volume with 1 µl of cDNA or preamplification product diluted 1/20 in TE buffer (for miRNA and lncRNA respectively), 5 µl of 2× Soadvanced SYBR green PCR master mix (Biorad, USA) and 250 nM of each primer. Cycling conditions were 95° C. for 5-10 min followed by 40 cycles of 95° C. for 10-30 sec and 60° C. 30-60 sec. A melting curve analysis (60° C. to 99° C.) was performed after the thermal profile to ensure specificity in the amplification. Relative expression level was determined against a standard curve realized on a 5 log scale using CFX maestro Software (Biorad, USA).

FIMAP Quantification lncRNA and miRNAs of interest were also quantified using the FIMAP/QMAP platform developed by Quantamatrix (South Korea). Briefly, lncRNAs and miRNAs were amplified by PCR using primers with the same sequences as for qPCR that were chemically modified. Forward primers were phosphorylated in 5' and Reverse primers biotinylated in 5'. Multiplexed PCR reactions were performed on Biorad T100 thermocycler in 20 µl reactions containing 2 µl of miRNA or lncRNA cDNA, 250 nM of each primers and 10 µl of 2× One Taq Hot Start 2× master Mix (New England Biolabs, USA) with the following conditions: 30 seconds at 94° C., 25 cycles of 30s at 94° C., 1 min at 60° C. and 1 min at 68° C., followed by a final extension at 68° C. for 5 minutes. PCR products were then digested with 25U of lambda exonuclease for 30 minutes at 37° C. to eliminate the phosphorylated strand and keep only the biotinylated ones. So digested products were quantified on QMAP using coded silica microdisks coated with oligos complementary to the RNAs of interest (one code per target oligo). Briefly, biotinylated PCR products were incubated with the coated microdisks in a 96 well plate, and hybridized products revealed by addition of a fluorescent streptavidin conjugate, SAPE (Prozyme, Denmark) after washing steps. Plates were imaged on QMAP that takes 2 images per spot: one dark image to quantify the fluorescence and 1 white light image to read the microdisks codes. Each target relative expression is then calculated by QMAP software by assigning fluorescence signal to each target according to the associated microdisk code.

RESULTS

Profiling of 2083 miRNAs based on the miRbase v20 was performed on plasma samples from patients suffering of mild impairment or moderate Alzheimer disease and cognitively intact healthy subjects. After normalization of the results generated with HTG EdgeSeq technology, averages of 406 miRNAs par sample were positively identified. From these 406 miRNAs identified, statistical analysis was performed in order to identify miRNAs with predictive value of Alzheimer disease.

Figure 2:
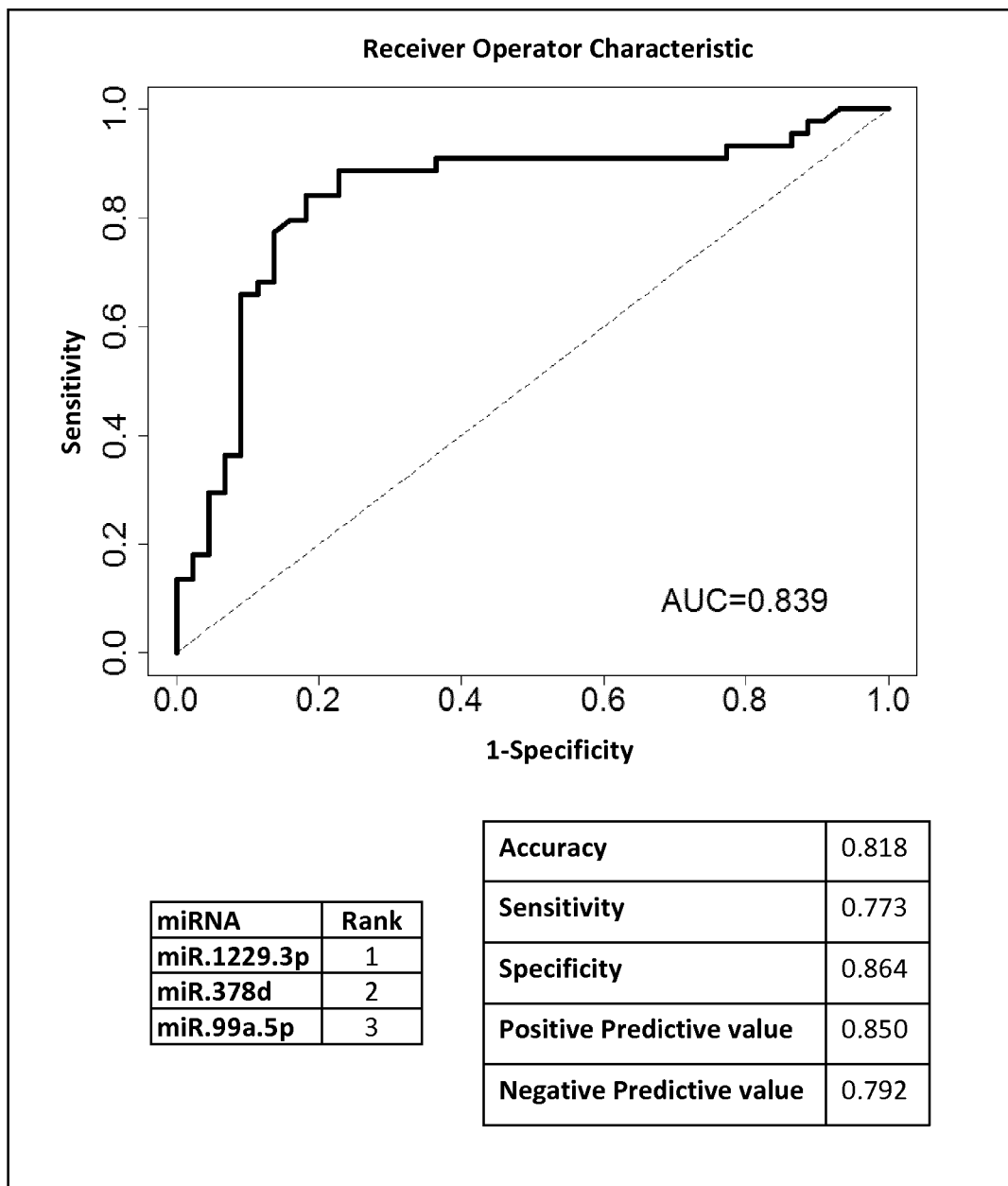
FIG. 2 shows a predictive model using random forest for the diagnosis of AD patients. Three miRNAs were used in this example of results and show a good AUC of 0.839 and an accuracy of 0.818.
Figure 3:
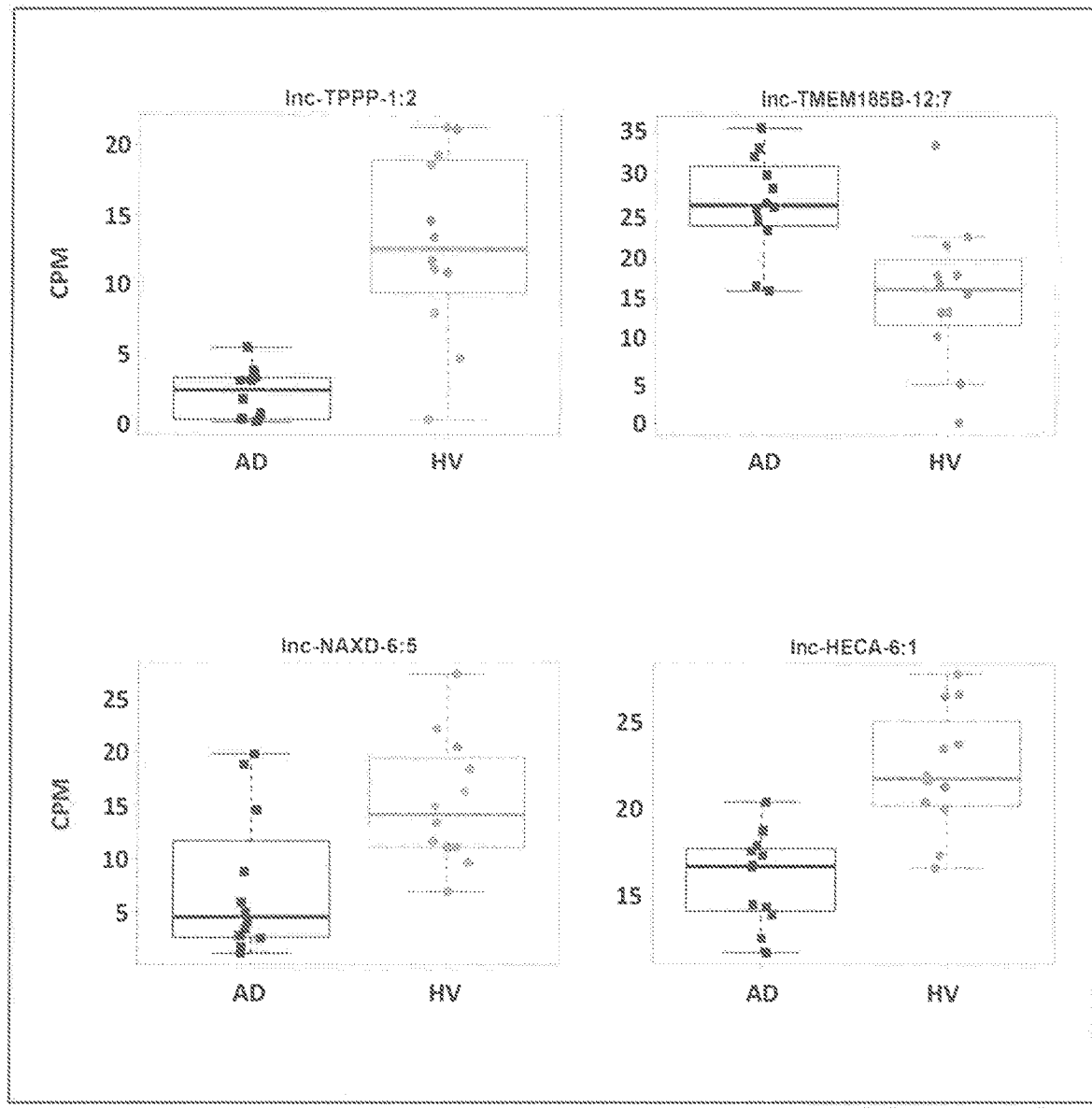
FIG. 3 shows the expression level of lncRNA candidates lnc-TPPP-1:2, lnc-TMEM185B-12:7, lnc-NAXD-6:5 and lnc-HECA-6:1 on human serum samples from patients with early to moderate Alzheimer (AD) and age-matched healthy controls. Y axis: mean+/−standard error of the mean of concentration of the lncRNAs in CPM (count per million). X axis: AD: Alzheimer patient group, HV: Healthy control group.
Figure 4:
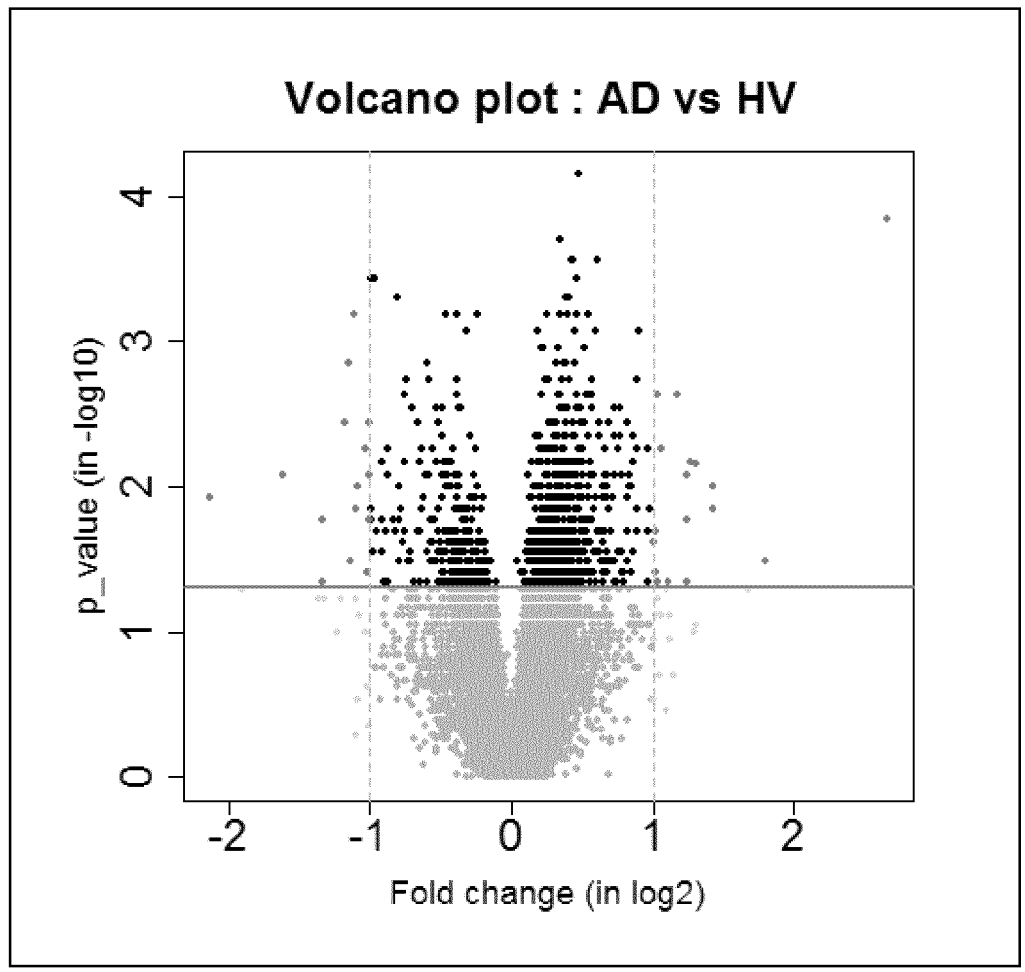
FIG. 4 shows Volcano plot of the comparison. The volcano plot shows the 1008 lncRNAs that are differentially expressed in AD group versus HV (healthy control) group with statistical significance (p<0.05) above the line. 33 lncRNAs show both p value of <0.05 and fold change of ≥2 or ≤0.5. The lncRNAs that are differentially expressed but do not reach a statistical significance are shown below the line.
Figure 5:
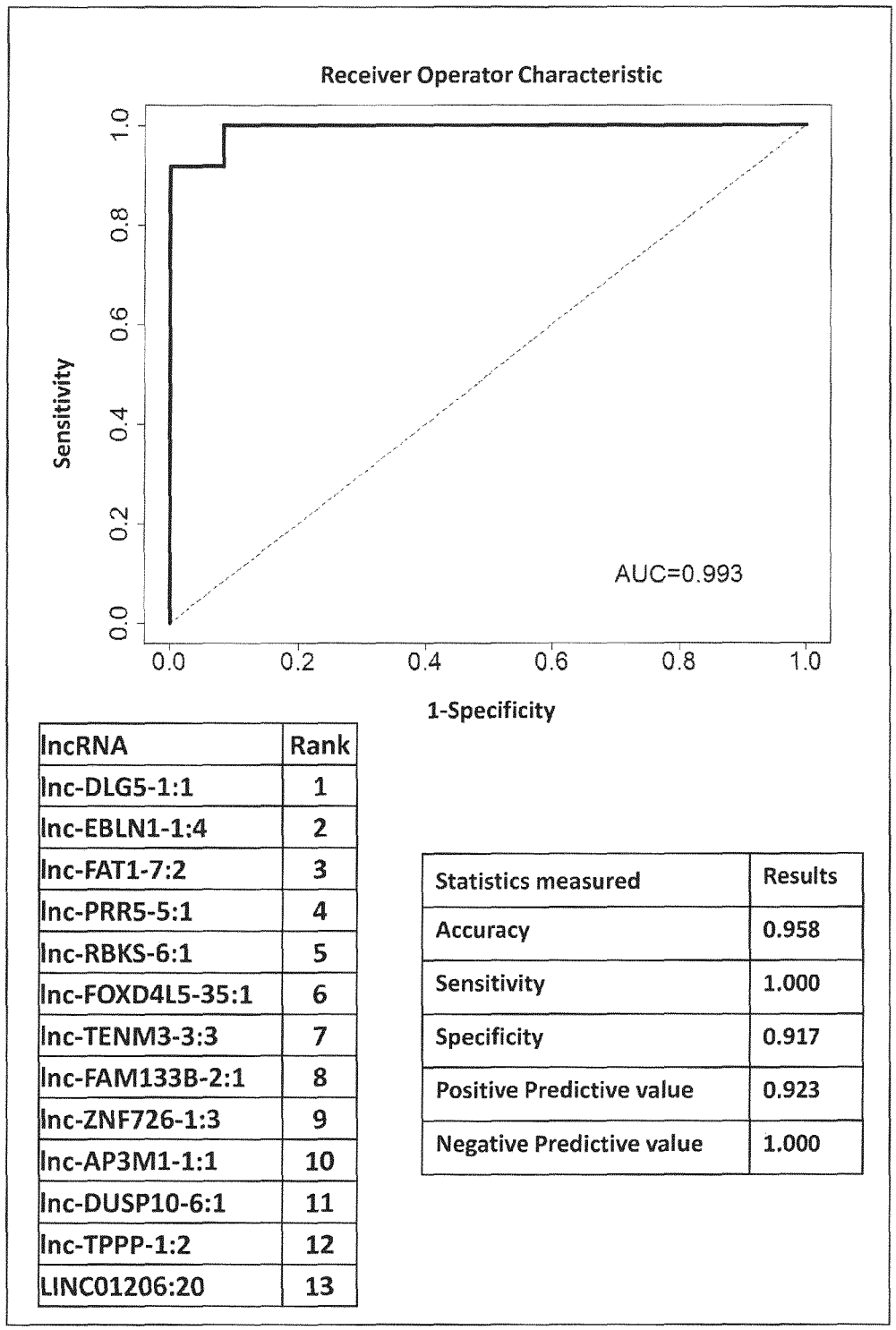
FIG. 5 shows a predictive modelling based on the random forest algorithm enabling the identification of the signature of the 13-top ranked lncRNAs candidates selected out of 19867 lncRNAs.
Figure 6:
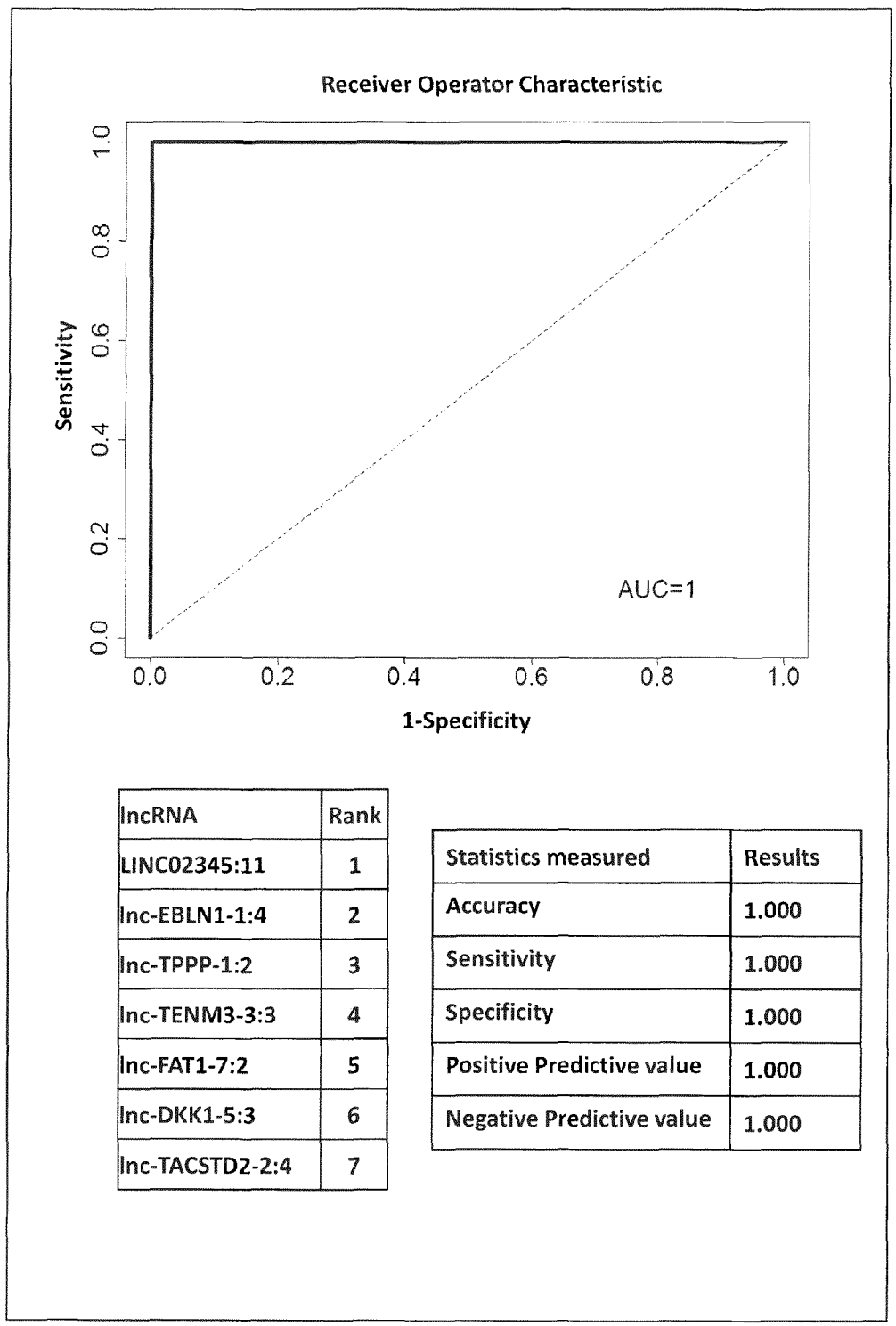
FIG. 6 shows a predictive modelling based on the random forest algorithm enabling the identification of the signature of the 7-top ranked lncRNAs candidates out of 90 lncRNAs with a p value of <0.05 and fold change of ≥2 or ≤0.5 or an AUC of ≥0.85 or ≤0.15.
Figure 7:
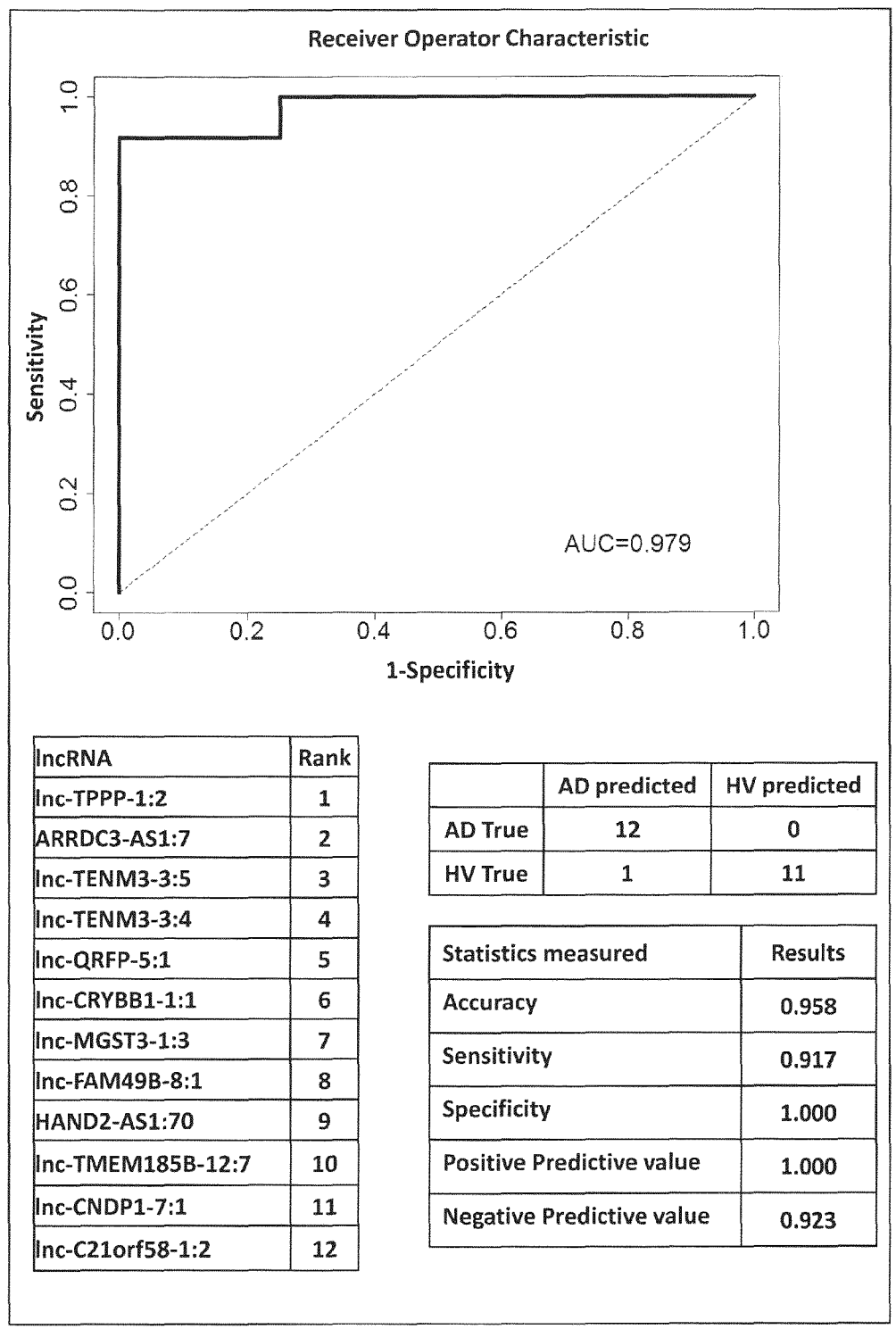
FIG. 7 shows a predictive modelling based on the random forest algorithm enabling identification of the signature of the 12 top lncRNAs candidates selected out of the 90 lncRNAs (with a p value of <0.05 and fold change of ≥1.6 or ≤0.6 and an AUC of ≥0.85 or ≤0.15.
Figure 8:
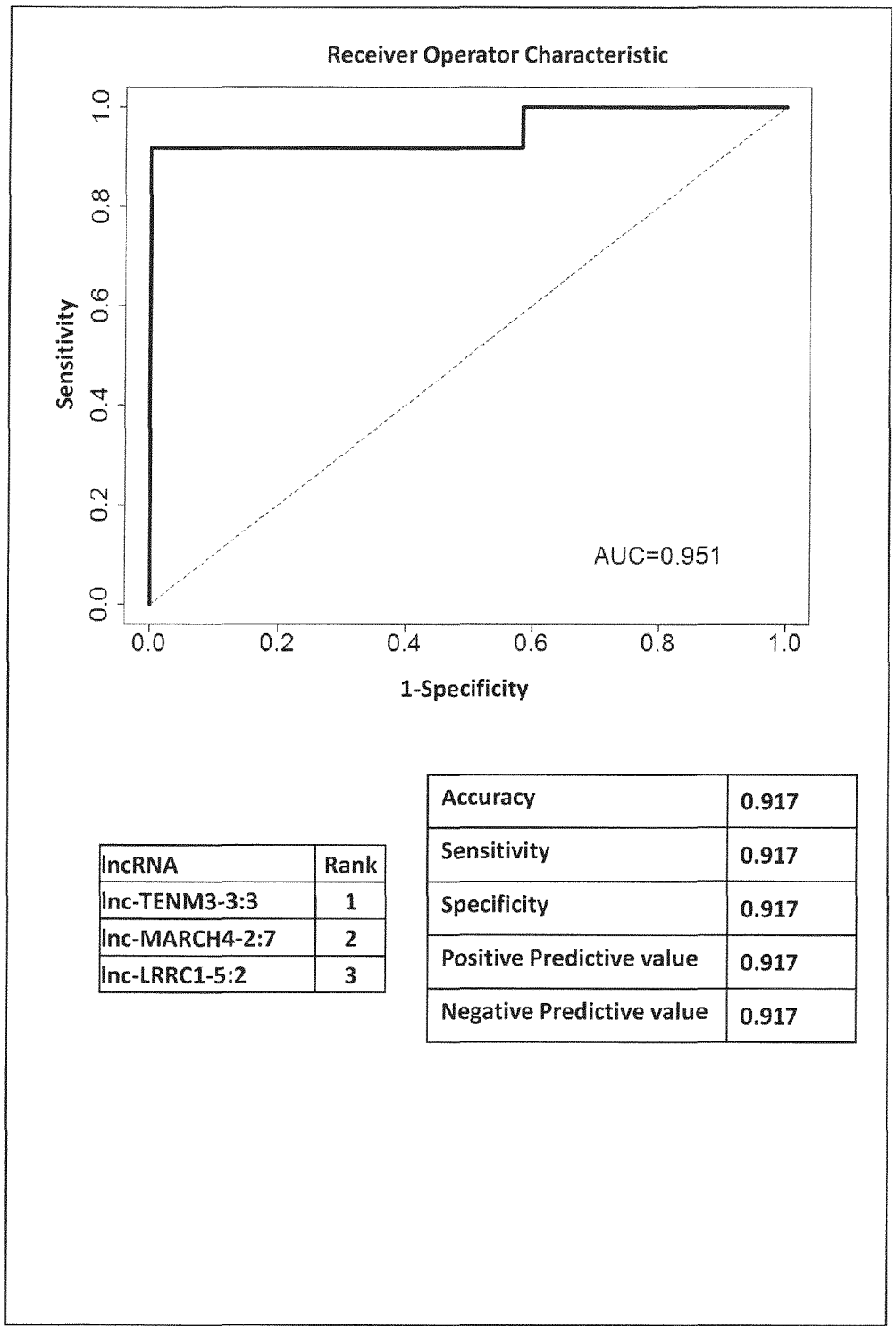
FIG. 8 shows a predictive modelling based on the random forest algorithm enabling identification of the signature of the 3 top lncRNA candidates selected out of the lncRNAs with a p value of <0.05 and a good correlation (Pearson) with scores of neurocognitive tests including MMSE and/or MoCA out of 7 neuropsychological tests performed.
Figure 9:
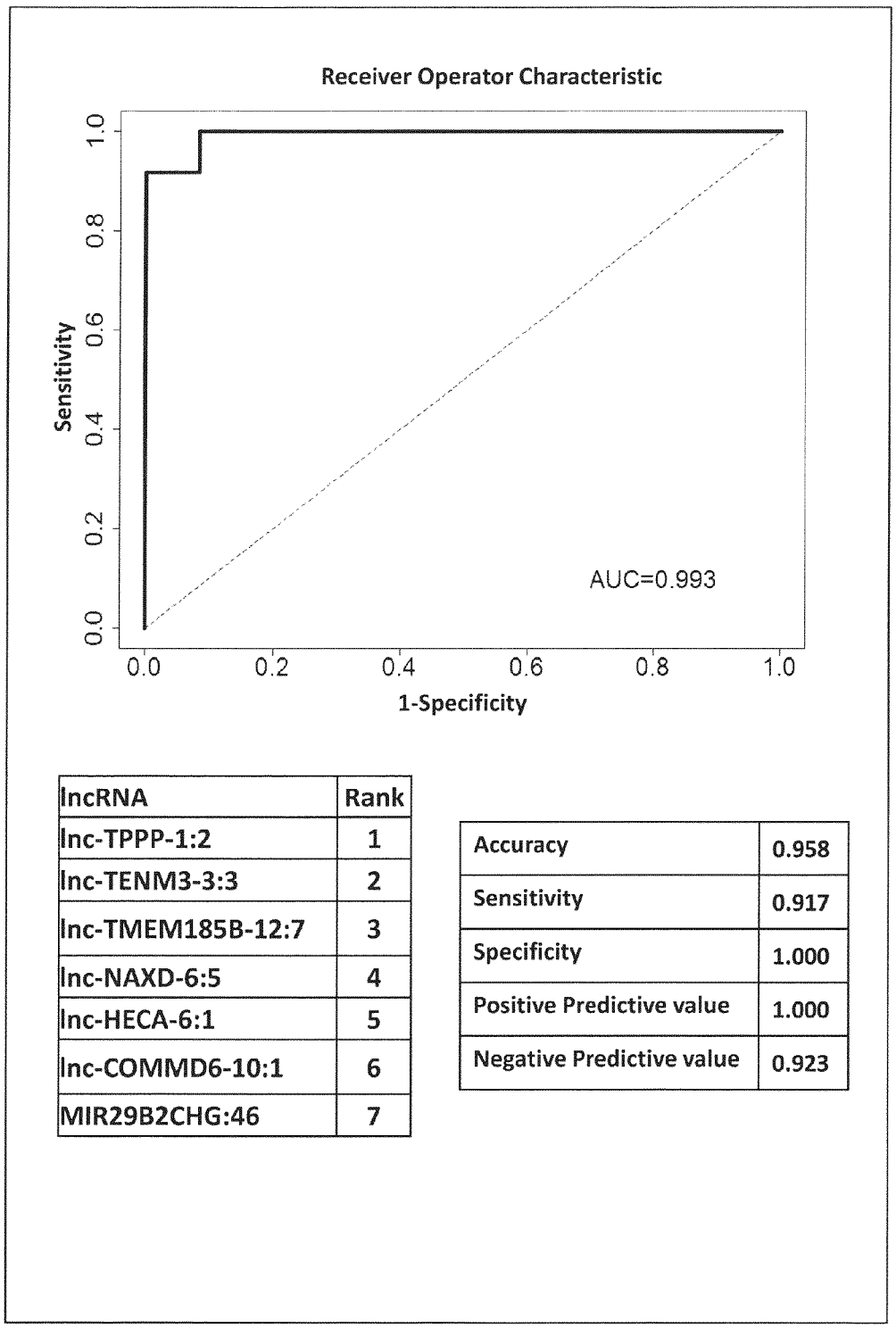
FIG. 9 shows a predictive modelling based on the random forest algorithm enabling the identification of the signature of the 7 top lncRNA candidates selected out of lncRNAs with a p value of <0.05 and a good correlation (Pearson) with neuroimaging scores (volume of brain structures of relevance for cognition and memory such as the mediotemporal area, left and right hippocampus, left and right amygdala, entorhinal cortex out of more than 120 structures measured.
Figure 10:
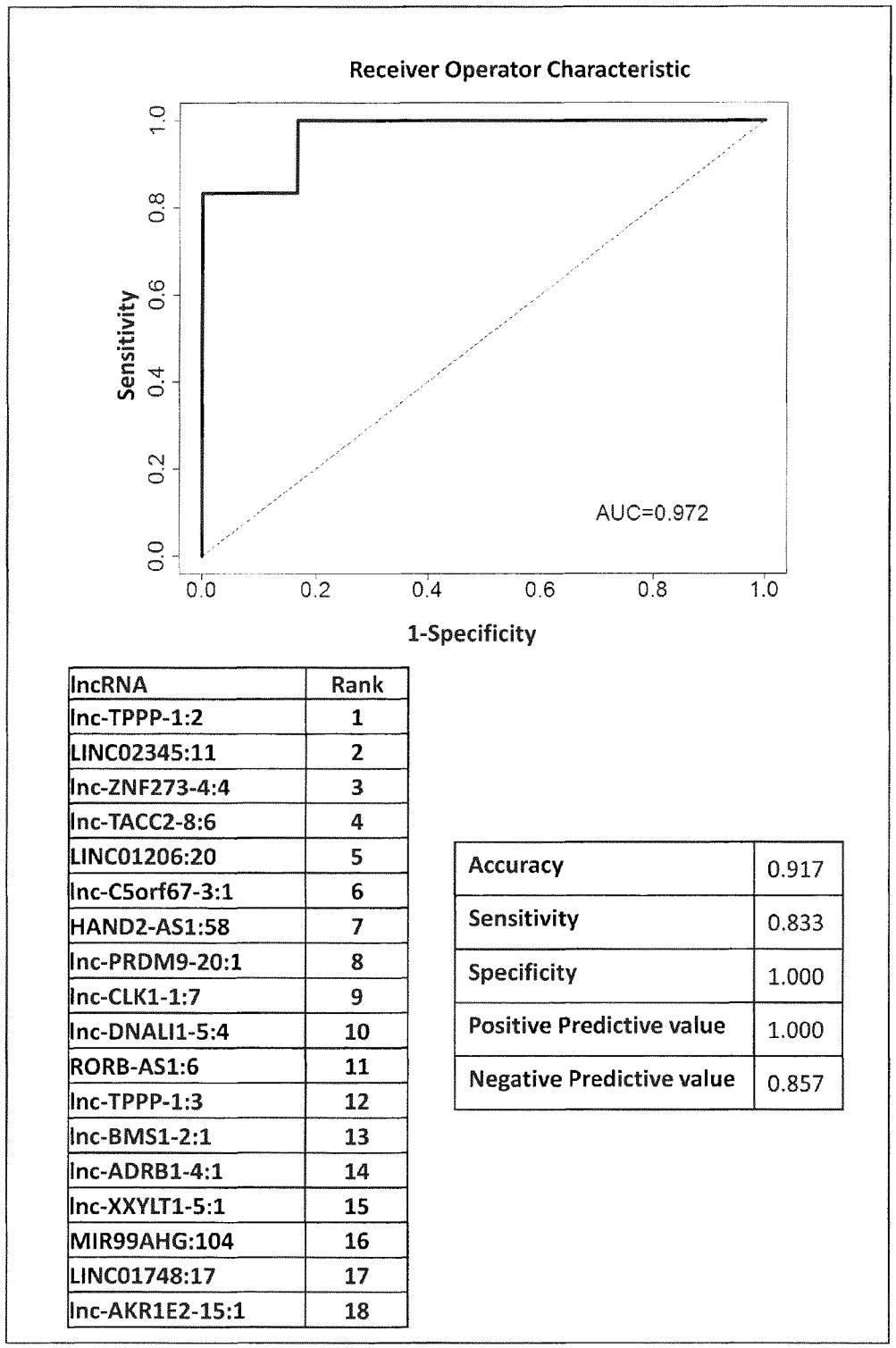
FIG. 10 shows a predictive modelling based on the random forest algorithm enabling the identification of the signature of the 18 top lncRNA candidates selected out of lncRNAs that show a p value of <0.05 and a good correlation (Pearson) with CSF biomarkers Aβ42 and tau (total tau or phosphorylated tau).

Random Forest algorithm was used for the classification model. From this, several sets of 2 to 20 miRNAs with high predictive value were identified and provide an AUC ranged from 0.839 to 0.793 with an accuracy over 0.77, specificity over 0.77 and sensitivity superior to 0.74. FIG. 2 shows a predictive model combining 3 miRNAs with an AUC of 0.839. A list of miRNAs useful for diagnosis of Alzheimer disease was generated. This list was determined using multiple statistical analyses: individual AUC, fold change and t-test for p value (Tables 2, 3 and 4). 74 miRNAs were selected from plasma lithium heparin samples, from the data set with a p value under 0.05. They were further analyzed based on fold change ≥1.49 or <0.75 and individual AUC >0.6 or <0.4. See Tables 2, 3 and 4.

Profiling 127,802 transcripts based on LNCipedia v5.2 was performed on serum samples from patients suffering of Alzheimer disease and cognitively intact healthy subjects using total-RNAseq technology. Above 127,802 transcripts, 19867 lncRNAs were identified with expression level of over 10 CPM in at least half the samples of one group.

Out of 19867 lncRNAs, 1008 lncRNAs useful for diagnosis of Alzheimer disease was selected based on the statistical significance (p value <0.05, Wilcoxon test). Random Forest algorithm was used for the classification model. From this, several sets of 2-20 lncRNAs with high predictive value were identified. The sets of selected 2-20 lncRNAs provide an AUC ranged from 0.7 and up to 1 with an accuracy, sensitivity and specificity ranged from 0.7 to 1.

Figure 11:
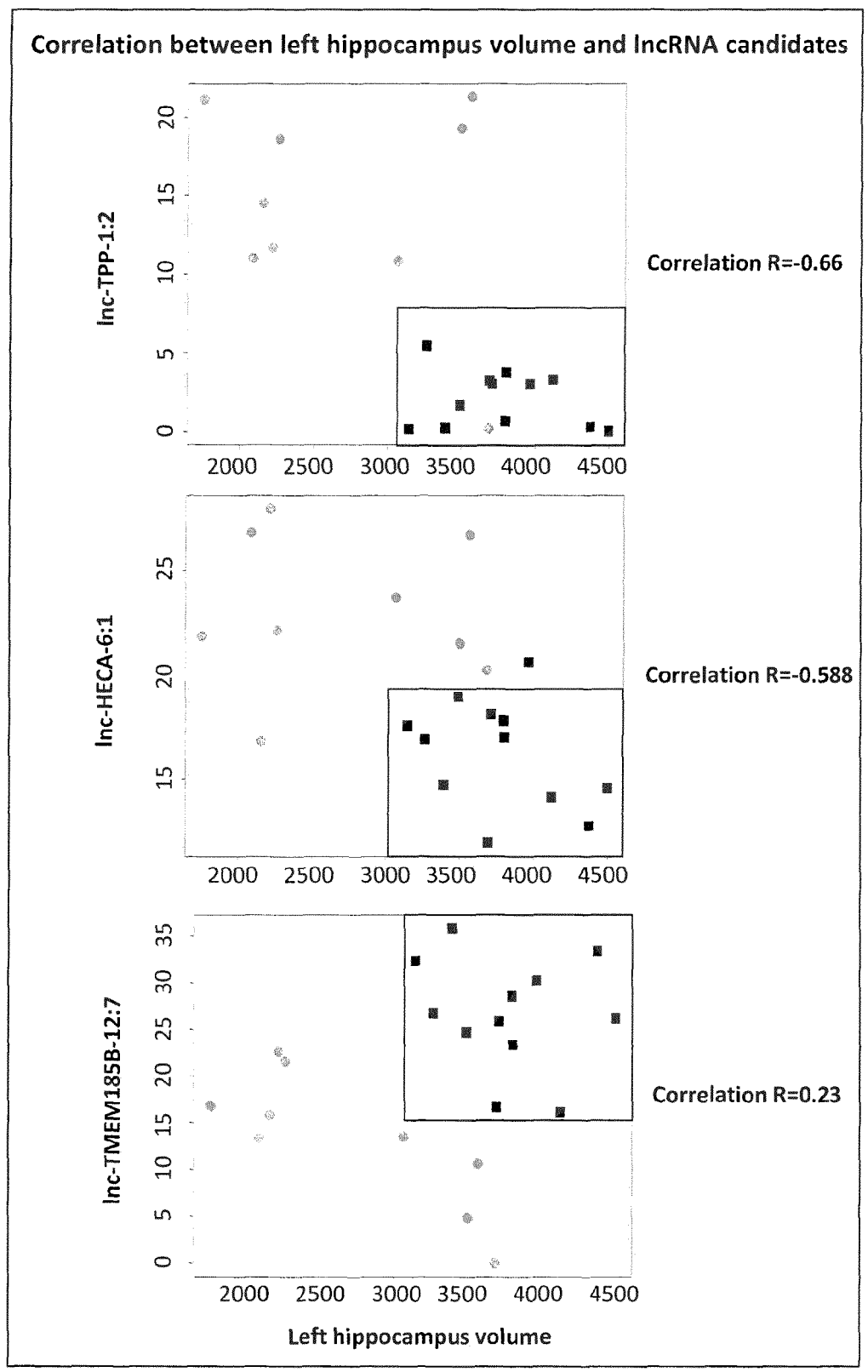
FIG. 11 shows examples of results on correlation between the level of lncRNAs and the volumetric neuroimaging score of brain structures implicated in cognition such as the mediotemporal area and the hippocampus.
Figure 12:
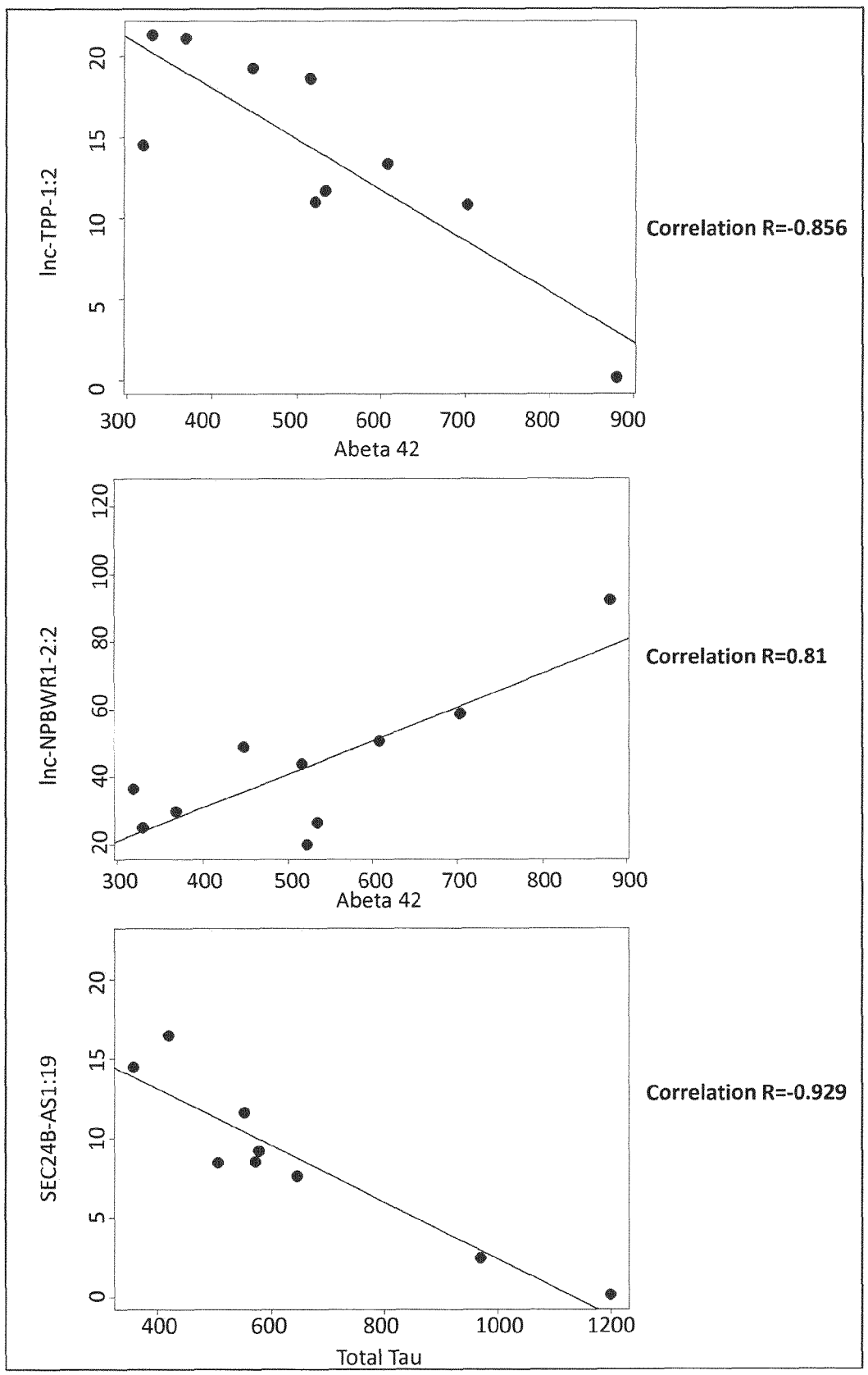
FIG. 12 shows examples of results on correlation between lncRNAs and CSF biomarkers Aβ42 or Tau.

FIGS. 3 to 12 show examples of results on a) the level of expression of individual lncRNA (FIG. 3), b) the statistical significance (p value) to differentiate the 2 populations, schematized as a Volcano plot (FIG. 4), c) predictive modelling using the Random Forest algorithm enabling identification of several sets of lncRNA signatures for diagnosis of Alzheimer (FIGS. 5-10) and d) correlation of the lncRNA level with neuroimaging or CSF biomarkers (FIGS. 11, 12).

SEQUENCE LISTING (1414 sequences)

SEQ ID NO: 1 - DNA, 30872 bp, Homo sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaagtaatatgcatgcaaagtaaagtaaaatttcctgagcaaaggacatcagaatcagtttcatgaagatgaacctgtggccagaaaatgaagacctttcctgaattcagagaaccaactttgcacccacaagagagaaaaaggcaaataaataatattatattttggaagagtcttacaaaatgattcataattaatttgcagtatactattctaaaattcttttgtaagagattaaagaaatatgtacacattagaaaactataattagtactcctaatggaaatcaattttcatttacaaaatagctttaaaaatttacaaatacaatgttaattcactcctgcttgcccaacaaggggagttcttgatggagtgaaaaagagcctaaatcttgagcacttactgggtacagggcactgtcatgtgtgtttcacgtgtattgccgaatgtgatacttacaaaaaccatatcaggtgggtgtggtaattatcatgatgcccattttgcaaatgaagaagctgagccactgaaatgttcaacaaatgtgcctccaggatacacaggttgattttccgtttcaggatttggactcatatactggccccaatgtctgctatgttctcttttggtaaacatgcaggaaatggaatgaaatatgttgtctttagtataacagaatctttaatttgtagctctatttgaactttcttagctgaagtgtcctcaacaaagtcatatatgtagtcactaatcactatgaaaatgacaatataagaagtaaaattatatgtataccattcaaagagatctgaaaattgaattaactgagcatttttgtagcatgaatctttgattagaaaatattggagcccatttgcaacattttaggttgctacatataatgttttatatgaaataatataatcaacttatttatagaagtgtagatgattttagttcttttcctatcattattcagacagagtttgatagcttagcagactcgtgttgtatgtgtatatgttagggaggacaggtttgcaattgaagctgattgtttgcccaaacaccatctggcctacccatttataatatgtcaaatgagactgcccaaggtatgagaaaaatcttaatttcacatttattcaggtcatattggccacagctcaaactgcactattatattgtttgcattttcatcaccacccggttttttttttaatttttttctgaattctcttgaatgctttactgattttcactaccttccttttaattatttcagaaacctactattaaagattttcactcactgttgatcataacgttaatcatcttgttacaatatagactattataagctttagtaaaataacttaaatattttaaaacccaaatatctttggatggactttgtgtatattaaattcttgtctattatagcaaagtttcaatatgcataaacatatacatataagtaaatattttataatgtatcactggctcttgtaaagatagttattcatgctcaatatcaacattttgaaaaatgtagctattaataaatatttatgcacaaacttagatttttaactgaaagttaatggctaggatttttaagtaactgtccaaataattaaatagaaggaataaaataaacatttcactttgcattagacacttctgctagaacatgttttataagaattaaatgttgaggaattttaaaaactacattagattttaaatcaccttaatagtcctacactgatttctactgttttagttggaagaatgatcagaaatagtatccaggggaaatgtattttgtaaaaatactgtagtttaataatatgataagaaggcaacttctgagtatatcctctgattaattcaatgccaaaatatatggggaagatagttttcaatgtaaatactgattcctgtttagaaaataaaaacagcatattattaatttagattaacataattaatataacacttatttcccaaaatgttatatttctttgggtagccccttaattattagtcaaacaagaaacctccaacagaagtatttcagaaaatatcatggcatttaaaaatatgaatgttcataatttccttaatagtttacatttttaacccctttaaaatgctaatttcatgatctttattgctgatttatgaaaatatcactattcattagtaaaatatgtatttttaaattaaaatttgaatctgaaagagcaaggaagacttaattggaagatgcatagaatttgtgaggtcttttcagaatatcttactgtatgtatgttacagaacataagcactgagtcaaagctcagcggaggaagttcacgttaatagtgtgctctaggccgggcgcagtggctcacacctgtaatcccagcactttgggaggctgaggcaggaggacaacctgaggtgaagagttcgagaccaggctggccaacatggtgaaaccctgtctctactaaaaatacaaaaaaattagccgggcacggtggtgggtgcctgtaatcccagctgctagggaggctgaggcacgagaattgcttgaacctgggaggcagaggttgcagtgagccgagatcacgccagtacactccagcctggacaacagagtgagactgtgtctcaaaaaaaaacaaaaacaaaagcaaaacaaaaaacaacaacagtgtgttctccaggctgagggccttcagtgctgcagcttattactttaatggtgagtagaaagtaaggtatggggtcaggcacggtggcttactcctgtaatcccagaactttgggaggctgaggcgggtggatcacctgagatcaggagttcgagaccagcctgaccaacgtggtgaaaccctgtctctactaaaaacacaaaaccaaacacctcatgttctcactcataagtgggagatgaacaatgacaacacatggacacagggaggggaacatcacacaccaaggcctgttgaggggtgggaggctaggggagggatagcattaggagaaatacctaatgtagatgatgggttgatgagtgcagcaaatcacaatggcaagtgtatatgtatgtaacaaacctgcacattctgcacatgtattctgaaacttaaagtataataataataaatgaataaaaaataaatatacgaagcaaaagaaaaaaatacaaaaattagctgggcatggtggtgcatacctgtagtcccaggtattgggagggtgaggcaggagaatctcttgaacccagaaggcagaggttgcagtgagccaagatcacgccactgcactccagcctgggcaacaagagcaaaactccatctcaaaaaaaaaaaaaaaagaaaaaagaaaaagaaaaagaaaaaaagacagccaggtatgggaggaaggcaaattatttacatttgtggtgcataaaatataccagaacaggaccataccctggattcatctcctgtatgaagtgttaaaactacataattcataaagtagtctaaactgtgtatttatatgacaagtattgcatatttcagacaacctaagcaacatcagtttaacacatagtatttctcagttaatcattttgagtatatggaaactgctgattatattactactatatatacaaaaactatgcatgctttgaagtcctaaaatgaagcaatcaatttttttctaaattaattcaagaagagtagtgaaatgaagtgcataatttatttcagtccttaaaagaaaatcatttaattgctcattttgtttttaagcacttttccccataactgcatagaaatgattcttcaaggcttgttagataagtagtcctatcctattttaagggaactctaataacgtggtaaaggtaagtgatagctgatttttctaaatcttcacatatatgtaaaatcctaaatattagatgttgaaactttttaaattgcatcatgaagatgtttatgaggattttacagagttatttatcgagtttccgaattacataatcagatatcctatttttgttacactagaattaatttcattgtcatgtctcaagtcatcaatttacatacagataactattagatacttatgaaagatctattgacttaaatatcaaaaaaagaaaagaaagaaaaaagaaaaccttatcttttacttcttccataaatttcagtcattagttttgaatgaggttttgatatacaaacctgtgctcttatgaaactgagcaaaatataatttttagtatggtgcactatgcataaatgaacttattacagcaaaaatgcagttaattatttaattacctatgtagtcattttcattttgctagatttaactttgaggcgtatttgtcatgttcaagtacttatttgatttttaaattatatatcttttgtagtaatcatgtattattctttacctgtgcaactaactgttcttttgaaaagcagcaaaaatataaactgcttataataataatgaacctgatgtggttaaaaatgaagctttcatgaatgctaatcaaaaataaaaagaatgaatccacaatgaaaacctaattctcttttgttgattttgaagatgtgttttgaacaaattgctttttcaatggaattcaagtttcctttttttcttcaacctatgtttatgacagttcggtctgctatcactgacatgattgtgaggtttgaaatagtgttaaaatttcactgcaggatcaatttttacagggattgcatgctatgaggtggacattttcttaaatatgcttaatgttggtgttctttgagcagtagaataaaaattactaaaatttatagaataattggacataattatatttgtagcttttgtttattgatttaaaagcctttttcttaaaatctgcttatagaatataccactctcacttgacttgcttatagagaatatttttaaatggaaatttttaaaatttaatctggaatttcagcttactttcttccttcacacaataaggctagagtttagtgacagtataatagtaaaaaaatcagaggaaaattaatgtgtagcaattgagaaaatattgcagtatggtatatgataactagtttctcatgtttggagtacctataatttatatgtaataagtttttacataattttatgtatttattggtagtgcaagttttgggaaaactgatagattgaaaattccttgctaaatcgccctcagctgctttcactaactgcttgagttgctctttagtggttcatatcacaacagcagaaactcttgagtaggacccttccatagagccaggcaaggtcatttgtaagtgtaagtgctggaggtatctatgggtaatggatgcttaaagtgtgtacgaatgaacttaatgtgattacactaataatggaaaaaagcatattggtaaactattatttcagaaaatcaatttgtacttccatagtttaaaatcttttcattattcttactacattcaccattttcaatactactaaacttgtatttttctctaggaattttatctcaatttactcttgctgacattttaaaactcattaattttgagatcaatcacattttactcttcaaacctatgtattttacatacttttaatttatatatgctattttatattaaaattttaatgcaatttatgtaatataaaaagtagatttatacaatttaaatgtatatcacatttccttatccttataaaattataaatgacatcttacacactaggttaaaaattttgtgaagaaccaaagaaagtataccggttagaaacatttgggaaaatattttgcatattttttaggctaaaacggaatcatttaattatagatatttaaaagtgcaataaaatattagcttccatatttatataaattccagaaaaaatagttcctggaataaagatttaattaaagtattttacaaattttgaactttgtcatttagaatctccttaagaaaataatttgtctaaaaataatgagatcatttcatatacttgcttatttcacatacaagtaacatatttcctaataaccatgtttaaaaaaatagttggccatgtgtaattccagcactttcagaggcaaggtgggcagatggcttgagctcagtagttaaagaccaccctgggcaacatagtgagaccctgtctcaaaaaagaaaaaaaaaattagccgtgcatagtggtacagtcctggaattccagctacttgggaggctgaggtgagaggattcaacctaggaggtggaggagaaggtgcaggttgcagtcagccagtcagccagtcagccagtcagccagtcagccgtaatcgcaccactgcactccagcctgggtcacagagcaagaccttgtctcgaaaaaaaaaaaataataataattgatgattaccaatgtatatctgctgtaaaatgaaaaggaaacatactactgccctctactaacaatggaggatccatgctttgcttacagtaacatgttaacaccaagagtgagggagagtattatactgaaaattgctgagtaaggaagtagaggtcatagaaacatttgacattaattgttacatgttatgacagagataaagaaaggtatatttataaaaagactaccatttttataaagatgcttgcattatacatttattcatcatatctaaattgagtactcacatagtatccagcttgtttttctccctgaaaatgtatttttagttatgatcatgttgccattgtttcaaatcttgcatgactcttctttcctagcaagttaaatgcacagtccttactctgccatacccaaccttccgcacggtatgactccagcctccgttctctgccagttcactctctcgctctcagtcacatctctcgtaactcttgcaaacctgattgcttactgttctccaaacatgtataagcagggttggcttcattgagtcaggcggtcttgtgtctttattagatatgcaacattgggaaaactactcaacttctctgaatcacatttattcattgataaaatgttggaagtattgaatatgtctagtgcattctctgaccatgagattatactccatctccatcccatgtcttagtccttttctttaacagacaaattactatgaagttatcattaactagattgaattatcatgttaaaattctactcataggaagaatactattttaaaaaataagttgtgtgaaaatatatagattcactgaaagaaagaaattcttcacctgcttctattttctaaaatggggcaagtgatatacatggagattaaaaaagattataaggaagcatctgtccctgtacatttttctacagttttttttgtatcttatgtaggtttgtgaatttcacttaaaattgcttaaattttaaaaatgcaaaaatattgtatgaattttgtgttattccttctaaaatatttttatcttttttatcagatgtttttccttttgaaagcttcttctaatgtaggttttcaaataatatctgaatataattataaattgtattatttgatattatttaaaattatgatatcgtatgattaagatatttaagtgatactaagattatatttggagtacctataatttatatgtaataatttgttaaataaacttatagaatatagaatataagtttatatatatgatgcttctaaagaatatagaatatattggatatagaatatagaggcatctaaagcaagttgtatggattaatatgtatgaatgaaaccccaatatgctctgtgcagtagttcagtctctcctgcgtctcctgccttcccgcccctgactcctcatctctgcctctcattgttcttgttgtccagcagcagtactgaaaactacaatgtaagataaaaaaagatgggagaagaagaaaaagagcaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 2 - DNA, 2661 bp, Homo sapiens
ttacaagtgagtggataaatggtgagaatttatcacccctttgaatatcaggaagaagacaacgatgcccactctgttaccacctctaatcagcactgcactaggggttccgaccagtgtagaaaagcaaaaaacaaaacaaaaataaaaacataaagtaaaaatccagaacaacaggaatgggaaagaaaacccattactcatagaaaacatgactgtgtgcctaaaaatgaggaaacagctacaggcaaatgattaaaattactagactgccggatacaaattaatacacaaaaatgaatttccatgaaatggcaacacataattaggaaaatgaaatccaagcacatttttaaaaacagcatcgcaaaataacaaggacctaggattaaatgtaacaaaagacatacaagaccactgtgaaaagtatcaggctgtatgaacacccgctgaaggagccctaacatttggagagacagataccatgttcagagcttgtaaaacccagtactgcaagtacgtcaatgattcccaagttgatctacaggttcaacacaatcccaaacaaaatcccaactcgaccggctagttctaaaatgtatgaaacacaaagggtcaaaaacagccaagacatcctaacataagatggaggtacgcgccccagagtgtgtggtattggcagagacagacaaggagatgcagaaacggacacagagatcatcctgacaaaggaatcttcagcagccgggactgggaaaactgggcttatgtctgcaacacaatgaaactggatccttaagcttcacaacaggcgcaaaaatcaattctgggtagaatctatatctaaaatccaaaatatacaaaactataaaatcctttggaaggtaacagagtatctttatgatcaaggcaaagtaaagattattaaaaattaggatccaaaatgctttaatcataaaagaaaatattgatacattgggccatattaaagtttaaaatttctcttaaaagacaccattgaagtaaaaagacaagaaaagctatttgcaaatgtaattcacaaagcactactacccagaatcataaataacacctgcaaataaatgagacagaccatccaatagaaaagtagggaaaatacttgaataggtactttacaaacaggaaatcccaatgagccgcagacacatgagaaggtgctgaacaaggagaagccaatgaaaccagaaagaggtctaccccacacgttccaccaccccgcgccctccgccaccccgcgccctccaccaccccactccctccactaccccacacccaccggagtgaaggtgctaacacttcaggcaatgggtgctgaaaacatggaccggcagacgtggtcatacacaactagcagtcgggcctgcgggtaccaccactttggaacagttgggaatttctagtaaacctgttaaaaacatggttaagcagttaatggaaacgtgaacataatgggatataaaactaatgaaaaaaatcaaatggagtttttttgttttttttttgagacggagtcttgctctgtcgtctaggctggagtgcagtgctgcaatcttggctcactgcaacctccgcctcccaggttcaaacgattctcctgcctcagccccccaagaagctgggactacaggtgcccaccaccatgcccagctaattttcatttttagcagagatggagtttcgccatgttggccaggctggtctcaaactcctggcctcaagtgatcctcctgcctcagcctcccaaagtgctgggattacggtgtgagccaccccgcctagcctcaaatggaattttagaacaaaaatatacctaatttctgatataaaaaattcactatacaagcttaacatcaaattaggcaagtggaagaaaagattagtaagcctcgcaacaggacaataaaaccacctaaaggaaaggatgagagaacaaggatgaaaaagcatcacgtttagtgacctgagagacagtatcacagtctaacagaaagctaactagagtcccagatggggacagggaggaagaagtgagagacggggtcagacaagaaatatgagtagtggctgcaactttgccaaatctggtgaaaaatatgaactcacaggtccaagaagctcaatgaaacccaaacgaggtaagcatctataagcttaaagtggattaatattaacatcttctaatactcttacatacataaattacgtgatgacaaattaaccccatcccaaccctacagaaaataaatttggtatgacacattttcctgttaggaccacaactggacagagaggtgacacaagagggcagcctgaagcctagcaagtcctcttcggggaagagacagcagagtcccacctctgatttccccagggatacaatccacacgcacacacacacacacacagaagcacacacacacacagctagcagacacacacagctagcacacaagcacacacacagcaagcatgcacacacagctagcacacacacagcaagcgcacacacagctagcacacacactaggcgcacacacagcacacacacacagctagcacacacacacagcaagcgcacactagcgcacacacagcacacacacacagcaagggcacaca

SEQ ID NO: 3 - DNA, 3258 bp, Homo sapiens
gagattcagacacacagaaagattgttatgtggtggcagaggcagatattgtagtgatgcatttccatgccgggaaatgctaaggatggctgttaataaccagaagctgggagacaggcatggagcagattcccactctggatgcccaagaaggaatcaaccctgctatcctcctgactttagacttctagactcctgaactgtgaaagaacatctttgtattgccttaaatcacccagtttgtggtagtttgttatggtaacaataggaaataatatagtaactaatatagatgcttagtaaccattttcccatcccaaaattgactaaggaagctaataagaaggggtagaaaagtggatttcgaaatagcctttaatgttcaataggtgttccacttcagcacaaatggaaatttccttcctggttcttgtgactgctctagtatttatttacaaattgatatgagaacttttgcttttgatggatggaaggatccaatcaaggcaaagatatgcagggagaaaggagaggtggacaatagaagggaatgacatggaaattctcctcatctcctggtctgctggattgtcctttaaaagcagaactcaagttattgtttaataagcaatttcatgaaacactcgtgctttaaggaccagtaaagcaaaaatcaaggtggaggaaaatttcttctttcacaatttgctctgtagatcttgtcctatagttgttgtgaggacaatagtgaattaatgtaagccaggcatggtggttcatgcctgtaatcccagaactttgggaggctgaggcaggcagcacttgaggtcaagagttcaagaccttcctggccaacatggtgaaaccctgtctctactaaaaattcaaaaattagctgggcattttggcgggcacctgtaatcccagctacttaggagtctgagggaggagaatcacttgatcccaggaggtagaggttgaagtgggccgagatcacgccactgcattccagcctgggccatagaaggagactctgtctcaaaaaaaaaaaaaagtgaattaatatatgttaagtgcttagaacacgtctgacatatagtaagtatagtgttttctataattataaaaagggaagaacataaacagatctatttctaagcacaaaagacttccttggggacaccccaaaacaactgggagaattgctgctcatatatctgtaactacagacaagcctaaggaatttgtcttactaattcatattcattaatttaatgaatatgtgttgaataccttctaaatggataaactcaatgaagggagaaatcatttaggcactgctaccccggtgacagagcagacagtaagtggtgactgactgagtgttccttgtacagcactgagtgccaagaatactcgggggaacaagacatcattgtctcacaatcagcagagccaagaggtgcaggttagaatgatgaacttgatctacatggaatgttcttaacaaagttttaattttttcccaatgtcgccaaaataaatagttttgactaattacctggaaaactaactggtgtggaatagtttatttcttccaaactttcagataaattatatgagaatgaaattaggaggaagaacagaaaaatcagtcatttcaagcaactgcatggaaaagaatgtatttcctttgaaaactctgggaatgtaaattcttaaccatttatggggattttagtaaatgcaggcaaggcatttcattcttacagctttctttgaagacagaaatacataatagcctactccgtaacaacatttcagtagtctttgagatttattttttctataacttgtagaagaaataggatcatttccgaagcagtatgactaggaatattactttgaaaaagtccaataaccatttctgatctttttcaaacagaaaaagtagaaaacgtcacctagtgtactatcctttaggcttttggttgaactcaagctattctggaaaagtcttgcttatcccccaaccttgtaaatatttagtgtttccagtttcccataatgtaaatgcagcattacaaacagcatgacaactgtgtatacaacaaattttgacaggactgctgaagatagaagtacaattctttgaagacaaatgaagtcccttatagagttttaatgataaatagaagggtacttagtcttccaactcccatgtcaatcagtgataaattttcctccaagcttaccataaaacggccaggttctgaggtctgggaagggcgtactcagtgccaaaccttatcttaaagaagggaagtccaatgtcatagtgcagagtgtgattcaaactgatttctctgtctgtttcataatggagatataatcttaggcctggtgcagtggctcacccctgtaatctcagtacttcgggaggccaaagtgggcagatcgcttgagctcaggagttcaagaccagcctaggcaacatgacgaaaccctgtctctactaaaaatacaaaaataagctggtgatggtggcaggtgcctgtagtctcagctatttgggaggttgtggcaggagcattgcttgagactgggaggcagagggtgcagtgaaccaagactgcgttactgcatttcagcctgggcaacacagccacaccctgtctcaataataataataattataataataataatagatatataatcttgttaagaatatatgttactatactgaagcaatgcagtgcaatgtacctcaacattgctcagaattcagagggtcatcatatagttccaaatgaaaaaccttaattgcaacagagagaaaaaagatgttaagcgtctagcattgttgcctaactaaagtacttggtatatattgttccttttcttctttttctcttttgtctaacttacaaaacatgaatatttatttccaagcttttttaaaaaaaactttttaattctgttttgtatctgagaagtaaagagatggtgaagtgagcacaattgtaagtaatactggataattactttggaggagattgctaggtagtgagacaagtggataatatcataagtgctagggctgagtatgaagttccgtgggaacacaaaggaggaaatagctatgaatcttaagaatagattgttatttaaactaaattctttcatggaaaaaaatagccttttaacacattatctcttacagaaaaccaattaataaaaacaaaacaaaatgaa

SEQ ID NO: 4 - DNA, 3846 bp, Homo sapiens
tgtagacatatatagatgtatacatatatagatagataggtctatatagaaaaccatctatctatatctagatagagatatgtattgatagatatctctccctgtctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaatgcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacacaagatggttcatcccaagagtcatcttaatttaaaaatcttcacatcttaagaagctacacgggaggctgcggcaggagaatggcttgaacccagcaggcaggggttgcagtgaagcgagatggcaacattgtactccagcccgggcgacagtgtgagtctctgtctcaaaaaaaaaaaaaaaaaaaaaagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatatatgattcaatattccaataaaagtgctttttaaatttatattgagcattttatccttctttcttaaaaatcttaagctacacacattacatagctaggcactgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctgcatttacagagaatgatatcatggtgtctatttttaagacaagaataaaaattatgtttttttctaataatagaaatggataagcagaattctggcttctaataatgagaacatactatcccctagtttgaaataagttagataatttaactttctcatgttatcttgaagttaatacatcatttgtattgaatgtatcagtgcactacatgaagtcttacattgggtaccatcccttttatcttccacataaagtgatttagtgttttaatacacttctttccatatcttgcagttttgcatagcaaaagaagcatgcactttgaggaaaatgcaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcaaaggatgtaaagtatctgatactaactatgtccaaatatgatttttaagcaaatgttcctaacaatacataaataataacatggaataaaataaattcatgtagctttatgataataattttacctaaattaaaaagtgttatgtgcaaatagatggtatacgacacttggcatgtaataatgcaattaagtccaattgaatatattgtttgatttatttccacaatctttgatacatgtattgtagatccaaacatcaaaaaccataagtagcctgtataatgctttttttattctctgtaaagtttttaatataaatatataaaagagcatcttaaattatttaagtcaattattttatatgtggatttggtattagaacatatatcttctttagcacaataaacttttttaagtgtcagaaattatataattatatagtgacttttgttcacaaggtagttagttgtacgtacctacaagatacttgaaaaatatttttgtcaagattggatgcatttttctcttatagactcttaaaaatgttaacaagccaacacgtgaacgtactgaagtattttttaatcatcttttctagtgttgataatgagttggctgatataaagtcattagagtggcaattcaacaaatattttctatggcataacaaatgtcattaacttgctagtctgtcacgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaaaatcacaccccagggcctgtcgggggtgggggcagggggagggatagcattaggagaaatacctaatgtaaatgatgagttaatgggtgcagcaaaccaacatggcacgtgtataccaatgtaacaaaactgcatgttgtgcacatgtatcctagaacttaaagcataataaaaaatatatatatttatttctactgaacacaatgtctatatattagatgacctagaactggtagggggttctaatccaggggattgttgataaactcagacaacttctgtatttttacattgttactcttaaagtcttgtcattgattgtctcaatattggaaaataacatgtcaatattcagtgtaataaactggaagaaaaaatgggccaatatcccattcaattaaagacatgaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaataccatattgtagagtgcaatttaaccaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaatagatatgacttcataaaaacaaaaaattctgtatttctaccctatatgcctcaaactaggaatagacatttccaaattatatctgataaagaatgtgtatccaaaatatgtaaactcaattataaggaaaattacagaccaataataaacaataaggaaaagaatatacttgaacacatactttgccagaggaaattcagagacagcaaataatcacatca

SEQ ID NO: 5 - DNA, 3376 bp, Homo sapiens
gctctggtcaagtttgctgtttcatgtgtcttgggttggcttcgctgataagcagacctaggagctgacatatgttagcagagacatatttggacccaacctatatactttttctctataaagcattcaaagaacaatgtgacgattacagttgtgtgggatttcacccttccttaactataaaaagaagacttcttgggccaggccggtggctcacgcctgtagtcccagcactttgggaagccgaggcggatggatcacgaggtcaggagatcgagaccagactggccaacatggtgaaaccccgtctctaacaaaaatagaaaaatcagctgggcatggtggtgcatgcctgtagtcccagctacttgggaagctgaggcaggagaattgcttgaacctgggaggtggaggttgcagtaaaccgagatcgtgccactgcactccagcctggtgacagagcaagagtccgtctgaaaaaaaaaaaagacttcttaataaaaaacaggcatacctcattttactgcacttcactttttttgtgcttcacagatattgcttttttttttttttttttttttttttacaaatggaaggtttgtgtggtaacccttcattcagcaagtccattggtgccatttatccaagagcatgtgctcaccttgcgtctctatgttacattttggtaattcttacaatatttaaaaattttcactatgattatatctgtgatggtggtctgtgatcagtgatctttgatgttcctattgtaattgttttagggcaccaccaactgcattcatataggacggtgcacttaattggtaaatactgtgtgtattctaactgctccaccaatcaggtgttgcctcatctttctcctgctccttggactctcaattccctcagacacaacagtgttgaaattagaccaattaatatccctacaatggcctctaagtgttgaagtgaaagaaagagtttcatgtttctcactttaaataaaaagctagatatgattaagcttagtgagtgtattagtctgttctcatgttgctaatagagacatacctgagactgggtaatttataaagaaaagaggtttaatggactcaccactccacatgattggggagacctcacagtgatggtgaaagacgaaggaagagcaaagagacatcttacatggtgtcaggcagagagagcttgtgtaggggaactcccttttataaaacgatcagatatcatgagatttattcactatcaagagaacagcagggggaagacccatccccatgattcaactgcctcccactggatcccttccatagcacgagggaattatgggagctacaattcaagatgaggtttgggtgcagacacagacagaccatatcattctgcccatggcccctcccaaatttcatgtcctcacatttcaaaatccgtcatgcctttccaacagtcccccaaagtcttaagtcatttcagcattaattcaaaagtccacagtccaaagtctcatcggagacaagctaagtcccttctgcctataagccagtaaaatcaaaagcaagttaatcacttcatacatagaatgggggtacaggcattgggtaaatacagccatttcaaatgggagaaattggctaaaatgagggggctaaagaccccatgcaagtctaaaatccagcagggcagtcaaatcttaaagctccaaaatgttctccttcaacttaatgtctctcatccaggtcacactgatgcaagaggtgggttcccatgatcttaggtcccctgtggctttgtagggtacagcctccctcctggctgctctcacagggtggcattgagtgtctgtggctgttccagacacatgatgcaagctgttggtggatccaccattctggggtctggtggatggtggccctcttctcacagctccactaggcagtgcccagtggactctgtgtggaggcttcaaccccacatttcccttccatactgccctagcagaggatctccatgagggtcctgcccctgcagcaaatttctgcttggacatccaagcaatttatatatcctctgaaatctaggcagaggttcctaaatctcaatttttgacttctgtgcacccacaggctcaacaccacatggaaactgccaaggcttggggcttgcaccctctgaagccatggcctgagctgcaccttggcccctttttgccatggctagagcgggtgggatgcagggaaccaagctcctaggcttcacacagaagggggaccctgggcctggcccatgaaaccattttttcctcctaggactctgggcctgtgaagggaggggcttccgtgaaagtctctgacatgctctggagacattttccccattgtcttgctgattaacatttgactcctcattacttatgcaaatttttgcagccagcttaaatatctcctcagaaaattggtttttcttttctattgcattatcaggctacacatttttcaaacttttatgctttgtttcccttttaaaactgaatgcttttaaaagcgcccaagtcaactcttgaactatttgctgcttagaaatttcttccacaagatacccttaataatctccctcaagttcaaagttccaaaaatctctaaggcagggtcaaaatgctgccagtctctttgctaaagcatacatagcaggagtcacctttgctccagttcccaacaaattttttgtctccatctgagaccaactcagcctggatttcattgtccatatcattattagcgttttggtcaaagccattcaacaagtctctaggaatttccaaactttcccacgttttcctgtcttcttctgagccttccaaactgttccaacctctgcttgttatccagttccaaagttgcttccacatttttaggtatctttacagcagcccgccactctactcctactaatttagtgtattaatctgttttcatgatgctgataaaaacatacttgagacttggtaatttataaagaaaaggaggtttaatggactcatagttccatgtagccagggaggcgttacaatcgtggtggaggatgaaaggcacgtcttacatggagacagggcaggggccttgtgtaggggaactcccctttataaaaccaccagatcttgtgagccttattcactatcacaagaacagcatgggaaagacccgcccccatgattcaattacttcccactggttccctctcacagtgtgtggtaattatggaaattataatttaagatgagatttgggtggggacacagataaactatatcagtgaggaaagcatgttgaaagctgagagaggtcaaaagctaggcttcttg

SEQ ID NO: 6 - DNA, 9806 bp, Homo sapiens
cttccggttactgactctgtggctgctgcctcccacaacgctgtgcttgcagaccccaggagcgctggctgtcccttcacttcctgaacatgtggatgtgtgctttgggttcttgacctcagctcttcccaaggtcttcttagagaagggtctaaatgaagtcatttttagagtatttgtttttggttacacaggtgcttccgcccatgtggcctcggagtgggaccctgcgggtcatcaatctgtacattgcctgagagcagccgtgtatgctctggaagggacaagaccaggtacctgtcgggggatgcggccgtggtaccaggcatggctgcgcaggtcctcgctgctcaggagcagctcctcctccagctccttcttcagtttctcgggggtcctgtccatgatgtgcctctccttggagaactgcaacacagagtcaaccatgagctcaccctgcccaggccacaccaggccatgccagctggaggtgaccgcctgcttcactaatccaaccagttatgctacagcctgcattcagggagatgtggccacaggactcagttctgaccaaggagctgagatgtgatggctggagactcaacaccattctggacgccaaaaagagctggccttggctggaaggttctggctaggaggagagggctaaagcatgcgaaggcacaacaatgatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgaccaaagcagtcctgacccagaaacgcagggactggctgagggcagcccaacattggtggctgagggtttagaccatcacactccagaaagtcagagtcacggaaaatctttgcccaggaaggcaacaggtatataaaaagatacttttagagagatctggctgcagtgagagcaatgggctggatggggccagggctggaggcacaggtcagagtcttttgaaatgtgctgacaacgcccagatctccatctccagcccttagggtcggtgcctggtagggatatttactggaatccgcattaaagctcagatgtcaatatggataaattgaactcatcccctctgcaaagcctgatcttcgcccttttccccagtcactggcatctcttctgtcctcattacctgaactagaaccctcagaatcggcttccattggttaagacattcctgattcttttacctatccccattcgaatccccactgtttagattactgttcttttctcctagaacttctgcaatagcctcctaacagtttccctacctcccatttctagtcccacaacctgccacctacaataccaccaaccttgtcatattgcccctaggttcagagattttagtccaagggtgctccagctaaggccgacatgacagccacagtctctttcaactcctctcccaccacacacacatatacacagaatcaacgagcttctaatatttagttttcattcatgccagggttcgggcctggtccctgggggcgcagaccccagtcctgccctgttcctccagaatcctgagctttaagcaccatttcctgttgccccagggagctgacccatggcccctgacatatactgaacttgcagacacactgggatttggctctgaatttgctaggaggcccagatcatgagagggctgtggatgcaaacaggaagcgtccctgtgggcccccagaaataactgtcagaggcatgactggcaggggagatgggcaagggtcctgccattatgaagtgggttccaagagtcagcagagttgaggcattaaagttttcaggacattatttggggctgttggctgccaaggcctgaggaaatattggttatgcttccaagggctcacagtgacctccagataaagcccaaagcctccttcataagtcaagtaatgcctttttccacctggccacaagctaacttgctaacatgttctgacgcagggtccaattgcaggaaccttccatggctccctgaacaaaacatccctcatgtcctgcctccatgcctttgtcttgtggtccagcagacagtgacacatctgtagaggtacacggcctggcaggagtccaggatgggaactggggaacagccaggggaaagtcagacaaggtaggtggggaccttgaaggccaagcagagaccatgccttatttacctttggctcccagagcctggcccagtgcctggcacacagcgagtgcccagtagacagtgactggctggaaccatgctcacttgcttgccctctgtctagcaggttccttgtcacattgggtgtggaggagaggagagagcttggaggctggtcaagaacaagtgaccttgggccatctctacacttctgagcttgtttctctatgcataaggagtggggataataactcccaccttacaggactataggacctgatgcaggtaaagcatctggcactatacctggcacatggatgctcgcttgacacaatgtggaatttgaaccctctttcaaagacggcttttagcaacaaaatggaactacttcactaaagaagtaaagaaaaaaaattacaaaatccatcagaggttttagagatatctggccctcgataatttagttctaatggaataaaaaagctagaagttggaaaactgatctctacttaggcacaggtttgtttattcgtttatttcagtgcaaagtcaacagttcctgggattttgagtagcactcaatggttctatagatgcagggtgagtaagcaggcatactgtcgcttggtggcaagcactttgtatgcatatatctcactattaacaagtatatgtattagcgccaggtggctcacatatccacaaatacacaggtgacacagcccagcatgcgagtgcaagacagttttgtgtttgcacaagactaagaggtccttgtatgtagattctgtcttcttggacacttagttgttgagaaattttttgttgaattttaaaaactgagatgattttctagtcattcatttattccatgatcaagcctggcaattaacttggttgaataaagaaaaagaagaaggagggaatgtgtgcataaaaagaggaggtggggaggagaagggagaggaggctggagaaggagcaagctagcaagctgctgggctattctatcctagttgggagtgtcaggctccaacacccggaatgctatcagggttctcaaacaaaagcctcctttcttcagttttggaacagtttattagcttgagggagaagtccacaacagtccaggcctcttatcaaattgtatcaaacaactccacaggttgggattttctagaaatcctatccagaaattttgattacaaataaaattataagtctgactggagttctggatcttcgatgttaacattggtctaatttctttttcatttttttttttgagacagggtcttgctctgtctcccaggctggagtgcagtggcgcattcatagctcaagtgatcctcccgcctcagcctcccaggtagccaggactacaggtctgcaccaccacacccggccattggtctaatttctaagcaaggccagtgtcttccaatgagctcagggtgggaaaccccacgggggttgggctgtgaactgtaccaggtggcccaagctgggggtccaaaaagacagatccacatctcaaatccactgaactctgggaatccctgtgatgacctgagacctgcatcatcactgcccccaataatgttgtaaacatgtaaagaaactgaatccccaaaaagcacactttcaaaagcactacacaaagcagtctgaacccttcctctgaagaaggctgctacatctggcatcgtcttacaagtaaatccaacccgaaatgaagttctttggagaattcagaaactcagcccttttgaacccctgccttgcgttgaatttcaagccaagtttacaaccaaattctgaagtatataaaggacttttaaagacccaattggtatttttacaattgaaaacctgcataaattgatcatgaacccaaagaatgaataaaccccaattactttcatcactctaaaccctgcccgaagctgaaaataaaaatccagttctccacaagtttgaagaccagttacttctagtacgagcccttgggtgttttcatctaaagtagaacagaaagaacaggaatggcacttgtggcgatcctaaagccttgcaatgaaataattagtagattggttctgtttcaccttttactgacacttgctggttttgtggcttacttaaaaatagtttattttattataatccaaagataaatgaagaaaggtttgaattcaccaatcctacttttcccactgggatgctaggctagaaaaatagtttcttatgctaataactgtgattaaagccaaagcatttacttaaataattaactttacaaataaaaaagttcaaagagaaaaaaattcatattttatatccctgttgggtaaacaaaaccaaatgtgaacgtgggcaattgggcatctttgcctgacccagcccagtgggcacatggtggcctggccagcggtccaggacgttgccagaaccatagctaaggaggtgccacttgtacacagctgtcatggatctatatattgattacaacagctgcccaacatatgacaataaagtgtcctgaggaaagggtgtcttactcttattcactcaagaggcactctacaggccagcagggagggtccctgagtgtgtccctgagacttctctgccttttaggtgttggacccttggcagatgaggacctctggcctcactgggccccttgctatgagccagctccttcaaattctctcattaaagctcagtgaagcagcctttgcagagagcttcctaatccatgcacacttcacccttttggctaaagttctgcagaaatagtcaggggctccattttcaatcaagagtttgatagtcactggaacaccgtgccttaaatgaaacccaaggacttactgcatgcctgccgtgctactctgcctctctggctagatctgaggcagccgcagctgtgatggaaggaggactccatgccctgcagcagtcacagcctttttgaggagacaaagcatttgaagagaatgtgcagcaataaacatctatcttatctggggtcagtgagggtttctggtcccttctgacaaagaaattggcagcagagattccataaaaatttcaataagttttagcattctgaaacacttcaattagtttgatgttaacgtttaagcaccttgatgaaataaatttatctcttccaaatcctagaaagaatctccctttcggcaaagattctgcagatgggttttgatgccatttttccattttgtagttagatctctatcatttatcacactgtagaccaaatggtcgttttagtgccattaaaaactgatttgcaatttgctgttaaattaagatgtttcattttcctactgtatatgattttccttttcacagatgagtgaggatacaaggggcaatcagaccctagtgcagacaagaaaataccatcaaaacccctagagatcccaaatctaagagatttccttttattcattatcaaacctaatcaatctcttatcaaaagaggctcagaaatcatgtatagtaaatatgaagaggatatctgtagaaccccttgcttatcaaagttctgagaaattcccattaaatttctgttatccatgtgtgcaaactaaaaagactaatttaattttaatttgtgcagactgaagtcttagagcagagcactctgtaagcaggcagcagtaacttaatcctacatgacaaactaattacattagaatcattgtgataggtgcccatgccttctttgatgttaaacccctgttacctttgatccacagtcattctctgggcaaggtctcttgcacacattcccatcctgccagatcatgaagctgttgcttttgaagctcagttttattttgatagaacaccaagggactgaaaattatttctcactgattttgttctgaaaacttcgggtagaattctaagcttgacagaatgtagcacatacaacgccaacaaatgtggcttcttttcttcactaagatcacccactcactggtgaaactgctcaatgtactcattgcactgtaacgtctctctccatcccttcttgaccccagtgagtttgcccatcatgtttcttaccccttgataaacatcatttacctacagcctcactcaaagctcagctccaagggggtctcaccttttcgttaatagataaaccgaaacacgatgagatttccaacaggccatttgttaacatcttgccacgctgaaagccctggcgggtaccttccgtctagatcaaatttagatgatgacttcctggagcagcccacagaggaccagacatccaaatcaccccaagaggcaggcctgtattctcattcctcctagagagaagtcggatgtgccacacttcagaggaaggccgaaggtcaatgggtgcacttaatcattattggactagagaaatgaagggctttgataaaagctaaacaccagtccaacctactgtgaaaaccctgtctaaactactttgctccctttaaccatgtcctcgagcgactttgaataatatctctcttgctttcacagggctggcacttgggttaaaagaaacaatgcaagtgaaatattaatcgctgagttcagcagcaagattacactcagtaatagtagtgctttcttaacatctttaaagaatgaaaagaacaaagactgccctggctaaggcagaccctaataaaagagtttgaaaaccggctgatcagagttcaaaatgctagaagatccaagccagaaatcctcaccactggtaattcaatcttgttaattcaacatcttaatgcaaattatgaatgatctggaacacagctattcatcaaaccagatgtcctatttgctcttcaataagaatgtcagcaaatcaaaatcaacttaattcaaatactctcatttcctaattcaccttgaatgaatgagatgaattaggaaaaggagagtactgaatgaacaaaatgcaccgtagttgaaagacacccaaagatgtaattggaaggaaaaacaagatatgccaaacacatggaggaaaagccaaagattcagacagccttccagcgtggggtgtagaacaaatgactttcaaattctctctctccaaaatagtaccatgactaactaccatcttagaactctgctctgggacaaagcgcatcacatgtcagtgctaagtacgcagcaggcttgcagtaaaacaaaatgattcatcacaagatgggttttggccagacatcaactgcaccactttcaatatacaactcacaggtcactttaaagttcctcctctagctcaccagggacctgggggcgggcctgccagcggccactccctgtgctccccttccaggctgatgcctccctgcctgcccacaccggggtactccacgtctctacactttgtgcgtgctcctctctccacgaagaaggccaattctcctccttctctggataacttcgactaattcaccagactcagcaaaggctctgcctccctgcaggaggccatccctgatcctcgccactcctgccccatctatgccaggcatgtgcctccagggagccacagcaccctctaaagagagcaacaccaaatcagtgataaccgatcgtttccttcaaccagagttaaatgtctgcagaatgcccaccaggcatggtattacagcagagatccccactggaccaacaactcccactgggtccccagcaccgacacatccgaggtaccacaaccggtgactgctgagctgaactaaggatgcaatgggatgaaagccaatggggaaatgtgcctcaaatacttattaacccctggtacaggaggcctggctgctgggattattcctagatcctctgtgacttctctgaccatgtcacacactaaccttcccagtgaaccttctgctctgagcaggcctggccttctgcactcctgcaaatgccagtggcttttctatctctgagctactgggtctgctgctcccccaggctgaaatgccgtccctatgccattcttttctttgtccatccaaatccccagttattaaaaaaaggagaaaaatttaaaaggggttacctgttcttaaaaacaaacaaacaacaacatcaaaaacaaaaacagtcccacatcctccctgaagctttcctaaaaactaaggctcacactgttctctcccaactgaactgcaaaataaagtattaacatacacaatatcatcttattttaggcgtcaattgtcttaatatagtacagtagaaagaacgctagcagccaggcatggtggctcacacctgtaatcccagcactttgggaggccgaggtgggcagatcacctgaggtcatgagttcaagatcagcacggccaacatggtgaaaccctgtctctactaaaaataccaaaaattagccaggtgtggtggtgggtgcctgtaatcccagctactcaggaggctgagacaggagaaggcggaggttgtagtgagccgagatcacgccattgcactccagcctgggcaactacgtctcaaaaaaaaaaaagaaagagcactaggcttcagcccagaaaatctgctttctattcctagttccccacgaaatgattctgggcgggctgtttctctgagccttggtgtgtcctctgcggaaagggtaaattattgccctgctcacctcacagagcttattttcagactccagtgagacaaagttgttgaagtcttcatagcatagagagcttgttttgagactccaatgagacaagatgtgaaagaactcatacatttgaaagtcttttgcaaatgtaatgaagtgatattatgacctaataatatccttgtggtaagtctttgaaggcaggaaccatgcctcaaatctcatttattgccccacacctcccacaaatccctccccacctaacagagggcttatgcatggactttacattcaacacccattctacattcaacacgcatggactttagaacttgaatatgtctgttaatgttatgatctggaatatctccattacaagtttctttccactgggcttaaataaaacactttcgtcttttttcccccagaaaaaagatccagtagtcttttatgtaacggctgtctactgtgaaccccttcgggatattaaagtcatgaccctcaacatggctggaacatcttgtatttggccccaactctatgagggccagcacatccctgatccttctctccattttcggcctcccatttaattcctttccaaggtctttatacacaagtccgtatgaggcctctaaatacatcctaaattctgtaagaccgctgcaaataagatcttactctctaaaaacacctgtataatcattctcctatgtaaggagggaccctctatatttttagttttgttcccat

SEQ ID NO: 7 - DNA, 1586 bp, Homo sapiens
atggcagtggctggggcagtgtccaaggagccactggtgtaatggtgcacccagcaggtagggaaaagtgttggcctggatgtcagcaaggagatcatgcacagtgcttccaaaaagatgaaactttacatgggcagaaatcaagggaccagctaaagctgggtaggaggaaagggagagatagagaggaagttcccgtatttgctgaacctgacacagctgcagaggtaaaacatcttttgatttgcccaaggcacgagagaacagcaactcctttaagaagaagacaaagtttgtcaatttacacacaagagagggacccacaggcctgcagtctgctccccagttgccacccttgtgtttgcctgggccagaagcacaagctcatcaatagctgtctgatctgtgggcctgttgtttgtgaacaagagggctccaatccttgcttattctgtgtgacaaccatatgtactatgaagaacaggatattttacagcataactcaaatgagagccagaaactgctaaagaagctcatgccattgatggagaattctggaaaggtggacaactctgccaaggactttctatgtcatcgagaatttcaaattatgtctggtctggagaaggatatcaagcacaaagacaggctgttagagttggatagagctagttttcaaaggacccaagttattgatgatcagattttttgccagtgattctaaccagtggttgtccaaacttgagtgggaaacgaaatgagaagtgagaagaagagctgagagaacttcgacatgcctctgtactctctaagaaggtcaccattgactttacagcaggaagatcctggaagaagaaaatccattagcagaatatcacagcagactagatgagacaatacaggccattgctaaggaaaccttgaactagacactgatcacatttgatatatctcctgaagaacctttggaagttctggtaaatctcagcacatacgagtcccctccccagtgggttgaccacacaggtgcagcctcacagaagaaggctttccattcagcaggattgggactagaattcaactcatttcggtacctcttgtgaatccaggatcaagactttcagggaggttggacagtggctcatgtctctctatacatcagccctgggtttctcagcttgttagagggattagaaaatgatggagtacagatcctggtacatctgccacagaggacaactttggatagtagtcatagccaaaacctccctctgccttcaaaaagtctcagaactccgggctacatatcatcttcttcatagaaaagatgtggaattccccagtgactatccatcaggttgttttttgggctgtctggacctaattgcttgtttcagaggcaatttaaggagcagtttccagacatcagctaagaatcacgttctccacttgttttcatctgcaaaagtcctgaggaaatggttgtgaagtttcctattaaaggaaataaaaaaatctggaaactggattccaagatccattaaggagcaaagaagaggtaaatgaagcagaataaagctttctga

SEQ ID NO: 8 - DNA, 22888 bp, Homo sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 9 - DNA, 22946 bp, Homo sapiens
agagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaagcagtactgaaaactacaatgtaagataaaaaaagatgggagaagaagaaaaagagcaggattagactggagagaaggctgtttccaccataaagacatttacccagccagccctatgaaaacaggagcctatttcactacttggttattgactgaacagagtagccaagaggtgggcctttcagcccttagggcctgccagacagcattaaaactaagtcttctgtgaagaagctccctgtgcttgggagtatgcagctttaatgtttgaaagagtgagggagggaagaagggagataaccctcccagaaaacagaaacgcagaccgtgctttagaaaagatctttccatatgtaacaaacctgcacgttgtggacatgtaccctaaaacttaaagtataataataataataataaaagaaaagttctttctcacaatcctatcagatggaatgagtcacccacctcccttgtgagggaaggagtaaggcccccaggataatgcttgttggggcagccttggcttactcccctgagaaagcacacagctgagcagaagctgcctctttggaaccagtggtggaatagttactggttttacgaatacaatggacacagcagattttgtttgtttgtttgttttgagacagggtctagttccgtcacccaggctggagtgcagtggtaggatcttgggtcactccagcctcaatcccctgggctgaagcgatcctcccacctcagcctcccaagtagatgagattatgcctggataattttttaaatttttaaaaaattttaaaaaattttgcccaggctgctcttgatctcctgggttcaagcgatcccgtcgcctctgcctcccaaaatgcaaggcttcacagcagatgttttcagtagaaattgtcttatatttgttttgtgttgttattgaaatgaatataatgctagatatttcttggtatttcggaagtttatatcttataggatagattttatggtaactttttacatcttgaaaattatgttaaaattattttagtttaactttgttgattatctgcttgtatgaattggctttaatgacaagaaaatactttaaaaccccagggttacctccagctggcttgtcctttacccctgaaaattttggtttcctaatataggcaatgacaaaaagaatatttaaattccacactctccaaagttgcaaagtaaaaataaataaaatattcataaacgtatctgaaatgggtccaaaatcaaagattcaggtaaatattaaaatacatgtccttttttctctgttgtagatggacagagagagaaaaaaaatcactgagtagagagagaaattatattgtaaataaaacatatggcgaaagaaaacttttcaggcaaattaatttttaaaaagccacatcatacacgatattaattaaaaatgtgtatatatataatttaaataaaaatattttcctttttgttatcttcttcatcttccaaattttggcattaaaaatattaggaaggcatttctatggcttttaaaaaagctttccaagcagctctcaatttattgtttcacataatgctactcttttctctaagtctgccttgtcagctaacgtgttttgggaagaaaaaagaaaacaaaacaaaaccaagactctgttcttctcatctctttgattgagttatcctttgctaggtgaagtgttgtgagctttcatacccttccctgggcttccagcagctctccccacggagtgctgccacagcaccaccaggagccccagatccctgcaaggaggagatcaaacctccacagcagggattcctcaagacaggtcaagctccagtgcttggaaaactcagcctacatcacacaaaaatgttatcatttatttggaattctttttcaatggattgtctccacttctaaaacatttctaagtctagttcaaatccagctgcagattcctggcacttgcttccttcccattctttttcatatatcttcttttatgttgcatatacttacttcagattaagtatataagttaaactttcagtctattctgccattagaagagtttatttccatacacaataaaaaaggatcgtttgtattatcctcaagattagtgtatgttatgaatgcaatatctttgcattcaagtgaatttaaatattataggaaggggtagagaaggaaatgcaagttatcactgactgacttgccaaagttaagcaatttttaagcattttggcatgcatgattgattgtgtacttttaaatttaatattgtatggtaattattttctcacgtcattaaaaagtatttttttcaatggccagataatagtttatcatgccatgtactgtatttaacttcaaattgatagtcttgaacacatatattaatttcaattccacagatacaaaaaataattgacattaaacttctttgagaataaaaccttgtccaaatttgatatatccttaggatgtattcctagacatggtttatttcatatcttatgaactctttatttgaaggtatttggtatgagttgagaaattacattacagaaaaaaattttgagtgtgtatttcattcaatctttgcattgtttgtaagtgcctatattaagaacttttttgttaaagtttgactatgaaatctgatgagtgaaaatttaatctttttcttattttaattttaatttcttcagttaatagttaaactgaacgctttccatgtgtttattagccacttctcaatttttatatatttatttagataaaattgtgcttaccaactccagtctcaatactctctgttaaggtctacggtgtattcatctgttgaggtttttgtgcttagagtatcaatttttgtgaatgggatatttattataactaacaattctaggttttatttattaaaaattgaacaatctgctatctataaaatccgtaatatttcctttgcaattttcttccaaacaattgtaagttttacaccaaaattattccaagaacaaagcacgtgagactattttattgacaaaactttgttggctgaaagtttatcttccgtatacttcaattttttttcccataggaggtttaaagagcacacacacacacacaccacacacacacacacacacacacacacacacacacacacacacacacacacagtgtttctgaagcccaggccatttttggtaccaactatatcaagttagaatttttacatgtgtctcttctgtacgaatctataccaaaatacatggacagaaaatacagtgatacattcttttaaatgaatgctgattgcactttacagtttaagaaacaaggcttcgatgtagggatttcagagtgaacacttactatatatctttggaaactagactgctaacctgttactgaaatgtttgcatcaaattgtttatcaggttattttctctcggtatataaatataacaaacttggacaaagtggatgtattttcaaaggataataaaaactaagaatggagtgggtcaatatacaaggagaaataaggcaatagactggaatgtagagaagagagagagactggcacagagggacagtggggatgataggtattttaaaaaataatgggaaatgaaaagattttctctatcacagaaaaccaaggttctgtggagacagaccctaaactagactcctgcagagtctaatgctcgttcatcacaaggcatgctagacactgcaagacccattggcccatctttttgatcctcactctcaatcatctaaacaaggctgagagatgactctctgtacagcctctgcattgtgtaataataactctgaaatagtttctgatcttttctcttaggggttgcataaaattttgcttctagcaagagaaataaacaacccataactaaatctagaaacttagcaggcaaagctctgtagtcagaatggctactttaatttgagcaattctgaacacaatttgaacctctccacactatgaaaatagcataaaatgaaagaaataatagctaatacaccaacaagaagtacagtatatatgatgtacttacaaaaaaatatagaattatggataatatgacacattcattgagcaaagagaacatggcatacatttatcttatataaaataatgctttataatatatatttaattgaacatggattcttaatacagaaacaaaaaatattttagattgattatcattgtacaattccttagagacaaaaaatgtaagtaaaatgtctgtggattttccaatacaacctactcttcctatctaagtgataataatagcctttaagtaattttctaaggatttttattttaaaaagtttaatttaccaatgaaaaaacataaatctttgacattaaatgaaagctctaacagatgacgcagatatttctaataaaaacaactcaaaaaatggaggaactaagctcgtatatttcattagagatattggatatagcaaattagcctttattttaaaatgaggtctctcaatctaattttaaaaataaatataagcggacttttacttacagcaaggtggaggaaatatattttttttctctatatttccttctaacaaggaatgaaaaccctagacatcatataagaaaaaacaataagaagattttgaaagatagagagaaatcagaccagccagtggctttggaaccctaggaagaactcagtggtgagtttcctggatcttcctttaatctcacatatctgagccttattgctgaagaattcaacaacctggagataccaagagcacagagaaaaccacaccccgacaaaagtctgctctttctagccaaagggtgaggaacgggcctgcctagaaagacatcatacttctagacaacaacccatcaactccagcaaatgccacagaaaaaaactgtggccccgctctcactcccacaatacgtatcaattggggggcacaaagtttcttcctctcgaggccataacgatgtgctccccaaaccctgctggggtggttggtgtgagagagagccagataggaaacttgatgttcatcttctctcgctgtaagaaatccccatgccccttcccctcactcccggccatagtgtcagtttatgtgatgtgaggatcctagtgctgcatcctcaccacacaagaacaagcccccctccaccaccctgcccattatgatggagtcagcagagcccggtggagagtcccatagactggtcacatagactggccgcgtagactggccacaggggatctgggcttctcactccgccaggcagcaatgaagtggcaccctcccattctgtcagagtggagtcagatcatgccagctaaaatgcacggtttaaatacaggcttcatcacatgattggaaatgtccacttttaaattgaaaatcacttatcataccaagatccaggaagacctaaaaccaaatgcaccaggcatggtaggtaacacctgtaactctagcactttgggaggccaagacgggaggatcacttgagctcaggagttcaagaccagcctgggcaacatagcaagacctcatctgtacttaaaatttttaaaaagctagccaggtgtggcagcgcatgcctgtagttccagctgctctggaggctgaggcaggagaatcacttgagtctgggaggtcaaggctgcagtgagccatgattgtgccaccacactccagcctgggtgacagagtgagactctgtgtcaaaataaacaaacatataagctgaatgaaaaggacagtcagcaattataaatatgtgataacagatatagaattacctacaaacgttgtgaggcagccattgtaaaatgtttcaaggagcacttacaaatagaaagtgccagcaaagagatataaagaacaaaggggaaatttgaatatttaaaaattaataatcaatgcgaaagtttagtgtttggactcaacagcttaatggaggagatagagtaaaagatcaggaaactggaagatagaataagaaaagttacccggtctgagcaacagagaaaagatagctggaaaacaataacaaaaatgacagagcatcagagatctaagggactataacaaaagatattagaaaaaggccaggtgtgatggctcaagcctgtaattgcctgtaatactagcaatttgggaggcccaggagggcaaatcactaggtcaggagtttgagatcagcctggccaacatggtgagacccccgtctctactaaaaatacaaaaaaaaaaaaaaaattagctgggcatagtgttgggcacctgtaatcccagctacttgggagactgaggcaggagaattgcttgaacctgggaggcagaggttgcagtgagccaagatcacaccactgcactccaaccccgggcgacagagtgtaactcagtctcaaagaaaaaaaagatattagagaaaaaaaaatcatgcaaccagagtccctaaaggagaggaggaagggtgcaaaggtgaaaaagttacttgaaaaataatgacttaaaaaataatgatgtttggccagatacaggacactacagaatcaagaagctgagcaaaccttcaacaaaataatccaaagaaatccacatcaaacaattaacttctgaaatctaaaaacaaagaaaaatcttgaaagtagccaaagaaaaaatgacaccttagttacaggagaaattcataatcacagtaggtttctgatctggaacaatggaagccaaattaataggacacaatatttttcaagtgctggaggaaaggaaccgtcaacaccaaatcctatagccttgaaaatgtcattcagaaattaagggaagatcaagacattctcagatgatatataattaagaatatttattaccagcagacataccctaaaataatgactgaaggaagttctctaaacagaaaggaaaaaatagaaaaaggaatcttggaacatcaggaaggaagaaatcatatgattaaaacaaatatgggtaaatattataggctttccatctcctcttgactttaagagagtgggtttgatgtttgaagccagaattataacactgcctcaagtggttctatatgaatgcagatgaaatatttatgacaaatatattataaatggggaagaatagaggagcataaaagaagtaagttttccctacttcatttgaactgatgaaataaggacactactggagtgttatgagttatgtataaataatgtaattctgagaaccacaggaaaatcacccaacacattgaaactaagcaacaatcttttaagtaatctcactatcaaaggggaaggatcaaggaaaataaatagaaaataatgcatattaaaagttatgtgacacagataaagcagtgttaaaggaatttttgcactaaatgcgtaattagaaaagaaaaataatctcaaatcagctatcatagtttgcatcccaagaatctagaaaagtaattttaaaacatcagaaagaaaaaaatgataaagttatgagacagttaagagcagaaacaaatgaaattggaaacagcaaaacaatataaaaaatcaatgaacaaaaaagctagttctttgaaagatcaacaaaattgacatgaatgatgaaaaataagagaaagacatgaattaccagcatgtagaatggcactaaagatgcttcactatatcctgcaatcatcaaaaggatgatgagagattacaatgaacaactctagacacataaatttgataccttacatgaaatggaccactttctttaaaaaaaaaaagaaaagctaccacaattgactcaacataaattgctaattgggatagtcttttaagtagtaaagaaactgaattcataattagacattgtcaaaatgaaatctctgagcccagatggtttcaccggagaaattatttaaagaagaattaacatcaattctaaagaatccagattattgagggggagggaacactttttgatagactttagaaagctagtattactctggttttgattcatatcaaaaccagaataaaattgttaaaaataaaatataaggaaataaagagaaagcaacatatcaataaccctcataaatatgacagaaaatatttaagaaaatattagtaaattgaaataaaattcagcagtatatcaaaaggattatatattataaccatgtatcttctattctaaggaaacaaggcaattcagtattcaaaaatcaaatagtgtaggcccccatattaacagaattaacaaaactcttctaattttccaattagaggaaaaatcacatggtcatacaattgatgcagaaaaggcattttaaatattcagaaaccatttataataaaactctcagaaaactagaaatagagagggatatttctcaacctgataaagaacatctacaaaacctgtgggtattttcataatgatgacagagagaatgctttttctctaaggtcaggaacaaggaaaaaatgctctcaccacacttatctaacagtgattgaaattctaatcagtgcagtagggcaaataataataataacaacaaacacaaagcagaaaggaagaaacaaatgtccctgcctacagatgacttggttgttcgcatggaaaatctcaaggaatctacaaaaatattcctaaaaacagtaagtaagttcagcaagtttacagaatacaagatgtatattaaaaagttatattcctatatattcacagtgaatacatgggaaatgaaccaaagaatgtgatatcatttataatcactaaaaatgaaatgaaatatttaggtataaattgaaactacacaccactgctaaaagaaatcaaataagatccaactaacagagagtaaacttagtttcttgaattgaaagagtaaacttagtaagtagtcaattctttctaaatttatactggaggtttaatgcaattctgatcaaaatctcagcaaaatgtttcgtaggtatagaaaagattgttataaaatttatctggaaaggcataggtcctaggatagctacagtaatttttacagagaataataaagtaggtggaatctgaatacccagtatcaaaacttactttacatctgtgttcattaagaatgtttggtgttggtggagagatagaaatattggccaatggacagaacagagagcccagaaatagacacacacaaatacactcacctaatctcttaagaaggggcaaaagcatttcaacaaatggtactggagccatcgaactccacagaccaaaaaacagtatcttaatgtaaggcttacatcttattaaaaaattaactcaagaaaggccacacagagacataaatgtaaaacaactgtaaaacttttagaataaatataggagaaaatttccagtgtctagggctaaacgaagagttccttgtcgtggtatcaaaatcatggtctctcaaagaaaaaatagttaattggatttcatcaaaatgtttactttgcaaaaaaaaaaacacctctgtaaagagggtaacagatcagttactgggcagctaaaatatttgaaatctacatataggtaaaaggactaacatctaggtctattttttcaactctcaaaactcagtagtagctagttgcagtggctcatgcctgtaatcccagcactttgggaggctgaagcaggcagatcacgtgaggtcaggagttcaagaccagcctggccaacatggtgaaaccctgtctctactaaaaatacaaaaactagcaggacatggttaattaattaattgattatttaaattaatacttgggaggcagacgcagtagaatcgcttgaacccgggaggcgaaggttgcagtgagttgagatcgcgccattgtactccagcctggccgacagagagagattctgtctcaaaaaacagaactcaacggtaacaaaaacaaagagagaataggcaaaagatatgaagaaatttcacagaaaatgaaaaacatatggcaaaaaaacacatgaaaagatactcaaaattatttgccatttggataattaatattaaaaccgtaatgagatatcactgcatatctttcataaaaactaaaatcaaagacagtaaaaacactaaatcctggtgaggctgcaaaggaactggatcactcacacaatgctgatggaaagataaaacggtagatacattctggaaaatagttttgcagtttctttaaaaaaagtaaacttgcattaaaacccaaaaattgacctcctagccttttatttcagagaaatacagacttatgttgacacaaaaacgagtaaacaaatgtttataataggttgattcataatatccacaaactaaaaactatccagacagacatcctttaccagatggagggttaaacacactgcggtacctctatacgatggaatactattcagtgatcaaagggaaagaattattgatatgtgcaacaacctggataattctccagaaaatgatgcctgctgacagaaatcaataccaaaaagctacacgattccactgaagtcacattattgaaacgacaaaattaccaaatggaaaagatattagtgatttccaggaattaaggaggggatgaggtgaaggaagtgggtatggctataaaagggtaaaatgagtgggttcaactgtattccccgcccacactaataaagcatatgaatatatgctaatgcctgaagcctatgaatatgaccctatgtggaaaaaggggttttgcagatgtcattaaagatctcaagatgacattatcctggattatctgggtggaccctaaatccagtataagtgcccatgtaataagccgaagagatgagagaaggccatgtgaagacagaggcagagattgaagttttacaaccacaggtccaggaacacctgaagccagcaaaataggcaaggcaatagctggactaggccaggaaggattcacttctaaaccttggaagggaatgcagcactgctgctaccttgattttaggcttctggcctccagaacggtgagagaataaatatcagttgttttaagctgtccagcttgtggtcattggttaggggttaggacagctctagaaaacgaatatgggggatcctcatggtgatgaaaatgttctgtatctctggtttaacaatgtcaatgtcctgggtatcatattgtaccagagttttgaaagatgttgtcactagggaaaactaggtaaagcagggcgatgtttttgttttattttgcataactgcatgcaaatctatcattatcccaaaataaaatgttgataaaaataaataaataaaattgaattataatttgatctctgggttacacaatcagaatgagttgatggcacctgaagggcatctattttatagtacaccttcatccaaatatttacttttaatgattaacaaaccgacttagcatgtttgcattaatatcttaagtgagtctctggaattattcatcttttagcaaaatactatgaaagcctctcacacaggctaagcagagaatattaatgactaactatgatttatcgttttgtgtttgcttcaagaaactggtacataaatatgtaattcttataaaaaatttgtggcagcttataaaatatacatgtaatataaggtgaaaaacaaaataaaataggagagaaataaggataggaaaagtaaaggaaggcaaagttaaaattagaatacaaaacatcagagagtgatctacacttcacaagtttgggcttctaatttttccagagaagaaatatataattccataaagatatttaagcaagtataaattagtcaatattctcatgtcaaaaaactaaaacataaaaataagtatctcaattagagatgtcaaatttagtcagagtttagaatattctatttaaaatatatccagtacgatttcagaaataattatctcagttcaagaagggaaaacctgctaaatatttaaatgtcaaatatatcagtgatagtttctgttcatatttttagtcttttgtcctggtataactgaaaaatttgcatgacttaaaatgtcatattttatttcagccttaatattggttagttgaaaggcataattatgaccagaaaatgtactttaaaattacccaatgagaaaagctatgctagttttaactgaaaatgctttacttaaatgccaaaaattgaaatagtctactttattaagatatttaaaataaaattatgaaaacgatgtcatatcctttgcaaagttggcacccgaagttcgagttctgtctttcaaaatgtaaagtgatttttttctgtggaagtagaattgtcacctgtaatggttttcagtaaattactctgaagcatcttgtcaagaacattcataaacttaaaaataaaacaaagattttcatgtctatcaagactaaaataacaaaaagttattcccaccatttaatatcatataaagacaaaaataaatagatatataataaaaaataaaatatatatatttaaagatacatacttttttcaatagtaaggatcacatttgcatgtatatgaaatacaacataaaaatcagcataaaaatcatccactatctcatttttacataaaatgatatctaacacgaggactgcttggaaaatagcatcttaatctttgcttaacttcttaggttattttggaactctcttgatctcagattcttcttctataaaattgagacaatctttctccaggagaataggttcaggttttataaagtgatagatataaaagtaatataacagatatgattattaataatattattatttgaaatggacaagcagtaatgggaggatagaatgataaggatgtgtatcattgccaaatccttgagggaggtgctggtatttggaaaaaaaaaaaaaaacaacgaatacctaaacgtgaataaatttgaggaaactctattgaaagtcttccccacctgttcatgaaacagatgcccttttctcctctgttattgcataagtaaggtatatgtcttagtccctttcaattccagtctggccatgtgcctgagctctatctagccaatagaatgccagcagaaattatatgtatcacttccaggtcttcccttttagaaccctaacacccaccctctttcatgctcattcttcaccaactgattgcacacacccgtcaaggaacttggagctgtcagatggcagaaggttgctgccctgaatggcagaatggaaataaacgcacaccggaattacccgcaattaaccactgcaactaaatgagacatcaactttacttatgttaagccactgagattgtaagttttgaatgtagacccaatatactacgccggttaatttacaagcctagaatagtacgaagaactatcatatataataagtaatgccaatatcaaaattatggtaatgtttcttgatacaaaaacataaactggaaaaggaaacaattactactaacaaaattcactataagatgtgtctaatatgtcaagcattgaccctagactacggtcaaatgtcagttggaaggttaagttgtgtactctaagacaagcacgtgaaataattcctgtggattcctgtcagtgcagcagtttctcagctagtgttagtctaggagattctgaccagcagcacttcttgttcagctccttttccttaacgtgtaattttcagcagaataaaactgcattctctatattctagcacaaatgaacattttgtgactaacagtattcactgatagtataatgtatcggccttattgctgtcaataattattatttgtatttatattacaatattacatttcagttattttggttcaaggttttagagtcatcaacttctgtgaacatttctaagaattttccatcccttatcttcctacccccttcatcaggaacccttagtctaagtaaccccatatacttttgcctatgtaacccctctcatatcaaaaactagaacacagacatattgagatggactcagtcataaagggatataaatttgttttgtagattcatatgttaattttataataatagattacttttaattgacacaaaatattacccagctcagataatattttattttgcaatctttcaacaattagctgttaggaaagactgtttaagtgaaggatctaccataaagaatccaaaataatataccactttttgcccagtggcttttgcgtatcaggcactatgttacagattttatatgcctaactactatgtttttataaagtattattttctaaatttacagatgagatagcctcacctcactgagattacatgatttgctaaagaccacaaggatagaatcaagatttgaactcttttctttctccaaatctagagctctttttccttacttctgttctatggaattgattgttctgcttcttttctataattaacctttacaatcacttaataacaaatttgtgatatatacggtagacaccaatataagtgctgaagctacaaagataaatgggaacccctggccaggtgtggtggtgcgcgcctgtggtcccagctactcaggagattgaagcgggaagatcacttgaactcaggaatttgagatcagcctgctccaaaaagcaagtccccaactctataaaaatatatttttaaaaaattagccagacatggtggcaggcatctacggtagcagctatgtgggaggctgaggtgggaggattacttgtgcctggaagttcaaggttgcagtgagctatgattgcaccactgtgctctagcctgggtgaccacaaagccctgtcttaaaaacaaaacataaaagtaaaaatatggaaccatcagtctagttggagaaaaattcatgaaaataaatgattacattgtggtgggatatgcgagtagaggtgaaagagaagacacagaagccctgccgtgaaggcagtgaataacttgctatgggactttcaaggactgtttggaggtgaaggcagtaccagagcaggaattagaggtacattggaaacttagtaggccaacagaggagatgagggtgtgaggtgtggaagagaagatacctgagtggggtctactcatggcaaacctatatacaatgctaagaaatttgagctgttgtcctgtgcatgagaggaaacaatgacaaattttactgaaaataataattttaagagatttttgatgtaagaaattactatcagcaacagcaaatatgggtcagggatggagaaactaactgggttgtgatggcagattagagatcatgtttccatttatccaatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactgaatagttagatttcacaggaaagcagatcaatcaataaatgtgggacttatgtatttacatgtggttattaaaaccaaggacaaagatttcattaccttagagtatagtaaaaaagagaggattgaatagaatcacaaagagggacacagggacagagaagaaggaggaaggagactgggaaagaacatttaggaagaggacagagacctagagaggatcatgtaaggaaaccaagtaaggcatgttctcaagactataaattgctgataggaacagaagccacaggaagtttaagaacagtgtacattggtctcacaaaataggagaccatttgttaaaacactgtccaaggcactacttatggcagcagaagtgagattaaaggggattaagtagttggtgaaaattagacagtgaaaatataaaagtaaattactattttcataaatgtatataggcacacctcattttattgaaccttgctttacaaattttaaccttgtggttaaaacaaccacagatactacattttttacaaattaaaggttttggcaactgtgtggagcaagtttattggcagcatttttttccaacagcacgttctttctctcttttggcctctgttacattttggtaattcttgcaataactaaaacttgttcattattatcacacctgttacggtaacctgtgatcagagatcgttgatgttactgttgtaattgttttggggtgccatgaaccagaaccatgtaaaacggcaaactcacttgttaagtgttgtgtgtgttctgaatgccccactgacctgttgttctgccatctctgtccttctccttgggcatccctattctctgagacacaacaatattgaaattaggccagttaagcctacaatggcttctaagtattcaggtgaaaggaatagttacatgtctcttactttaaatccaaagctagaaatgacgaagctcagtgaggaaggcatgtcaaaagccaatatgggacaaaagctagacctcttgcaccaaaactagccaaattatgaatgcaaaggaaaagttctggaaggaaattaaaagtgctactttaatgaacgcacaaatgagaagaaagcaaaaccttattgttgacatggagaaagttttagtggcctgagtagaagatcaaaccagccacactattcccttaagccaacgtctaatctaggggaaggccctaactcacttcaattctatgaaggctgagagaggtgaggcagctgcggaagaaaagtaggagactaggagaggctggctcacgaagttaaggaaagatgccatctgcataacatagaaatgtaaggtgaagcagcaactgctgatggagaagctgcagcaagttatccagaagacctagctaaaataattggtgaaagggcctacactaaaacaacaaatttttagtgaaaaacgcagctttgtattgggagaagatctcctctggactttcatagctaagaaggagaagttgatgcctggcttcaaatctttaaagaataggttgactcttctattaggggctaatgcagctggtgaccttaagttgaagccaatatgaatttaccattctgaaaattttaaaacaagaattatgctaaatctacgtagcctgtggtaagtggaacaaaacctggattacagcacatctgtttatagcatgatttactgaatatttttagctttcttttgagacctagtgcacagaaaataatattcctttcaaagtagtactgctcattgacaatgcacctggccatccaaaagctctgatagagatgtacagggagattaatgttgttttcaggcctgccaatggaacatctattctgccacccatggatcaaggagtaattttgactttcaagcactatgattcaagaaatacatttcatggggatatagattccatagatagtgattcctctgattgatctgggtatagtcaattgaaaaccttctggaggctgggcatggtggctcatacctgtaatcccagcaatttgggaggctgagaagggcagatcttctgaggtcaggagtttaagactagcctggccaacatggtgaaaccctgtctctactaaaaatacaaaaactagcctggcaaggtggtgcacccctgtaatcccagctactcaggaggctgagtgaggcaaggcaggagaattgctggaacgtggaggcagaggttgcagtgagccgagatcccgccactcactccagcctggataaaagagcaagactccatcgcaaaaaaaaagagaaaaccttctggaaatgtttcattactctaaattgcattaagaacaaggaggtcaaaatatcaacattaatagtactttgaaagaagttgattccaactctcatggatgactttgaggggttcaagacttcagtggaggaagtaactgaagatggtctggaaatagcaagataactagaattagaagcagagcctgaaaacgtgactgaattgctgctacctcataataaatccttaagggatgagaggctgcttgttatggacgagcaaataaagtggtttcttgagacagcctctacttccggtgaagatgcgatgaactttgttgaaatgacaacaaagggtttagaatactctgtaaacttagttcgtaaagcagccacagggtatgagaagattgactccagttttgaaagaacttctaatttgggtacattgttatcaaacggcaacgcatgctacaaagaaatcttttctgaaaggaagagtcaattgatgaggcaaacttcattgtcttattttaagaaatcatcggccaggcatggttgctcacacctgtaatcccagcactttgggagaccgaggcgggcagattgcctgagctcaggaattcacaactagcctgggaaacccaggtgaaaccccatctctactaaaatgcaaaaaattagccgggcgtggctgcgtgctcctgtagtcccacctactcgggaagctgaggcaatagaattgcttgaacctgggaggcagagggtgcagtaagctgagattgtgccactgcactccagcctgggccacagagtgagattccatctacaaaaaagaaaaaaaaaaaaaagaaagaaaaagaaaagaaattgtcacagccaccccaggatttaaccaccatcgttgtcatcatcagcagccatcaatatggaggtaagaccttccaccagcagaaatgttataactggctgaaggctcagatgactgttagcagttttagcattaaaatatttttaattacggtattttcattggttttttagacatgatgttattatacattttatagactacagtgtagtgtaaatgtaactgggccgaaaaaattgtgactttattgggacagttgcttaattgcagtgatctcgaccctcacttgcagtatctctcaggtgtgcctgtataacgtgaatggaatttattaacagggagtgaaacgaaagagtggcaactagagagaagcatggagtaaggagagggattttctcttgatttcatttgttgacataggaatcatttatagatttgtttttcatttatttcaatgataagaaagaatgataagaggtggcagagaaagagaagttgaaaatagaataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaaactaagactgaaagttttgacaaattagttttgaaaccttcacaaactaaacctgtttttgatattggtttcaaaaagtatgcatagaaacttgacatgaagtagctaaatttatgcactcaattgatatttatatgtgtgcaggtctatcaacgttattgaaaagttaatccaaaggatttattgattactctcaatttctcagatactgtcagttcacttttgaaaattattctcttatgtaatattgcactcttttcagtaaaaaggagagtttgtggctgttaaatatgcatgaggcacaatagtttcacaacaaatcaaatttaattaaatgatgcatttcctccacttacaaaaggtttattaaaggtttatttgctcatgcaaattaaagtgttagagtaaaaatccacatgaaacttggcactaacaattaaaaaaatattgaaagatttctcgcctcgctgcaataccttgctatgtttaaactgctcagcttgtcatttagaatctttaatgaaaccagggaggaggctatttatttgcataataggacataatttgctgtggtgaggttttaattatttataggctgtctgaaatatttaaaatggcatcactaaggagcatgaagtgttggataatgccttcatttcaggtttcctgccgtttcttttatgggtcaagcgatttatttctaattagcataccaggctagtggctttaaaaacataaggaaaacaaattggtttcagtctgtttgcagcttgagtagttggagacggccaagggtcactgacggagactgagcagagttaagagatgaagccagaagccatcccagcacatggaaatcactgactcaacagagccatactttcatttgtgcacactgattactgtatgtagtagcttctctttggtaggtagtgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaaaaaaactcaggaatcatctataaggtctcttatgttatgataaatggattttcatgttctttactatctattttaaatatgataattttcttgaaagtagtttaaaagtggtcatgttgtaaacatcattgtatagccaggagaaatgtgtttactgcaagagtttattatatttccgtgatgctctagatatccccatcatcatgcacatagattgaaagcaggggtagcacactgttgtcagacattctctcatttgtcaccttctggcctcaaaacatgaatagagaaattgctgccagatgtcaagaaacagccttagggcattacagaggatattatccatgcccttttaagtagtagacagatgctgtattcagagagaggatttttatgattatcgttcacacagcccaggtgattggtcaaggccataaaggagtctgcaatccttggagaacttttggagtcactttaaccataacgtaatgtattgcaacagttacaataaattatgttatggttcctgaatgtaaccgtcaattatcattatttttttaagtatccactggatacagatagtgg

SEQ ID NO: 10 - DNA, 1179 bp, Homo sapiens
tctagttggataaatataaatatttggaaaatggtaccctggaaaatgataccattgaaaagggccataaaagaggaacgttctcattcttgatatagcacagaagttgggcatcattaaaggtgatgaactcaacttaaattcatcaaagaaacctgggtgtattgtaagtttttctcatttttcaggttaatgtgactttatcagaaataagcaagattttaaatccctcgttcctatagatcgcaagtttttaggactcccataaaacaccatgatttttttcttcattggaggttgttttacttgtattagaaatgatgtagctcataaaagggagccagttcaattcaaaacacatttatgggggcccacaagggaccccaactaggcagtgctttcctagagaagaaaaagcctacagggtttggattcagactgactgaatagcatttttccacttattaactgttaaccttgagcaaattgtgcttatctctgagttctcttgcagaaaacacactacctcactaggttactaggaagatttcaggagatggtgcttgtaaaaggccaagcctggggctccaggaatcttctgtccttgctttagttgctgggggatgtaggtgatacagacatgggtaggatttagtccctgaatgctgtcagggattgatagtctgggactttgcggtataggatactcacttggaagatacaaggtgtttgtttgtttggcatttgttttttgtgttttattttatttatttattttttgagactggattgctctgttgtccaggctggagtgctgaggtgcagtggtgcaatcatagctcacggcagcctcaaactcctgagcccaagtgagagatgagtcagagccaagcccttctgctaacagagctatttgttgctgaggaagttctcagtttctcctctgaatggtgccaatatcctccagttgcttaaggcagagtgagagaagctgactgtggatacccacatgaagattaatcccacctggaggaatggggcaaggagctgctctctagaccagtcaagcttgcatttgaattgggcttgtaatgagttccccagaaggaaaacacacgcacatataccccaacagaaaaagcatcctggggctgtggactcatccattgtctttgataa

SEQ ID NO: 11 - DNA, 1882 bp, Homo sapiens
gctcttatattttcaaggctattgtctagggaaaggcagggtggaatagaggaaaaatcctaagaccagggctcaggtctcttgggtcctcatcccagctctgtggtctaattttgccaaacttcttgacttccctgggctttaatttcctcatctgtacaaagagaagactggctgagaacagaggcaaaatggttgtcacgctttggcaatcaaacagccgtacatgtttcaggtgttaaggaagatagatgctctaacacaaaattctgtcttctcttactctcttgaaaaacaaacaagacaaaacattcgcagagctggagacaggaagaatgagcttggaagatcaggaccacgtgctggtttcactacctctggtcaccccagctcattcttctgctgaaaagaggcaggagaacagtgagaacagggtggtggtccccaagggaagaatgatcaatggagacagtttcatgatgccattcatgaaattcatcagaatttcatgatgccccttggggtgactatcagggttttaagttattcttgagagtttctcgaacgcttttctgtctttgttttctaaaagactttgatgatggcagtgggagctcagattcatgttggagttaccattctggtttgccaaggtagtggaggaatgtggaaagacgtcgctgcactttagtcctgtacttctgacctgtactcaaaggcctttcccttcctaccctggggcatctccccacacaggagcttcatgccagcttcccctctgctggggttgccaactcatgactccctgggggaggcctccgcactagcctgccagcaccttcttctttccttgaaggcttgtgactcatagctgctgtgtaacgtgtggcacccccagacaggaacacatcttgcaaattgcatcgggggctgcttctctggtcttccttctggataccagatttggaggtgccaaatggaattgaattctttataggttagagagcatttaactatacctggcagggctctttaactcagactttagagtttttttttcatatctatacacacacacagatatatttcataataggcaacatgactaatatttgcagtattgttttgattctatcagtgcaactggttcactcattcctgagtgtctaaacatcattaagattctaaaggtttgctctgaagaacatactcagaataagttctggtatttttctctggacatgttgttttccaactacttagagaaaacaacaaagtgggataagactggataggcaaataggtttgattttatttgccagtgccagttgatgtatcatggcttcctcgtggctgtgttgaaagggatcgtgagacactgacttggcaggaagaggtgccttggcaggaagaagtgcctagtggatgagcaatgcctgctctgggcaaggaggggaccaaatagcatgtgtgccacttttagaccctccctggacaatatctttccagccactgcctgcctcatcctcctccttgaaaccagagggcaaggcatgatgttccaccgataggattattgtctatgatggaggaaaatcctatgaaactatgattatttcagtgataaaccaaactagagagtaagttattacataattctggggacttgctgccacatcaacatatcggtggattctgttgaaaatgaagtcattgtagcttgaaaatgaagtcattgtagtggagactaaaatgatttagttgggacttcctgacaatgacaagaaggggagtagagaaggaagtggagatgccatacaatttgctacacggttataactgcacacgcagcaagttacagatgactcttacaggatcctaa

SEQ ID NO: 12 - DNA, 3338 bp, Homo sapiens
cattcctgaatttttacacggtgctgaataggtactgaaagtaaaaattttagtaactaaatctgccaggtgcaatcacatgtgcttgtagttccaggtattctggattcaaaggcgggaggatcacttggtcccaggagtttgagcctgcagtgcactgtgattgcatctgtgaccagccactgcactccaacctgggcacatagttgagaccttatctctttaaaaaaaagcagggaaggggatgattaaatcttctttgataaattgattttgagaatatttcattgaaaaactagataatttgtggagatacattgtcagttgtatacagactaattaactacattggtgattcactccatggaccattttcttcagatatgtttggaattattatctattcctacacttattgcactaatgactcaccttagaaggaaaagaaaaattttaatttacttaaaaaaaattttttttgattgaatagataattgtgtatatttgtggttaattattattttacactccagacctatttctacacctgtagggaagaaacttaatcactgatatcgtcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggataacaactaagaattatttaattggcaggtttattaggtagttgttgattgatgacatgtataacaatccaaatggtatgataggtgaagccaatgcagtggcacatgcctgtaatcccagcactttgggattgcttgagcccaagagttcgaggttgcagtgagccatgattgcagttaaatgttccaaaaatgattttcagagcattactggacattttaattaaaaagaattagtatgaggaggtagagacaatggcaactatctactgctactccctgcccccagcaaaaaaagtgccattcagggagtaagaaacagcaaaagtagaatttaagttttcctgaatggatttaacctgttagcatttaaaaatagtattttgtggtcagtcatcttaagcttgtctctattttatctatatttacatagtttttattagaaataacacccattaaaatttaacagaaactttgtatgctgcctagaacgctaactagtttattggaagtcaaataaaaatataatttttttaaggtttcaataagattcttaaatgtataatgtaatgtattactgctcattcttaaacagaattgcctactgctaacagttttgaaaagattgtccatctttttcatctcttccctttgatagttgaagatcagaagaccaaacataaaattcactgccagaacttgtccagaggcaaacagtaaaagcataggaaaaatattaaagtgagccaataggatttcagaggcctagataacaaacttaagggcggctaacaggtttatacttgcacctacatttttatatctggcttaattgcataagtaaatgagcatcaacattgaaatatatttttctttttcaaaatgggagcttatatagtgacttattaacatctaaaagtgtaaaaccaaatttcaaagaggtaaattgagagatatgtttgattaattcctctggtgaaacaaaatagcttttcatagatctttactaaactttttaaacagctttaaggtatatttgacacaataaactatacatattcaaagtgtacaatttggtgtttgacaaatatatttattgtgaaatcgtaacaagatataatctacatattcatccctcccaaaagatgctcctttgtaatcctttcctccccaaacaccaaccacccaccaactccagacaagcactggtcaccatagattagtttatagttttttaatgattttatataaatggaatcatataatatgtacttttcattttacttctactcagcataattatttggagatgtatctatgttattgcagatatcagtacattcctgtaaattgcttagtagtagtattttgtatggatctgacactgtccattcacttgttgatggacttgtgcaagattttagctagagtcaactatcaactctccacagcttatcactgaaataacaagcttcgtgtgaccatattaaaaattatcagttttacatttgaaaggcccagtgccaacctggaaaaaattgcttgcattgatgagtaataaattctacattttgcatattctcacaactgcatgaattcatttcacaatgttggcaaataatctgaattcttggtggcacgggtcctccgtatgctgagcgccggtcccctgggcccacttttctttctctatactttgtgtctctttcttttctcagtctctcgtcccacccgactggaaacacccacaggtgtggaggggcaggccaccccttcatctggtgcccaacgtgggtgcttttctctaggttgaaggtatgctcgagcatgatcattgaggacaagtcgacgagattcccgagtacgtctacagtcagccttgtgacatttgaagttctacaatgaacccgtcggagatgcaaagaaaagcacctccacggagacagagacaccgcagtcgagcaccatcggctcacaagatgaacagttgattattctctatcccttggcaatctcattcactttcatgatttaaataattgcttccatatgaacaactgtatcttcagcctcacatgtccagtaagctacttactgcacagctcaacgtgaatatcctgccagttcttcacattccatactaaagttgttgttttctttcctaaatcttttcctcctttttctttctttttttccccctgttattaagattttattatccagccaagtggactaaaaaatatctattggttattttgccaaaccaagatttctcctacattcatcctcttttttagggttgagttaatatgtataaagtgcttaaaacaatgcctggctgaagtgtttgttttccgttaggagagagggagagacaggaagaaagtagcaaagaatctgaga

SEQ ID NO: 13 - DNA, 5808 bp, Homo sapiens
acagattctctctgagccaaatgggttaagggagaagtgatggaggcgattcgaagctgtctttcctaccctcttcagtacctcttccagtgatgtgaagttaaaaccagagatggagtctccctgtgttgcccagtctggtcttgagagcttcagttttaaataataaattgttctcgtctttctaaatttcaatcaaaacacaggatgtattttaaaagggaaaaactgtgaggtaaaagaatagggtgaggggaggaaagaaataacttcatagagaaaaattcaatgaacccttggaagaaaatatatggaagtatggttactgacttgggaaagaagagaaaggtacaatgtaactgcacatagaagccagtcctgaaaagaagcaagccggctgaagttatctgcaactcagaagcacttggtaccacccaaggggagataagaggagatctcatcagaggtgcctgaaaagcacctcagccgaaggcctcacatagagagacctaagaatgaaggcacctggactaggaatgtgaatatgtgaaagaacatgaccggccaggggccctgagttattgaatgcaacccccttcagacactgcaacacacaggctgtgcaccaagcctagtatgggaaggacagcttttcttcatgaggcctgccaggtaaagccagctatgaaacaggaagttgaccttcaccagacactgaacctactggcaccttgatcttggacttcccagccttacaaactgtaagaaataaatgtctgttgttcataagccacatagtttgtgatagtttgttatggccacctgaacagacttaggcagggtgcctcattataacctggcaagggtgtaaatttaggtggttcccttcttggacttttctggtggaagtggaggtagggccacagcttttgggtgtgtgtgtgtgtgtgtgtgtgtgtgtgtgtgtgtgtggaagcagaaaatgtggtgtttggtggaagcagaaaatgtattgtctagatgttttctctcttattataatagattacccctttcatggtcttttggctagacagagtaacctttttgggggtctttttcatcagtgcccattggtgctttcaagtcaatggcttctttagctccaaaaaggtacacaaagacaactctgggacctcaccaccatatcattccttaaattcatagtctgccttcttctctccatctttcaagatatttttatgtttatatgttatctagagttctaaattttacttagcaggaggaatagggaaaaatacaactactctatcatcctggcaacagtttaatatttaaaatatgtattttttaaaatcagataaaatacatgtttttttgaaagatttagttcaatcacaagttacttcaggaagtttttcctaatctctcagtcttaggttagggccctgataaggtttgactctgtgtccccaccccaatctcactgtactcccataatttccacatgtccccatcccaatctcatctttaattatattcccataatttccacatgttgtgggagggacccagtgggaaacaatttgaatcatgggggtggttcccccatactgttctcagggtagtgagtaagtctcacaagatctgatgcttttatcaggggtttctgcttttgcatctttctcattttctcttgccgctgccatgtaagaagtgcctttcacctcccaccatgattctgaggcctccccagccttgtggaaatgtaagtccaattgaacctctttttcttcccagtcttgggtatgtctttatcagcagcatgaaaatggactaatacagtaaaatggtaccagtggagtggggtattgctgaaaagatacccaaaaatgtggaagagactttgaaactggatgacaggcagaggttggaacagttttgagggcttagaagaagaaaggaaaacgtggggaagtttggaacttcctagagatttgttgaatggctttgaccaaaaacctgaaagtgatatggacaataaggtccaggctgaggtggtctcaaatggaaatgaggaactttttggggactggatgcaaaggtgattcttgtcacgatttagcaaagagactggcagcactttgcccctgccctagagatctgtggaactttgaacttgagagagatgatttagggtatctggcagaagaaatttctaagcagcaaagcatttcagatgtgacttgggtgctgttaaaggcattcggttttataagggaagcagagcatgaaagtttggaaaaattgcagcctgacaatgtgatagaaaagaaaacttcatttctgaggagaaattcaagctggcttcataaatttgcataagcaatgaggagccaaatgttcatccccaagacaatggggaaaatgtctccagggcatgtcagaggtcttcataacagcccctgccatcacaggcctggaggcctgagagaaaatggtttcatgggccaggcccagggtctccatgctgtgtgcagcctagggacttgttgccctgcatcccagctgctccagccatggctgaaaggggccaacatagagctcggactgtggcttcagagggtggaagccccaagccttgacagcttccacgtggtgttgagcctacaggtgcacagaagtcaagaactggggtttgggaacctccgcctagattttagaagatgtatagaaacacctggatgcccaggcagaagtttgctgcaggggtggggagttcatggagaacctctactagggcagcatggaagggaaatgtggggtcagatcccccacacagagtccctcctggggcactgcctagtggagctgtgagaagagggccactgtcctccagaccccagaatggtagatccaccgacagcttgcaccatttgcctggaaaaacggcagacactcaattccagcccaggaaagcagccaggagggaggctataccctgcaaaaccacaggggtggagctgcccaagaccatgggagcccacctcttgcatcagcatgacctggatgtgagacctggagtcaaaggagatcattttggagttttaaaatttgactgccccactggatttgggacttgcatgggccctgtaacccctttgtttaggccaatttctcccatttggaatggctgtatttacccaatacctgtactgccattgtatctgggaagtaactagcttgcttttgactttacaagctcataggtggaagagacatgctttatctcagatgagactttggactgtgggcttttgggttaatgctggaatgagttaatactttgggggactgttggaagggcatgattgtgttttgaaatgtgaggacatgagatttgggtggggccaggggcagaatgatatggtttggctctgtctccccacccaaatctcaccttgaattttaataatccccatggtcaagggcagtagcaggtggaaataattgaatcatgggaacagtttcctccatactattggcatgatagtgagtgagttctcaccagatctgatggttttgcaaggggtttccctctttgcttggttttcatttttctcctgcctactgccatgtaagacgtgcctttgctcttcctcaccttccaccatgattgtaaggcctccccagacatgtggaactacagaattggttttgtctgtgtctttgttaaagatggctcaagtgaccagtttcataggaaacagactgtgcaagtgacctcaagagtgcagatgctgtggcttatcacgggtagaaaaaatattcataagtctgaggaaatgtttaatttcctgttctccagcctccatggtaaggagtcttttacatttataggctcccttctttccagcatctgtgacataactttcaggagactaaaagcaaaatccaccatattgattgtctcctagccctgtgggcgattcccagtaactggatcagacagactcatcccaaaccttgtacctcaattctgatcgttctatccctgtctaacaaattttgtgtcagttctggtcaccatccagaactcaagaagattaagccatgatcctaggcattaccctagacttcttcatcgcccaacagaatcatcaccagattctattcagtttaattcctaaacctcacttgaatccaattctcattaaccacagtttgagccattatcagttcacagctgtcttattatcacagcctctaaattcctctgccagcctccaggtttgctgctctcaaattattctctgcagccagagtaatcatcattctaaatgatccaccctcttcttaaagtcctttagtaacttcctcctgctccccaaataaacttcaaactccttagcaagaataaagggctcgacctgacgtgaccctgataaccacactgacttggtactgctcacccttccactcacacctacctgcaatctgcactccagaaatgttgaactacttgcagttcccccaaacaagcctttctctttctcacttcttggcctatgttcatgccgagaacataacctgttgcccactcatcctttgggtccctgtttacatggcacctcctcaaggaaccctttgattgcccaaaatgagttatatgcctttcgaaatgacctcatagaaacctgtactttaccctgtgatggaaatcttgctgaggtataattgcccacttacttacctttgtctgcccttggacagtaagcaccagaaggtcaaggtgtaagtagatctcatcacctctgcatcctcacatccaatacatatcctggcatatcaaagctccaccataaatattggctgaattagcatataaacacccaggctttagaaatgaagtcatgcctccatctttctgctttcccttgcacccttcagggagagtaatcctgcctaatctccagtcctgtggatggactctgtttaaaatccttccatgtcttctccctaatcatagaataaagtccaaatcccttaatatgacctaaaaactcaattccgctgggtccctgttccattaccacttgtggtaaccagcctccaagatggcccccaatgaccccagcctcctggtcttcacatctttgtccctcccgcattgtatcaatattagtctgtgtgaccaacagcacatagtagaagtgacaacatacaactcctgcactcaggtcataaaagccatcaagtcttctgcctctctctcttgaggattgcttactctacaggaagttagctgccatgtcatgagcaaccctatggagagacccatgtggtgaggaagcaaagtctctacagcagtgaagaactgaagcctccggccaacagtcatacaccggcacctttgtggaagcagatcctccaaccccagtcaatccttcaaattactacagccccaaccaatattttggttgcaaccccatgagagaccttgagccaaaaatcaccagctaagccactccagaatagctgactccagaaatgatgagataataaatgattactgtcttaagccactgagctctagagtaatttattatccagcaataaatagcattctagccctgccatagcccactgccccttgtgaggcttttctcaattccagaactatgccaggccccctctggcctggggcccttctcacatgctgtttctttgcctttcttcaccaggacaattgcttttttttttttttagatggaattttgctttcgtcgcccaggctggagtgcaatg

SEQ ID NO: 14 - DNA, 2881 bp, Homo sapiens
aaattttttactttatgtttctgcttaggctagcaagtgccttcatcacctctatagcaaagaggctttcagaggagttttgcttgaattctcctgcctcagcctcctgagtagctgggattacaggcatgtgccaccatgcccagctaattttgtatttttagtagagacggggtttcatcatgttagtcaggctggtctcaaattcctgacctgaggtgatccacctgcctcagcctcccaaagtgctgggattacaggcgtgagtcaccatgctcagccaatgctggaaatttttaagggaaatatagtgatatatgcaggacactgtgcaaactgctattattaagctgttgggacctaattacttaaaacactgaactattaagtatatattttgacctggggcaccatgaaaaaagtaccaagacaactaatggcaccctgaacacagaaagtttaggaatctctggcacatacaattttttgttaggcttgaaggatatacaagaactgtaaaatacaaacaatttcaagccatgcccatacatactcgtttccatttcagatggcttaactgtgataaaagctgcttatttaacccatttgttctgattaaatcagtgtgaccaaacacagtctttagaaaaaatagattattcccccacatcaggaccttcaatcatagaagataggtgactttcacttgcaaaatccgtgatgacctgatattttatcaacaaacatatacctttatgggggttctatctccttcaaagtagtcattttgggagattacacttattctggtggaagaatgactctggttaaaaataatcatgcactttgggcaggggtggtgggggcggggtgtggaaatcttcatttgaaattatcttcagagcccatgacatggcgttttacaaagagtcaatgatgctaaaactccagctctgagggaagatttaacttctagaaattgtcaaacacaactttgtgcaaaatctgataaacaaggcaggtaaatcaaagagggaaacatctgctaaggatttttgtaaaaagcaaaacaaacaacaacaaaacctaagtaagaattctcaaatgatgacacacatctcagaggagggagtggattctaaagccttttctgaaagaggagtggcaaaaataatttaatagcattatgaatataaatatgtagtctctcaagatggctactctggtgggcaatattcactcatacgtacaaacatagggtaatagtcttaaaagttatgcatattactttttttggcacacctcttaaaccaataatatcaaaaaagatggctattttaataaacattttcaaaaattataacatggacaattatatgatacaaaatcaaatacatctggggaaataagcatgatctcttttgtagagctatactgattttgtaatacattgataggtgtagacagggctgatattcagatggtctatgctggtggggcattaactattttgagggtcatccgtgaacacagatgtctttatatataagtctatatgtacagaatactccccatttatatatagtttaggtatcttgattttttcaaaagttggttgattggcacttacaacacagttttccaaaaacaaaaccatgctctaaaatttagtcttgtgaggctatcaggtcattcttttgactttaccgtgtaagatatttaataacagtgcaaaatattgcttctctggggaaaaggtgttctacacttcctatcagtatcccaggtacatgccttctctcagagtgacaaagagatttccactgatgaggacagggaaagaaataggacctgtttttgttactttctgcaatggcatgttactccctgcaaatgttcaaaagaaagtaaatttaagtcagttctctttagaaggtactagataagtgttctgaacccagcttcacatcagaatcacatgaaggtgtgtaaaaaacaaaacaaaacaaaaaaacaccaattcctaggccccaccagttaaatccaaatctctggtggctggaacattggcagcgacagtgttcacagctcccagatggttccaatgtacacgagggttgagaaccatagactaactttttctctactctactattaatatgattgtttttgcaactttggcctaggttcacagatgggagaggcatacatatgagaagttacacattctgtttagaatgtctcaaagtggaaaaacaggtaagagtaatcggacctagaccagagagacaatttgctctacatcgttcaccaaaagctaaaatggagtaaccggattttttttcctattgcttcctgttttcataggtgggtgaataaagtaaggaatacaattgtaatttttctcttgatctccaagagaagaacttccagatttaggaagatagatgggaaagtgaacagccataatcactagggtgatactccttttctggctagaataaaatgaggacagaggtagcttcagagcagaggaagctcatgtttaatcaagcagatatatcttggaactgaatatgaagaagtgttcggaagtgtcacgctcattctgggcaggagcaactcctccttgtcaagaacaaggaggaaaaaatgcaaacagagaaaaacatatgattgcacttcaaaatctaaaaggggaaggaagagaggattcagggaagcaatcctctccatattgaacttgaggccaagaaagaaaaaataaggtttttttttcttctttttaaaatcaaaaccctctgtccttcctttcctgactcgacatttccaagctgtgcttcctcatatctaagccacctcaccacagcatttgacacta

SEQ ID NO: 15 - DNA, 3424 bp, Homo sapiens
ggagcgccggtctctaggcctcctgtgaaatgggtggagccttactgatttactctccccttcggaatcctatccactgtaaaaagaggcccgcaactcctcctctaagtgttggggcagaggttggggtaggaacccggtcatagggcaaggacgtgaggcagggtggaaaaaagtacagggtagaatgatttccagtggtttggcgaatgcatcgtgtgtaaatagctttctggaaacctgttgggagggtcagaagtgccagccccagctcgatttcatgagtcgtaattctttctatttctccctaaatgtgagggcatttgagttccgtaaaggagtcgactccaaatgtttcctgctgcaccacacacttgactaccattggtgacggtgacttagctatgacttgctgagtgtagcgtttctaaaccttactaaactctgggttttatttttcccctttttatgcttacaaaactgaaattcaaagaataaaatgccttgtctcattgccacacagctaagtccatgcgggaggccaattcaggtggtctggctccaaaaccagggctcttcccatgatttgcccgctgtgacaccaggttggcaactaggaaatgtacaagcaggacttgacaaatgtaggagcaaatatatggtaaggataagtatgaacaccatcaaaattagccagttactcatgtaatagaaataaagtgaggagatcaacaaacaaggactgacatggctggaaaagtttcacgggggatagcaaggtcaaccaaggggatttgattattaagtaggaatcttcagtctttcttgcttttcggtttagtatctcccttaatttgatgagagtgattgtctcctctgttcaagaaacctgtcattttggtaaagtggcaaaaaacttggctttacaaggtgtgtgctcttgggaaagttagttaatgtccgtgggcatcaatttccttactgtaaaataaacatatcacctactttggaatatttttgcaagatttaatggggttttgtatgtcagaaattctcagtcatggatacacagtagaatcctactgtgacccatgctcacagtagaattacttgaggtggtttctaaatgacccagtccaaacaaattcaatcataatcagctgttagaagtaaatcatctagcctggtgcctgaaacatagaggccttcaaaaatattagctccccttccccaattccaaaaccagagcatatcattcacctgtgaattatattcttttggtagttaattggtatgtcttgatcaagcagggaggcgaacagacccataagagtgcagactctcacaaaccaagtgttgatatacatgctcatatagtacatgctatgtagatacagtgtgttgatgtagtcactatagatgagtttcggtggcaaatattatgtgaaaacggaaccctggactgctagtaatgagttctaatatttgcacaggagtttacagagcagtgtaatcttgtgaattaaataatataatcaagcccattttatagacgagagaattgaggattggatggtgaatgtaatcaaggttatctaactccacaaaatgaaaatatagcatagattcactgagccttcaaaatacctaccttagagttgtatggtttagatagagaatatacagctcctaccacagtgctaataagtaagtcatcaataaatgataacttgtaaagtcacgggcccaaattcagatctcatgccctttctatattcttcagtatctttggaaatatgatggagcttttcatttaagaggaattgatctatacttctctcaccccagaagttgtaacaattagctttaactgcataacacaccagtctaaatctgagtggcttaagacaacccccattcatgattatagttcatgattctatgagttaactggcagttctgctgttctggacagggttactgtggccccttatacagacctaacatgatccccatgttccttgcctcctgataatcatgcctttatgcaatccccttgtattacagattgagtatcccttatccgaaatgtttggtaccagaaatgtttcagattttagattgttccggattttggaatgtttgcattacaatggttgtgcatcccaaatccaaaaatcccaaattcagaatgttccaatgagcacttcctttgagtgtcatgttggcactcaaaaagttttggattttggagcattttgggtttgggatttttggatttgggatactcaacccgtacttttctactgctgtatgacaaattaccacaaactcaacagctgaaaacaacacccatttatgatgtcacaattctatagataagaagtcccaattctatagatcaaaaggtttggccaggttcaatcctggtaatcacggatatataacagcttataaacatcaaggagaaagtattttgaccttcattaaattctttttaaggcaagcatacctgtttaaactgatttgtctatagccagttggtttaatttcattgaattcttcccagagcctcaagataagaacccacccaagcttggtgcgttcttatctggagcctctgggaagaacaccttgatttgaagtcaagagccaagctggcttcttatctggaggctctgggaagaatttctttcaagtgttaaagataaataaaaatagaggctccagtttagatattttaagtccaaccacccatagccaggtagccaaaacttaagtcatccttatttccctgaaacacttgctctagacataaacaaaacacaaaatgtccttgacagtgtgagtcaatgaaattaaaccaatcagctatagacaaatcagcttaacagctctactcgccttaaaaagaatgtaacgaaggtcaaaatacttcttcctcaatgtttataagctgtactgtaactgctgtgagctgggcttcttgccacttttggttagatgtcttccagtttgtaaactgttctttgtatgcatgctaaacttttaaaaatttttaaagtttgatctgattttaacacagcgcattcagattgctggcaggatctatttccttgcagttgtaggattgaggtccccatttcttagattagacctacctggataatctccctttgtaacgtgttcataggagtaatgtatcatcgtattcacaggttctacccacgttcaaaaattgacttgcagagatttccaagttgtagtatttatgaaaagcaagagaaggagtcttattcccctgtgggtagcactgaaatcgggaaagaagccattggaaatataccaagatatgcaacaatgattaccactgagttgcaagatagggcaatgtttattttctttatattttatctggattttc

SEQ ID NO: 16 - DNA, 12776 bp, Homo sapiens
gagcaaaaccagcgacgcgtcccggacgcccggggacccctgtgggtctcggtttccttcgctgtgaccctgacatgtttccctccaccggcccgaggaaaccgtcgcttccagcctccaggtaccgtcacctctgcggggctgcgagcggaggaccgggacagagaaggagccggcggtcctggccagccgcgcggctcaaaacccgacggcgcggggactccgggcctggggcctccatggctgtggcctccttatctcccgggccggctgctccctacgctgcggggctgagggcactggggacccaggggcttctctggcactagcgaggacctaaccttgagtgaagaacgatgtcaagtgaaagtgaagaataacgggggtgggcgcgaagagaatggtcttggggcgcgcttgcgcctctacccgaggaccgaggtggggattcgacagacgccagcggtggggatccggggcgagaagccccgactttctgagtcgtgagccgcctccagtcgccccaggacgtaaccccgaggagctttcagacactggccgcgcctaatatcgctgagaaccgcgaaaaccggagttccggccgcctcccggactggcgtcccgaggccaggggacccgcttggggctcccggccgagccccgacctcggacgtttttccgggagccgcgagaggcctgggggcctgggccaggcgccgcggcgggcatcgatcgccggctcccagagagtggccccgcgcaggtggaggtgaccccgtcacctccaggagcgcccccaagccccggtacccgcagcgtgcgccctctcctcctccccgaaggttaagttcgtctttttcggttctcggttacgcatccccttggcacgcatgcccagccacaccgtgggcgaaactagagggcccgcgtcccctgggggctgccgcggggccccgagtgaggtgtcccctccgggccgggcccgagtcggaggccccctttgcagcctagaggagcgcggggctggcgctgcgcaggaaccgccaggccggggagggggccgcgcccgggcctgggccaagagcgcgcgtcccccgcccgggccctgcggccctccccaggtgtctgagcagagctgctgaagctgcagaaatgtgctggcgcctgtccaccgccgcacacaaaacccagccaaaagcggcgagaggaaaagcgaatatggcgctgctgaaaatggagactccgcatctagaaagtctttctttcctttcctcttttcgctcttacttcgtcgatcttttcccccttgccctctcacgagggcctcctgcgctttccttcgggtgttctctacccctcggcccctttcctgttcttatgaataacctcctttactcggttttccttcttcctttccactcccggttcctctttctccattttgtgtcacaggcgccttgcttcttgttccctttcagggcgcgcactcccccgcccggctcactttattttgtgtgtgggtggcggagcagggagggggtggcaaggatcgtgaggctaagtatcgagtttgtttgtttgtttttctttctttcttcttcttctttttaaaggtgttatcttaggagccaagcatctcctttggtcctgcgctccttcgcctagcgcctggtgccccccacccggctgcatccgaggcttgcgcggcccggtcccatcagccgagcgtcgcccgcccaggaggaggctcgggttctccgcagaagcgaatactttctctttttgttttaagttagaaccttgcttttgcagtgattcgttgctgtggcgtgattttaaacaggtgagaaatcggagtctcattttcccaggggggcttccaatgaggattttaagagaagcgtgcaaagaagacagcaatgtccatcttttttttttcttgttttcttttgaacagagggaacccccacgcgctgagatagttatgtttttaaggctaaacttttttaaaattagtttttcttttacacttatggctgacttttgatccttttaaagaaaggatgaagtcaaaacagattaatgcttttgaatacacaacgtccccacgtccccaaattgtggtgctgggatagttcctctaagatgcattctgattttgaagttcaaggtctctaagcgctgttaagcggaaccatgaaaaatacgttgctacattaaagataaaacagacggtgatactgactgcagaatcgtagtagaaactttttttttttttttgaggctgtgcaggatttgccttggttttattagggaacctgctaatagaagcaatttcaagtgacgggcttccctcagtaaaaagctggaagcaatgacatcttttctatctgagtgactctccttagtcgtggtaaataaataaataaataaataaatagatagatagatagataaataaataaataaataaaaattagtttacatgcagtgtttgaaaagaaaatgattttgcttcccaagtttttatgtgttttcttttttaccaactatatttcactttatttacaattgtcagtttattctcacaccttctggttagttttatcttctcaccatggtctgttagaaccccatcctcgagcaaaaaaacaaaaacaaaaaccacccccccaaaacaaacaaacaaacaaacaaaacaggtgttcatccctgtgagatgctaatgcccctggaactgtttgaaaagagcaaaattttgtaaggagattcttttcaaaaagtgttagagaagtattcttcaaaaacatcttagaatgtttccttaaaaaatttcctttcttggttttcattaattgcctttgattaaaattaggttacaaacatatcttaatttcagactgtttctttataaaagaaaggagaaagtaaataggtgttggcaaggactaaaccaatgcaactaggccctgttgagagcctaaatctgtaaactggtacccttaaaaaacatcaatcaacttgaggttcgtacaggtagttctttgactcaaacagttgatttttaaaagtcttataaaataggttaaaatgtgtttttagtccaggttcctacttctttgttatgcatttctcctcgtagataaataaatgaatctaacttgatgagtaggtagatttttctccagaagaactttctaaaaatgggcaaagttagggaagtgattaatacccttcagtttaattggaattattcagtgcttataccaagttaatcctattaagatgctatttcctgctcagggggataaattaagcacaacttagattattttaggtggacaactggtatatagtctaagcaatgggggctggaaaaaagtatctcttctccaaaaaatatagattatgtaccagtaatgttcaaagtactttgaggaagtgtattgatgggatgaatataaatcatagtgactgttgttaaggggtttacggattataaagagcaattgagcttcctttattttctcttatttagaaaacaaacattcataagaaaaaaataaaattagatcccttcttttgcccacatacaaattcagtttcagatcaattaaaaagttaaataagaaaaatagaattaaaaaaatattggaaggctgggcgcagtggctcacgcctgtaatcccagcactttgggaggccaaggcgggcagatcacgaggtcaggagattgagaccatcttggccaacatggggaaaccctatctctagtaaaaatacaaaaattagctggttgtggtggcacatgcctgtaatcccagctactcgggaggctgaggcaggagaatcgcttgaacctgggaggcagcgattgcagtgagccgagatcgcgccactgcactctagcctggcagcagagttatctctgtaactctccatctcaaaaaaaaacaaaaaaaattgaaaggaaatatagaatttgtagtatgaaaggatttcttaaacaaaacattaaaatacacaatccattaaggaaatgatcaattggatgacagtcatgctccaaataatgatatgttagtcaatacatgataatagtcccataaggttataatattgtatatttactgtaccttttctatgtgtagatgtgtctaattatacaaataccattgtgttacaattgcctacagtattcaatacagtcacatgctgtacaggtttgcagcctaggagcaataggcttgtaccatatacaaaccatctaggtttgtgtaattacactctatgatgttagcatgacaaaactgcctatggacctatttctcagaatatgtccctgtagttgagtgccatgtgactgtatataaaaatttttaaaaatactttttacatgacaaaagatatcataaaatgttacaagataaactgagaagatattttcaaggcatgtacttggtgaaggattcatattcaaaatgtataaataacttatatagaaagaatttactaatttatgtataatgaatttcataaataaaagatgtgggccaggatatatacatatgaagtgaaagtatagtactatcaataggatgaatacatatcaacttcaaaaaatgtaatttcctttgggatagaaagaaagaaggaaggagggggaataggaagagggcaacaacttcctgcccagggggcaacaactctttttttttttttttttgagacagagtcttgcttttgtcccccaggcttgagtacaatgactcgatctcggctcactgcaacctccgcctctcgggttcaaatgattctcctgcctctgcctcccaagtagccagttaaggcacctgccaccatgcccgtctaatttttgtgttttttagtagagacggagtttcaccattttggccaggctggtctcgaactcctgacctcagttgatccgcccacctcagcctcccaaagtgctgggattacaggcatgagccactgcgcccagcccacagcaattctttataaaaagatcagaggcaactatgggaagacattaacactttttgttctttgtagattgttaaaagcttgttataatttatttaaaaatctctaacatcaattcctagtctaaagaatgaacaaatgacacatttcttttccttagtcaataataatcttgtaagatggtgttcacgtgcttttctttgagggcaaagaaaacaccattccccagtgtttttcctgggcagtgtttgaatattatatgatactcacagcagagattttcctagtttggcttctgttgtaagcttgttttctgagtagatttaaatgagaagaacagaaacatatttgaaactatgactatgtataagagcatttattctcctataatgaaatcgtggaaaatgtttttaaaaagtgagcaaacaaaaacctccacaccattatagaaacacggttaaaaaactattgaataatctcaagcctagtgtgtaataattattaagtgtgtctaatttgttgtgctaagtgtcaggaattggtattgtggaaggatatgtgagatctcattttctccttttatatggcaggagtttatacagtatttacatctgtcattgatactttttatgaacagaagttttgtttacttataacttccacagggattattcatatggagcactggaaagatgtaacatttcatttgctttgataccttgtgtttattttaggtcgaaaagcatcatgaagccaagtggttattgttttgcttattcagtgtgaactgagtgagccaggtttgtataccaagtgattctcgtggtggacaataccaatatgattatgccaaatgcattgcttctgaggcatcactctttgggcacatatagaccctgctgatttctgccaaagcactcttcttaaagttccaaaacattaccccaaaacctctatagccccctattgccaacaaaattaaagcctttctcttcattggcattagaagcccctgtaacccattgcttttccatttccagcctctttccaaaattaccaaacaaactctgtatcctgcagccaccaaactgtactagttgtaatatattcactaagaacagtggtctctcatttgtctctcttttctctcttcttatatcagttagaatgtaacagacaacccagctaacacagaggctcatttttcttatgtgacaagaagtctgtagataaagagttgctagtgttttcttgggggttcagtgatatcacctctgtgattcagttgaccttcatatcatagttgcaaaatggctgccgtaagtacaaaaaccacactgactgctgggtgggaaggcaacagaaaatttgttcttggtgagtcttactcacgtcaaggaagtataatattttccaaaatgccccaccaaaggatttcctcttacatcatattagccagaactgggacatattatcaccctttatctggggtagaggcccacatttccacatcaaagggaatttgctcaatgcctaaatcaaactggaattcagttaagcaaagaagaaacagaggaatggtttttgggtaggcagtaaacactgtcagctacatctccctgaaagccatcactcccttaaaatatctttgcgtaatgtcatcagttacttctgaactttttcatccaatggacagtgtttattttctaacttacttgaactttttgtggggcttagccacaccctttttgaaatttatgtattcatcaaatacccactcatcacttactgtgtattagtcactctgctgggcaaagagaatgaaaaaatgagtcatgcatggtcctgaaccttcacaagtttatagcctagtggggcagacaggtgaataaataagtgcaaaagaatgttatagatactgtgataaaattatgtttcgtgggccgggtgtggtggctcatgcctgtaatctcagcactttgggaggctgaggcgggtggatcacctgaggtcaggagtttgagactagcctggccaacatggtgaaaccccgtctctaataaaaaataacaaaaattagctgggcgtggtggcaggcacctgtaatcccagcgactgggaggctgaggcaggagaattgcttgaacccaagaggcagagattgcagtgagctgagatcacgccattgcactgcagcctgggcaacaagagaaaactttgtctcaaaataaataaataatatgttttgtgggtttttttttttttctttgacagggttcttactctgtcacccagcctggagtgcagtggcacgattatagctcactataacctcgggctccctggctcaagcaattctcctgcctcagcctcctgagtagttggaactatgcaggctaattattttatcttttgtagaaatggggtcttgctaagttagccaggcttgtcttgaactcctgagctcaagcggccttcccacattgacttcccaaagtgctgggattacaggcatgagccaccatgccgggcttagaatgatgaatgagataaaatggggtacaaagaaaggagcagccatttctggatctcaggtgtgatgtctcttttcagggaaggacaggggtgatacagccattaataaaagcaatctcactttcctggttggttgtctctttgcctcctcccctggaataatacagacctctgtagaaaatcacaggcagggtagggatgacggagctggcctcctcccttcccttggcctgacaaatatgcatggaattcccaggaatgttcaagctttttttttttttttttccaaacttcagattagaatccaactcatgtagaatccatgtagaatccgactcaaacagaatccatcaggcatgagaattctggaatgcccttcctggtttatctacttcatctgtgttccatgaagggcacctggtctcacacctagactccgggagctccaggtccctactctcttaggtttcagggcctaaccaatcaggatggcaagaaggatgtatttggggagatccaagcctgtctgcttggctgtagtgtaggactggggggaaaagaaaggcacagtaaggatcaaaacaaggctggagcagtaggtaaagatgagttcatgccaacgtaggaggcttgaagatgtttggtaagtcataggttcccaaactttccagctcactgcatctgtagcatcttcgtaatttgttcatggtgccctcagccagaagacatacttcacaattccattcgttaagtaggtaagtctaaacaacatattagtggtcatttgtgaggtgtttgataggtggggctgtatttctctcaaacatttaaaatatcccacagcaaccttgtgagtttgttccctgtggtgtcccagggtgacctgatgggaaatttgagaaccatggtataggtcgctaaagatttttcatctggtgaattaaatatttgattttgtatttgagaaagcgccatctttctgtagattggagtaaaggcgtggtgggaggtaaggagaccataagttagtggtagtcatttaggagagaagtgatggggatataaaatgagacatactaatgagcatgctgctggatctaaaatatgttatggaggtagaatggagaggaggatttccttatcaattggtttttggagagaaagaaagagagaggttgattcctagactgtgggcttgggttaaagggtatatgatagcagacatgttgaaaaaacatatctttgggagaaagaataacattttttggcatgctgaatttgagacgtgcaaggatgagatggatatagggcattggagctcaggagcagatctgaaaaatataagttaattatgaatatatagattagggctgacaacataagagtagacgaaatggctcaggatgagtgtagaatagaaagaagcatgcccatatgtgatggtcaattttcttttaattttaatttttgtagagatggggtctcactatgttgcccaggctgatcttgagctcctggcctcaagcaatcctcctgcctcagccttccagagcactgggattacaggcatgagccaccatgattggtctggattccttataaaaaatattataatgagtacatcatgtttagagagccaagaaagggcagggtcctgcctaggagacagagccaggacaggtatcatgaagcttgtgtaaagtgatatgttttgggtggagccaagactcttcccctactgttgttctgttcaatagagaccctgggtctttctttttcgtttgtggtggcgccccctggatagagcctcagagaggcagcatcacaaagagctatgcaaggaattggttctgcaggggagacagtggagggcaaggtgtgggggactgcggggaggaggagggggtaggggagaggtggtagcacacagtgcgaggattctgtgccatgccagttcagccttatgttcaaagcagctgttctttctgggcttccaagagaggagcaccatttttatgcccacattgtaacaaacaatgagatatgtactggttaacagtatcaaatgcaatgcagtgattaaataaggagtggagaaaatctatggaatcttacaatttggagggccctggtgacttatctaaataccttttttgcaatagagcaagtcagaaccctgaggatctcagggattaacaagggagacagccatgtcaaacaaacaaaaccaatgcactgtgataaggtgtaaggcttaatataaggtgggataactttctctcacctctctcattcactaatcacttcctatcagcacctgtcactggtaggtggtttctgatgctccgaaacgcccaggtgcgctggcttccagcctagctcctctcctccctctgcgtgttcttcctgagcaatttcatccaatttaactatcacctgtagaccagtgatttctcaacctgtatttctagtttcctgacttactgagcttgagttcagcattttgaacaatggccatagtactgggcacatggaggtactcagtaaatgtctactaattcacttaaaagttgatcctaagtaaactgatgatgtaggagtaaatttggatctcaagtaaactgaagtttacacagtgagtaagcagggaaatactttccaatagatttgacataaaacttcaatttcttttttttttctttttcttttttttttagagacagggtcttgctgtgtcacccaggctagagtgcactgatgtaatcatggctctctgctgcagcctctaacccctgggctcaagggatcctcctgcctcagcttcctgagcagctgggactacaagtgcagtccatcatagccaactaatttttttttttttttgagatagggtctccctctgttgcccagactggagtgcagtggcatggtcttcggtcactgcagccttgatctcccaggctcaagtgatcctctcacctcagccccctcgagtagctgaggctacatgcacttgccaccgtatgtggctaatttttgcactttttagtagagatgggatttcaccatgttgcccaggctagtctcgaactcctggattcaagcaatctgcccacctaggccttccaaagtgcttggagtataggcatgagccaccatgcccagcctgcccagctaatttttaatttttttgtagcgatggagtcctgctatgttgcccaggctggtcttgaacttctagcctcaagtgatccgtctgccttggcctcccaaagtgctgggattacagtcatgagctactatgctgggtctaaaacctcagtaattaaccggaaaccagatgagagtttcactatgggaattgggttaggtgcagctaatcacagtgaagaatagattaaaatacatggatttgcaaatcagaatgcaggttctgctgctaactttgggaaattcagctaattctctgtgtctttgtttctatgctagtaatgctttattttaaaatgtatttatggttattaagatgtaattcacataccataaaatttatcgatttaaagtgtacaagtcagtgtatttacagactcatgtaaccatcatcactaattccagcgtgttttcatcaccctaaaaaacaccctcatgccctcattccccattccccattaccccagtttctggctactgctttctatctctatatatttactatactgtacatttcatacgagtggcatcatataatatatgtccttttgtgtctggctgctttctcttaagcataatgtttaaccataaaaaaagttagcataatgttttcaagattcatccatcttacaccatgtatcaatactttgttcctttttatggctaaataatattccattaattggatgtatcagattttgtttattcatcaattgatggacatttgcattgtttccatttttttgctattatgaattatgctgctatggacagtactgtatgtcctgcatggacattacagaaacttttctgtgtggccatatgatgactcaatgtttgacatcttgaggagctaccagttgcttttctgagtggctgcatcactctgtattcccaccagcactgtataagagttccaatttatccatgtcctggccaacactggttattgtccatcttttttattgttgccatcctcattgatatgaagggacacctcattgtgatttgatttacatttccctaatgactaatgatattgagcatttttttcatgtgtttatttgccatttgtatatcttctttagaggaatgtctacaaatccttttcccacttaaaaattgattatttttctttttattgttgcattttaagaattctttatacattctggatgttagaaccatatcagatatatgataggcaaatattttcttcaattctgtggtttgtattttcactttcttgttagtatattttgaagcataaaagtgtttaattttggtgatgtccatgtccactttattttttcttttgttggttgtgtttttgttgtcatatctaagaatccattacccaatccaagatcacaaaaattaaggtctgtattttttctaagagttttatggctttaggttttacatttgggtttttgatccattttgagttaatttttgtatatggtgtgagttagggatccaatttcattctttgcatgtgtacatgtagttgtcccagcaccatttgttgaaaagactcctcttttcctcttaaattgtcttagtgcccttgttgaaatacattggccatagatgtagggactcccaattctactccattgaacaatatgctcatgcttattctagtaccacaactataatcccagaatgaaaaggtgaattacatagaagaaatttctattctcaaattacttcataactcaaaagacttgtgggcaattcagttctgggttttctttcatctctcgttggaaaaaaaaaatctctgcatcaaccccatctaaaataactaaattgtatgcataaacctaaatttaaatactcatctgcaggtctcgtttatagaatcctacttatgttgatgatgtgggctttggcaatctctttctcactgtattctatgaaatagcttaaaaagtcaattatgaattgaagcattcaattattagaatgcataatactagtttaatttaaaagttagtcttcagtttcatgcaaaaccc

SEQ ID NO: 17 - DNA, 2376 bp, Homo sapiens
ctccgcttccagcgtcccccagaacgcggagaggcagcctgagtcttactctcccaccacatcaattcccagcaccgtgggccccggggccactttattttttgtatttttttgagatggggtgtctctgtcgcccaggctggagtccggtggtgcgatctcggctcactgcaacctccgcctcccgggttcacaccattctcctgcctcagcctccggagtagctggggttacaggcccccagtccactttcttggagtctgctgtgtctgaccaaaaagcccatcttcgccacatctaaagctggaagttcatttgccagcgttgtttagagcaaaaagagatgggatctcgttattttgcccaggcttgtctcagcctcagtgatccattcacctcggcctcccaaagtgccgggattacagatgtgagccaccacagtcatctctctggcagctttgaaagcctatatcgcctgtttacatcttgtcagctacagcatctgaagtgttttctttcaaggagtatccaccttttgagatggagcccaccaactaatatggaagctgaaaaatgaccagctcttgtctcctcaaactccctggcagctggggagtatagatacacaatcgggttctgccagcccaacagacccactcctgcaccttgaacctgctgggctgctgacctgagaagcagggccatgcggaatccacagagcaaggtgggggtgtccaagggcacgtgcagccaaggggcacgtcattgctgcagctacatctggtttcaaaggcagtcgtttttaaagtgcctgcgactgccggcaggaatgtaaattagtacaacttttatggaaaacaatatggagatttctcaaagaactaaaaatacagctactttatgatcagcaatcccattgctgggtatctaccaggtactgggtatctacctaaaggaaaagaaatcattatattcaaaatctctgcactcatgtttttcacagcactgctcacaatagctaagatagggaacccacctaagtgtccatccacagatgaatgtcttcatatacagaaaatgtggtgtatgtacaccaagaatactactcagccataagaaagaatgaaatcatgtctttggcagcaacatggatagaactggaggccattacactaagagaaataactcagaaacagggagtccaataccgcatgttctcatttataagtggaagttaaacagcgggtacacacagagacacagtgtggaataacagacatcggggactacacacggtgagctgatagaagggggtgagggctgaacatttactactgggtaccatgttcactgttcagatgtcagggatgccaaatcccaggctccaccgctatgcagtatctgcatgtgagaaacctgcccctgtactccctgcttctataaaaaaattaataaaaacatgtttaatatgtaattttgaaaaataaaaaattttttaaaatgtgtcttacgtggggatatcagcagtgcaagccaccatgtctgtgcccagcagcagcagctgtgaagtgttcactgttgggaaaaaaacttctccactaccaacttagttccgccgactgggggcctgcaagttaactgatgatagattaacaggagaaacatgcattgcacctgcaggagtaccctgtagagagagcagctcccagaacgtctgggagtaaagagcatacattagcttaagtaaggaatccggggtatgttagggcatgaaaggatggagggttctgatgaggcttgtttatgcaatgtttttagaatggactggagcccacggtgagtgccactctgagtggagaccaggggtaggggcagggagcagctgcggtggccgaccctctaaaagctctgcactagtcagataagagaatttcagatatgatttctttctgcatcttctgaagctcatatgttgtcactttgaagtaatttctgtaccagtttgggaggttgttggtctcttcatacttaccttgcagtgggatttggaacactcttagtggcacagttttcaattctacaggctctcctattctgtaagttcctaaaatatttttacgaatatggtttactatacaaataatttatttgctttcagtagcctttatctctgaaaacaattactgcatttaaagacaaattgaaggcatgtaatgacgaaaatttagaagcacttccattataatcagaaccagaacaaggatgattactatttctgttcatatttaacattatcctaggtaatgtccttgacaagaacattttaagaggtaaaataatcacaaatgaagagacacaggcatttattatttgcac

SEQ ID NO: 18 - DNA, 5677 bp, Homo sapiens
caagattaaaaagggtggggaaagtgatttatctcagggtagcttcctagcttctgctccagatctgagtgtgccttcaggaaagaaggaagaggccttgggagaacactgagtcttcaggaaagagtaactatttgtctgtcttttttttttcttttgttttctttctttctttctttctttctttctttctttctttttctttctttctttttctttctctttctttattcctctctccctctctctctttcttcctttctttttttttgatccagcgagacagactggattttttcttctaatttttttttttaatgaaacgtatttcccctgagtctcagcagcagagggccctggtccttgagtcacttccttgttgcagttctgaattcattattttattatagcttttgaatgactgatacatggtaggctctgatcaaccaaaaggttcccaataaggtgaagagaaagaaaaggagtttgatagttttccagattccaaaaaaattagctttcacaagttgccaggtgtcaagaatctgaacaggtaaccctctctcagcatatctcatctgtcagcaatggcttgtgaagatgcatgtgtaaacagtaggaacacagacttctgggagacagtacaaactggtgctgctgtcatttggaaccaactagaacatagctggcaaccatttctcctgtttcctttcttccactggcttcactttttttttttttttttttgagacagagtctcatacttgttgcccaggctggagtgcaatggtgtgctctcggctcaccacaacctccgcctctcttggttcaagggattcttctgcctcagcctcctgagtagctgggattacagtcatgtgccaccacacccagctaatttttgtatttttagtagagacagagtttctccgtgttggtcaggctggtctcgaactcccgacctcaagtgatctgcctgcctaggcctcccaaagtgctgggattacaggcagaggccttacatttttcactgtttcaatcctaacttcccacagacaacttcccagtaccacaaatattccccagcttcttccagtaccacatgagaaatgggcaatcttttttttttaaccacagataaaatatagtggataacaatgattagcatttgctaaggccaagccctgttcttagtgttttatgagtattatctcattgacttcctccaacaaccttcctgaaagatataattattatatcctaattttatagctgagaaatttgaggaacagagaggagagtaacttgcccaatgtcacacagctactaaagagcagagctgggatccaaaactgggtctgactgcacaacccatgcttttttaacctcacagttccgccagcgggccaagattttaacatctacgaaatgctgttaagaagtataatagttaggtttttatttcctttctcaatgttatatccccacctgagtagaaggactctgctgggtactataccaaactacctacctatttatttatttatttatgtttttttgagacagactctcactctgttgcctaggctagagtgcagtggcgcaatctctgctcactacaacctccatctcctgggttcaaacctccagagtagctgggattacaggtgcacaccaccacacctggctaattttttgcacttttagtagagacagagtttcaccatattgaccaggctggtctggaactcttggcctcaagcgatcctcccatctcaacttcccaaagtgctgggattacaggcatgagccaccgggcccaattatttaatcctgattatgtaagcagtttgaaggaaaactacagtgttctttgatttagaatagaaggcaggaaggccttccctgaaaaagtgacactgagctgagatccaaaggataaatagaaattgaggatgggggaaagcatacccagcagagggaacagtgtgtgcaaaggctctgagaaaggagcatggctcagctgaggaactgagaggccagtgttgttgttatactgagaagaagaaggaagtatctttattcaaaaaaaaatttttttctagacacggggtgtcactatgtagcccaggctagtcccaaactcctggcctcaagcaatcctcccacctagcctcccaaagtgctaggattataggtgtaagccactgtgcctggccagaagcatgttaggtactatagtgagacaggaagataatgccaggcctgggaggctgtattaagaatttaggtctttatcttaagaatgaagagaaagattttaagccttcaagtgatcagagttgcatttttgaaagatttcataaagctaggaggagaaagaattagaagggtctaggggatttgggtagcccagtctggagtttattgcaactgtgtagggaagtgatgatggtggcttgaaccttggataagacacaataagtgtgtggctcacgcctgtaatcctaacactttgggaggccgaagcgggtggatcacctgaggtcaggagttcaagaccagcctggccaacatggtgaaaccccatctctactaaaaatacaaaattagccagtcatggtggtgcgtgcctgtaatcccagcaacttaggagactgaggcaggagaatcacttgaacccaggaggtggaagttgcagtgagccaagatcgtgccattgcactccagcctaggcaaaaagagcgaaactccatctaaaaaaaaaaaagacacaataaatgtgaagttgactgagctagggttcctggccttggagacagtccagtaggggagagcaacttagaaataaaaatagtatattgtgctatgagcactactagaggtaaacccaaataactctggaagctcggagaaaagatagagggaagatggaaaatgtattagttatctattgctgcatatcaaattaccccagcatttagcagcttaaagtaaaaatgataaacatttactagatcacagtttctgtgggacaggcatgttggcatggcataggtgagtgtttctgatttaagatctcccacaagattgcagtcaagctgtcagctgccaatcccatctgagggcttgaatggggggagatccacttccaagttcactcatgtggttgttagaaggccttgatctctccctacataggcagccctctccccagggcttcctcacaacatggccactgacgttccgcaacgtgagtgaccaagaaagagagcaagagaaccaagagtatgtgagagaaagcacccatggaaagaagccacagtctttttgtaacctaatctcagaaatggtcttatcacttctgccatactctatttattagaagtgagtcaataaattcagtccacattcaagaaaagggaaatacacaaaggtgatgaatacacaaaggtgtgaatagcaggaggtggggatcattggggttcattttagtggctgcctaccacagtaggttccacagaggaggcagtacatgagtagttgtattaaagtttttcaggagcatttcaggaggaagggctttccaggcaaagcaaaggacgtgtgcaaagatacagaggcatggaagaacttcatgtgttcaggatacgctgttggccattctgtgaccaggcgagaggggcttggggagtataattgattcagctgagcaaatttgaagaggaggtaaagtatcattggttgaaagatgatacatttacttctttgaattctaccagcatacctgcatctttgtgaaaaatatatacatacgaatatattcattaaagcatcatctttatattagtttgctagggctgccataacagaggaccacaaactgggtggcttaaacaacaaatttattgtctcagaatgctggaggctagaagtctgagatcaaaatgccagcaggattggttctttctttttttatttttcacacagggtctcactctgccacccaggctggagtgcagtggcacgatctcggctccctgcaacctccgtctcctgggttcaagcgattctcctacctcagcctcccgagtagctgggactacatgcgcgccaccatgcccagctaatttttatatttttagtagagttgaggtctaaccatgttggctaggctggtctcaaattcctgaccttaaatgatccgcccaccttggcctcccaaagtgctgggattacctgtgtgagccactgcgcctggcctaagattggttctttcggagcacccaacttctgagggttgccagggaaataatttgttccaggtctctctccttgacatgtagatggtcattgtctcctgtcttcatattgtcttccctccttaaatgtctctatccaaatttctgcttctttaaggagaccagtcatattggattagggcccccactaatgatgtcattttatcttaattactttgtaaagaccctgcctctaaatgaggtcacattctgagatattaagggttagaaattaatcatatgagtttggggggagggtacacaattccacccatatgttccatgaaagggctatatatgcaaagcaacctgcagacacaaaaggaaccaagaaaccaaagaataaggaagacaaatctggtttgttggtatagagtattttattagggagcttacggacaaaagtatggtcttcggtggccacaagacaggtagttcttcacaccacaaaccccctgatccagggcttatattttgaatcatacatgctctgggagaaatgtgtagatggttatggacctcacagcctgtgatttatgcaatgacatcaggggtggttttgaaggaaagacaaaacttacagtgaataggtgtttctacataaagagtaataactagacatcttggaggtattcctggactgggggttagtcaggagtcacatggcagattagcatctaaaatacagtcactcttgtccccacaccataaaaatcatgtgatgggaaaagagtgaaaacaactaaatgctcatcaatagggaatgggtaaataggttatggtatatcataaaatggaatactatgcagctgttaaaaagatgtactgataagaatattttccattgtggaataatctccaatatattttattaagggaaaagggcaagttgccaagtaatctatggcatgccagtatttatgttaaaaaatggaatgtgttgtaatagcataggatatctctggaaatatacacaaatatacacaagaaactggtaatagtggctacatacgtaaagaggaactgggagcctgagggtcagcaataggagggagcctttttactatatactcctgttgtacaggttgactttgttaccatgggcatgtattactttcaaattaaaaaagaaagaagtaggtgcagcaaaccaccatggcaaatgtatacctgtgtaacaaacctgcacgttctgcatatgtatcccagaacttaaagtaaaataaaaaaagaagcataagggagcttggtaattttggtatgaagtatatttagtctgaacaaaactgaagtttatgtctatgtttttaaagttgatgttggctgggcgccagtggctcacgcctgtaatcacagcactttggggggccgaggcg

SEQ ID NO: 19 - DNA, 2145 bp, Homo sapiens
acgtgaccttcgaccgatcggaagtgggggcgggacggcagcgccggggtgggctcagatcgccaggcagccgtgggtctccagggtccggtcgcgacccttcccttcccgggcgggatttggtccaggaccgtcgatggcgtcttgacaggtccccgaggcttggatgtggtcccgaggtgtccgctgtcggccgtttggaatctcagagggactgacgtggctctcccaagacggcaccccgaacagtcgtggttcatcaaaagcctggtcctgggtagcccctccctgaaatggctgttggttgggaatttgggggctgagcgctttgaaagggcattgggacagcatcacagaatgtcagtgtcccacatttgcgaggagtcccgggccccagttcttacactgcagtttgcatgaggatgggccaccgccacttccgcctggggttgtctggtgatgcccccaggagagacgcgcccactgaaaagccagcgtggtgtcctcttacacggtccttaacaaactctgggactctgggggtgcaggaaataccacaggaccgtcattactcccataccggctgagtcacaactgtattgcaggaggcttcttggaacgcctatgtaactttaatggaagtgaccaggtacagatcttctacagcaaggaaggaatcttagtgctagaattcagttgagcctttgagttggctcttcttataagtgagcaaacaagtaacaaggtttagggggcgcccatttttgtgttagcacgattgccctcgtgtttaatatttcccaagccctattatgataaggagttggacttaatgaagaaccatgttgtcaaacatcttatgcccatcttgaagttgtgaaggaggatgagcaccaagaaaaggaaataaataaaatccaatacgggccgggtgcggtagctcacgcctgtaatcttagcagtttgggaggccaaggcaggcagaactcttgagcccagaaattcaagaccagcctaggcagcatagtgagaccccgtctctacaaaaaatataattagctgggcgtggtggcaaacacctgtagtcccagctacttgggaggctggagtgggaggatcacctgagccctggaggtcaaggctgcagtgagctatgatcacgccactgcagtacagcgtgggtgacagagcaagaccctttcttggggaaaaaagtcccatataactttccttgatgaccccaccctcacccctcactgtgtcattatgccaagagagctttgggcattctaaagaagtatgaggaatacttgaccaataaccaaagtatagttatttatttgttaatgacttctttcctagactgtgagttactttagagcagagacttatttttccctgtatccctagggtgtggcacatagtaggtgcttagtaaacttattttgcattcaataatgccaagtagaataattcatagattatggcaaaataaaagaatttggcaaaattgcaagattgaagattgctttcagaaaaaatgttccaacccctgttcaaaagtacatagcttgctgtgttgttgaagtgccagcacgaggaggaccatgccaacacatccatttattgcccattctgggtgtgttgagcgttttaagtttgctatgcttgtaaaaatcaaggaatggcaatggtatcaactttcatgaacacagtcgttcagctgaaccaagtatcagtgataacttctgttttgaattttagaaatatatctctgaggttagaatgttgattcatgcatattccagctggctttccctatgagtataaatagggaaaacaaggctattggcccaaatgtaagttgtattccaaggtttggtccaaagaccagagaatccctaagtaggaagacagttttgttttcccctcttttactggttaactttgagcaggtcacttatatttgggggcacagaagatgaagatgaccctgagcttgtcatgttcactgttaattgttctactaacaccctagacttcatcatcttgttatagcacttatcacagttgcttttaaatcatcatgcagttatatgtttattgtctgccttttccactagaataaagcctctgctgacataa

SEQ ID NO: 20 - DNA, 4249 bp, Homo sapiens
gtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccagtattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatgtaatttcaactattttgtacatttaaatatgccatgttgtatatgtctgtatttaaaaatgttgtaaatacctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtg

SEQ ID NO: 21 - DNA, 7614 bp, Homo sapiens
gaacatttggacacaggaaggggaacatcacacactgaggcctgtcctggggtgggggaaggggggagggatatcattaggagatatgcctaatgtaaatgacaagttaatggatgcagcacaccaacatggcacatgtgtacatatgtaacaaacctgcaggttgtgcacatgttccccagaacttcaagtataataaaaaaagaaaaaaaaagaaactcagtaaaatgaataaagcagagaaaataatcagtgaaattgaaatgaaacagtagaaattacctaaactgaaatggaaagagaaaataaactaaacattaaaatgaacagagccttagagaaaagtggaagctataacaaaagatctaacgtttgtattattgaagttctgaaaaaaaaaataggtaggaggggctgaagaaagagttgaatgtcataatgactgaaaaaaattccaatttggtgaaatatataaacctatagtatgaagagctgaattaaccccaatcaggaaaatctgaaagaagtggacactaagacacataataatcaaatttctaaaaactaaaaacactgaaagaaaaccttgaaaacagcaagagagaatgagaacttaaatatagaagaaaataattcaaaacacagctgatttataagccaaaacaatggaggccaataggaagtgagatatttttcaagtctgaagctaaagataaccataattctataactagcagaattatctttcaggaataaagggagagtccagacatcctcagattaagaaaaactaagtgaatttgttgtcattagaacaatcttttttttttctctttctctttttttttttttttttttttttttttttttttttgtcacccaggctggagtgcagtggcgcgatcttgaccactgcaagctctgcctctcgggttcaggccattctcctgcctcagcctcctgagtagctgggactacaggtgcccaccaccatgcccagctaattttgtgtgtgtgtgtgtgtgtgtgtgtgtgtgtgtgtgtgtgtaattttggtagagacggggtttcaccatgttagccaggatgatctcgatctcctgacctcgtgatcctcccacctcggtctcccaaagtgctgggattacaggcatgagccaccatgcccggccagaacaatcttaaataaatagctacagacagatttctaaacaaaaaggaatgaataaaagaggaacattggaaaatcaggaagaaataaaaagtggaaaaaggaaaaatacaatcaaatacatacattttattatccttttgatttttctaaataatgttaggtacttaaaaaaagtgtgatactatatgatttgactcaaatatatttagaagcagtatttgaaacaattataaatggtggaggataaaagatggtaccaggatataaaatttccaaattttactcaaattggtagaatgctagctctagtagacatgacaaattatgtatatataatgttttaccaagaacaaccataaaaaatctatataaattcactcaaaagcactatggataaataaaacagaaatttaaaatattttcgagaatctctttttgttaccaacaacaggccattttggttactgtggctttatagtatagttaaagttgggtagtgtgatgcctccatctttgttctgtttgcttaggactgctttgctatttgggcttcattttggttccatatgaattttagaatagtttttttctaatcctgtgaagaatgacattgatattttgatgggaataacattgaatctataagttgctttcacaagtatggccatttacacaatattgatttttccaatctatgagcatagaatgtttttccatttatttgtgtcatctctgatttctttcaactgtgttttgtagttctctaactggctagccatatgcagaagatagaagctggacccttactttttaccatatacaaaaattaacccaggatacattaaagatttaaatgtaaaacctcaagctataaaaattctggatgacaacctaggaaatacacttttctacattggccttggcaaataatttttggctaagtccccaaaagcaattacaaccaaaacaaaaatagacatgtgggacctaagtaaactaaagagcttctgcacagcaaaagaactatcagcagagcaaacagacaaactacagaatgggagaagggagaagacatttgcaaaccatggatccaacaaaggtctaatatccaaaatctatagggaatgtaaggaaatcgataataataataataataacccccattaaaaatggacaaaagacatgaacaggctcttttcaaaagaagatagacggccgggcacggttgctcatgcctgtaatgccagcactttgggaggccgaggtgcgtggatcacgaggtcaggagatggagaccatcctggctaacacagtgaaatcccatctctactaaatacaaaaaaattagccaggcttggtggcgggcgcttgtaatcccagctactcgggaggcggaggcaggagaattgtgtgaacccaggaggtggagcttgcagtgagccgagatcccgccactgcactccagcctgggcgacaaagcgaagcgagactccgtctcaaaaaaaaaaaaaaaaaaaacaaaaacgaaaaaagaagatatataagcagccaacaaatgtatgaacaaatgcccagcaataatcaccacagaaatgcaaatcaaaaccacaatgagatatcatctctcaccagacagaatagctgttattaaaaagtcaaaaaacaatagatcttgatgaggttccagagaaaaaagaacacttatacactgtcggtgggaatgtatattagtccagccactatggaaagcagtctgaaggtttctcattgaacataaaacagagctaccattcgacccagcagtctcattactgggtatatacccaaaggaatataggtcattaaaccaaaagacacatgcactcatatgttcaccactgctcttttcacaatagcaaagacatggaatcaacctacatgctcaccaaggatagattggatgaagaaaaattgatgcatatataccatgaaatacgacacaagccataaaaatgaataaaatcatgtcccttgcagcaacgtggatggagctggaagccataattctatacaaattaaagcaggaacagaaaatcaaataccacatgttctcaattactaatgagagctaaacattgagcacacatggacatagatgtgagaacagtagatactgtggactgccagtgagtggagtgggaaggtgggttaaaaaaccaccaatcaaatgctatgctcattaccaaggtaatggaatccatactccaaacctcagcatcgtgcaacattcccatgtaacatatctgcacatgtactccatatatctaaaataaaagttgaaatttaaaaataaaatactaataattatacttcacagaaagtatataaattaattttaaaatctcaaataacatagaagaaagcagaaaaaaagagatacaaaatagacgagaaaaaaattaaaatgatacataagctctacagtataaataatttaaatttaaatggtctaaatgcacaattaaattaaagaaattgatggtgtagatttaaaaaacaggacccgagggtatgctttttataagaaacagccttcaaatataatgaggaaagttaaaagtaaaaaaatggggaaaaacatatcatataaatattaatgaaattaatcaagagtgattacaataatattaccaggatagagtgaaacattatttaatgataaaaagtacaattcaccaagaaaagtagcacttctaattatgtatgaatcaaacaatagagctgtaaaatacatgaagcaaaaactgacaaagctgaaaagaaaaataggaaattacactattacagtggaaaactttaacatttctctctcagcaaatgatatagaaattaggcataaatctgcaatgataaaaaactcaacacatgattaaccaaaaggatctaatcaacagtagacaatgaataatacacagtattttcaactgcctatataaattatactaaattagactacatcctggaccagaaaagaaacctcagcacatttcaaagaattaaaatcatacacagtatagtctccctctacaatggaatcaaactagaattcacaaacagaagagctagttatagtggcatgtgcctgtagtcctagctaccagatcagctgagagaataaatcaatgaaattgaagagagaaagaataatagataaattaaaatgaatgaaaatatggctctttaattatcaataaaattgacaaagatctaccaaaatgagaaaacaaagagagaagacacaaatcatcaacattaagaatgaaacagaggagatcactgtggactccacagatattcaaagatcaattagaaaatactgctgataaacttacacacatgaaatttgaaaacttaggtgaaatttaccaatttcttgaaaagcaaaatgtatcctgactcatctaatatggaataggtaatttgaatggtcctgaacaggtaattaacaaaattaaatatatgtattttttctaattaaaaaagataatatccaggctcagttttcactgagggtttcttacaaatattcagagaagaattaacataatctacacaaataattttcaaaaaatagaaggcttcccaactcttattataaagttaatattacctgataccatgaccaaaaatagcaatgaaaaagaaaactacggatcaatataaatgcaaaaattcttaacaaaatattataaaatagaattcagcaatatataaaaagaattgtatacaatcttcaagtgagttttactgtagggttgccaagatggttcaatactaaaagatcaatgtaatccaccatatgaaaaggtcaaaaaagataaatctcatgattatatcatttgatgcataaaaagttttccaagattcagcactcatttattataaaactctgaaaaataacaggattagcttcctcgcaaaaatcatttatgaaagatctacagcgagttattacattaaataataaaagattgaatgtttgagagcaacacaagggtatttaccatcactgttgctattaaacatagcaatggaggttctagaaagagtaataaggcatacgatggatatcaattgttaacacatttgaaagaaacaaagctgtctctatctgcagatgggaaaaggtatgtgtaaaaacctatgaaaaaccaacagaaagaaaataaaatctggaattaataaatgagtttattaaggttacaggatgcaagaaaaatgtgaaaagtcagtcttattggtatatactaacagtgagcatctggaaacccaagtgataaacacaacatttacaattacagaaaaactgaaatgctgatgtgttaaactttataaaacctaaacagcacctctagctataagtttcaaaatgcacatgaaaaaaataaagatccacaacctacgtaaataaagagacatactatgtttgtggattgaaagactcaacattgtaaagatatctattttcccaaaattgatcttcaggttcagtgcaattttaattaaattctaggagggtttattttattttattttttagaaatagacaagcgttttataaaatgtgtatggaaaaaaaaatatactcaaatatctcaatcatgaacaagaagaataaagggaattgttctacctgattacaatacttattatatacatacagtaatctagactctgtagcattggtggaaagatagaaccataggtcaactgaatagaagaataccatgcaatggtcccatgcaagggtgacttactgttttttgacaaacccacaaaaacaattcaatggaggagaaatagtcttttctataaatagtgctgggacaattggctatttctatagatttaatgtttatgtcttcaccacactgatatatttaaacctaatccacaatgtaatagtatttggaggtggggactttggaaggtaattaggtcatgaggtctgaaccttcattcacaggattagtgcacttataaaagggtttcagagggccccctcaccttttctgccatgtgaggatacagtgagaaggccatctatgaaaatggatggaggccttcagccactaattctacaagtcttaatttttgacttctctgcctgcacaactctgagaaacaaacttctgttgtttataagatactcattctacagtattctaacagtctgagaggactaatacatatatccttaggcaaaaagaattaacatcaacctaatcttcacacattaaacaaaaattaatgcaagatggattatagaattagatgtaaaatgtaaaactataaaatatctggaaagaaaccatgggagaaactcttggggaactcatgcttgatgagcaaatttagatctgacacaaatattatgatccatgcaatctttaaaagatgataaattatgctttgtcaaaattagaaacttctgctttgtgaaagaccatgttaagaggataaaaagacaagttacaaactcaaagtatttgaaaaaccacataactattaaaggactcatatctggaatatataaagaactctcaaaactcaacagtaaaaaaaaaaaaactgtaaagaaaaacaaaaactaaaaacgagccagttataaaatcggtaaaagcatgaacatatattttaccacaggtgatatccagaaggtacatgaaaacatattcatcgttattggaccatcaggccagcataaagaaagaccatggtgagatatcactacacacctactggaacagctaaaagaaaaacaaaacaaaaaacactcatgataccagatgttggtttgaatgcggagaaactagattccttgtatgttgctgctggctttctaaaacaatactagaaaaatagttttgctgttttacttttaatgtaaacttacgcttattacattatccagcaatcacacttatggacttttttttaaggaatggacacttgtgtctttacaaactctagtacaaaattgttcatagtagcattatttacactagaaaaaaatctgaataaaatttctcataatagactaatgaataaacaaactgtgatagaaccataacatgaaaaattactcaataataaaaattaaataaacaagaaactattgatctatctaatgacttgaatggatcacaaggaaattatgctgagtgaaaaagaagaatccaccatcaaaatgtcacatattttgcagttctatttatgtttgtatttatttatttatttatttatttatgagtatactttaagttttagggtacatgtgtacaatgtgcaggttagttacatatgtatacatgtgccatgctggtgcacgctgcacccactaactcatcatctagcattaggtatatctcccaatgctatccctcccccctccctccatc

SEQ ID NO: 22 - DNA, 2768 bp, Homo sapiens
atttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaa

SEQ ID NO: 23 - DNA, 9392 bp, Homo sapiens
gtggagcgacagcgacagagccttggagagggaggctctgctcaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaagactcagagaagtaccaccttgacagccttcaacaagatccaggagaattttctggattactagccacagactctttccctacccttattttctctcaaagatacagagtctttctctctgttctaagccacctaaagctgggagaagaaagacacaagcacctctggccaccaccactatgactgccctggatcagacctgaagctagcacagcacaggtcttgctcaagtcctgctgcatgcaatttctgacgactccctatgttcactcaaggcctttggtctctacaattagcaggtggcaaagccagacaggcctgtgttctttcctttagggcagtgagatccctcagtccctggctgggtccagaagtgctattcagaagtcagggctttggccactttttaatagggttttttgtttttctcttgtaaatttaagttcctcatattgaatattagatctttgtcagatacatagtttgtaaatattttttcctcattctataggttgttcactctattgataatttcttttgctgagcagaagcttttaagtttaattagatcccacttgtcaatagttgtatttgttgtttttggtgtctttatcatgaaatctttgcctctttctatgtccaggatggtattgtctaggttgtcttccagagcttttatagttttgggttttacatttaagtatttaatccaccttgagttgatttttgtatatggtataaggaagaagtccaacttcaatcttctgcatatggctagccagttatcccagcaccatttattgaatagggaatcttttccccattgattgtttttgccagctttgtgaaagattacctagttgtaggtatgtggtcttacttctaacctctctattctgttccactggtgtatgtgtctgtttttgtactagtaccatgctgttttggttactatggtgctgtaggttagtttgaagtcgggtaatgtgatgcctcaagctttgttctttttgcttaggattgccttggctacttaggttctttcttggttctatatgaatttttaaatagcttttttctacttctgtgaagcatgtcattggtagtttaataggaatagctttggacagtacaaccatttaaatgatattaattctttctctccattaagatggaatgatttttcatttatttgtgtcttctctgacttctttgagcagtgttttgtaattttcattgtagagatttttcacctccctggttagctgtatttgtatgtactttattctttttgtggaaattgtgaataaaattgcctctctgatttggctcttagtttggctcttcttggtgtataggaatgctagcaaatttcgtacattgattttgtgtcctgaaactttgtggaagttgtttatcagcttaaggagttttgggtcacaactatagggtttagatacagaattatgttgtctgcaaacagaggtagttggacttctctttctatttaaatacgctttatttctttctcttgtctgattgctccagaaaggacttctaatactatgttgaataggagtggtgagagagggcatgcttgtcttgtgcgggtttcaaggaggatgcttcaagattttgcccatttagtataatgttggctgtgagtttgtcataggtggcctttattattttgaggtatgttcctttgatacctcatttattgagaatttttaacttgaagctttgttgaattttactgaaagtcttttctgcatctgttgagacaatcacgtggttattatctttagttttatttatgttatgaatcacattttattgatttgcccatgatggaccacccttctattccagggaagaagcttatttcactatggtgaattagccttttgatgtgttgctagattcagtttgcaagtattttgttgtggatcattgaatggatgttcatcaaggatactggcctgaagttttctttttttgttttgtcactgccaggctttggtatcaggatgattctggcctcatagaacaagatggggaagagtccctcctcctctatttcttgaaatagtttcagtaggactggtactggctcttctttgtacatctgttaaaatttgttaatctatcaggtcctgggctttttgggggttggtaggctatttattacggattcaatttttggagctcataattggtctgctcagagactgaatttcttcctggttcagtcttgagagagtatatgtgtccaggaatttattaatctcttctagggtttctagtttgtgtgtatagaggtgctcgtagtagttactggttgttatttttttttctctggggtcagtggtaacattcccttcatcatttctaattttctttatttgaatcttctctcatcttctttattaatctagctagtgccctatcttagtaattttttcaaaaaaccttgattaagtgatcttttgaacagtttttcatgtctcaatttctttcaattcagctctgattttagttatttcttgtcttctataagctttgtggttgagttctccttgcttctctaattctttcagttgtgatgttaggttgttaatttgagatatttctaattttttgatatgggcattacttcttatgccctactctaaattttgttcttctagaaaactcagaactatgctttctaaaccaattcaaactttctcagtgaatcaacctggactccctgaggccaagttagcaattttccattacacttggttctctttctctgtaagaatatctaatgcaacaattcaagtgtttctttccctcctggtaatgcggggaactccttttggctgagaccaagacttaaaaccttgttctttcaacattaatgaagatctatttagaaagcctccatttttgcagaaaagatatataaacaccaatgaaaatcaatatgaaattatatgacatacaattatattgtggaaagactgaataaataagtgaactaagctctaagaaaaaaagatgatgatataaaatgatatagaagtaaaaacctgggctggtatagcataattaatgtatcagtaaagtatgtacattgtagaagtggcaggaagacagcatagagagtgagacctgaccaaaagctttaaggaaagttctatacccttaaacgagattaaagtggactcaggaaaacatgggccacatgaggggaaggacacatgttccagatgagccaaagctcagagcatctctaccttctccaggaggaaaggggaggcaaagcagcaggcagaagacagcacggccaggtcagcacagggcacccaggccaagccaggtgggctccatcatacaggtagtgaggagtcactgccaggtgggctttattcattagtttgttttgtttcttttagtaacgaagacacatgatcaaagttgacctttgtaagtgttgctgcagctgaacaaaaagatggataagaccagtgttttaaaaattatgttgtatagagcactagcctcagtgagatattagtagaacacacaggcacacacacacacacacacactcacactaagcccagattattctggcaaatgctgggttaagcaaactaaaagaaacatctttagtgctggacttctcagaacctggaatgtcgctatatgactcataaaacagcaaggttaagacagaacatgtcattttttcccagaaatgctgaaacactttccttcccttggcttcagtgtcaccttctttctcctggttctccatcaacctctttggctgatccttcttgatttccttcttgacaatctgctgctgctcagccattctcttttcattccccatggatttctcaagtgcgtttctattcctgcattttaaactttccttgtttttcctgacacctctccttgtctgactcacccctgttctaaggcaggtgttccatctgtgtgcgcttttggcaccctgggatgctcccagcatgttccctgccacactccatcaggttttctccgcagactctgtgagggcagcagccttgtctccaccattccttcaatgctcagcacataacacagaagctgactccataacatttagttggccaactgagactaaatatatgttcctctagatcttaaaaagttacagaaacatagcacaatagacaaaatattctctttagtcaggagttctctatatatgtacaacagtttgaagtcattattaaagcaaagtgaaagagaaactgtcacagaattccccaagataaattattttgctttagtcttcatcatgtgagataatcaagaccatgtgttattgtaaatatttctagcttacaacacaacgacctgatttttattgtgtgaaataaccgcaatataaatcagttaattaaaaattgcataaataatcctttcaaataaaattctgcctaaattttacattactcatatgttcaaatgataatgagctcataggcttttccaatacctcagtcaaaacactgtactgattccagctgtgggaatagtatctgaaagttattttacagatggggaacaggtacttacctgacattggcctttacactactgtgcccttttaggtcaggaaaaagctgttcccttaaaatcctaaaatctcttctgtcaggtctgaagggtgggtgggaaacacagttttacaaattttagccacagatgttttattccttgcttaaagcagtgactagataaaggccactagaagagtctccaatgtttctttagaagcgtgtgcctgagaacatcttccagaaacactcccttgtctctgcccaaaatcaccttaggtaggaaaatcaaaactcagcaggctgagggatccaaggggatcactgagctctgagtcttatgagagaagagagagaggtctaagactttttgtgtataaatttatgggttccaagtgtaattttgctgtaagcatggatggcatagtggtgaagtcagggcttttaggtatccatcaccagaataatgcacattgtacccattaagtaatttctcactgttcaccccttccatcccctcaccctgctgagtctccattatcattccactctctacgtcaatatctacacatcttttagcacccgcttatgagtgatacaatatgatgtttactctgtgtctggcttgcttcacttacaacaatggcctccagttccatccatgtgtctgcaaaagttataattctattgttttttatgcctgaatggtatttcattgtgtatattttctacattttctttctccaatcatttgttgatgggtatttagtttcattttatgtctgtgctactgtgaatagtgttgcaacaaatacacaagtacagttatctttctgatacattgatttcttttcctttgcataaatactcagtggtgggattgctgaatcagacagagccaatagatgatcagtaatggtggccaatcatcagctagaaagaaagtgcttagcagggcttgaaaacaccaaaactctgagaccactgaccttcaaaaacttcaacagccctgagtgaaaagtccaaacacatttatctaccattcgaagacgctttattgtctgtcctctgcacatctcagtagtctctttttaccacactgtctatatactgcatgagccatttatatgaaactatctgacactccaaggcatcttgtactatatattcaactatgtatccctagtacctagcacagtcctggcatatagtttgctactaaacttttacagaatgaaggaattatcttgtatccaggttccaagttttaaggtgattcttcagtaaaaaaaagtattacagttcacaaataatctacttccctttttacaaatgggatcaattttaatcttatctcctaataacattactttcatttactctgatctaaatatactgtcctaagagagcaataagaaagagagttgaagctggagtttgaagaattgtacatggtcctgtgataccctaccttgttttaacctgagtgactctctcctagcggagagagagccggacagactccattttagtttcttcacgtgcagccccctttaccttccacccttaattgcataactagtgtaaactgactcaaagcaggtccaggaatgcacttagtgataagatattgaggcaagctgcaccagctgctcctgggtacgcactcggtgaatgtcacgcaaaacccctgcatttctctctttgtgatagtttaagcccctgcacctggaactgtttatttgttttgtaactgctattgtaaccaattaatattttaactatttgccagctctgcttctgtaaaacttgtttcagctaaactcccccctcccctatttagaccacggtataaaaacaaaaccagccccttcctcggggccaagagaattttgagcattacatgcctctcggttaccggctaataaaggactccttaatttgtctcaaagtgtggcattcctctataactcgcttggttacaacagtccacactgtggcctgaggtgcattgcccacctgagcttcatctgttatgtatgtcagggaatataagcagggtgagagtggcctcatcagaggaccccagatctctggcttacccatctggcaagtgcacctctgtgagcaaagacttcagagccaggtgacaagaatggcccaagcagtccaccaggaaaacctgggcccagtgtacgtcaatgcagagcatcaagcatggtgtaacaggtgcacagttgcctactcctgttcagagatgactgcatcccacataccgtaaaatgaggaaatgcatagaagcagatgtaactgaagaagacagcagaagcaacaaggagggacaaccaggacctaggagggcaccatgccagagacgcctggaccccatgctaggctcagtgcctgttatactcttgggagccagcactttccctctccatcacatggcatacttgccattatttgttgtgtaaaatattgtccttagttttcacctttcctaggagacacaggcagagcctgtgacactacagcttctggcacacagtaggtaggtgcatcacaaacatctgctgagttcacacactcttgccttctcaaaacttcttgtcaagtcttcagtgaaaaggaattgctgattgagcaagaattaaacttctagagactcctggatccactgaagtttgagacaaggtgagatttgtttactgtcatattcctagctcataacatattgtagtcacttaaaaaagtttgttgaataagtgagtaaattgattcatacgtcatacttagctatatattttctgagtagaattgataaagttaatagtttaagtctagtataattttgctttactcattcaatgaacctgacaattcaaataggtgccaggcacactgctgctgaagaaaaagaggtataagatataatttctgtctacaagaaagccacagtctaaaaagtagaaacatatgaacaaatcgtaacaataaataggctaaattcaaaatcagaggagtttgtttctattttaaacagctctagtcaggaagtgttagagagttctaaacaggaaatattccaacacatcatctaagcatgaagcaggagacacccataattgagtttgctgccaccaaccccaacagcaagaattccagtcctgctgctgcaaagtaagtgtcactctgattttattgctgctgtgtaacccagttttagactctctggttctcacttaatgttctaaaaaagtattaaagagaaaattttattctggtgatgagcccatccactgcagccatctcaacatcataccaattataagcctatcatttaaaaagaaagctgttagtttaacttatttatccaaatatcagtattacataaacatatttgtcatcagactttggacttatgggttaaatagcatataaatatgattagagccttaaagtttacacttctctggttcgctcaaatttttttcaaaatagcatatgcctttctaaacaatggttagtatatttttcaaaatgaacattaaaatgtatattttccaaaaacaaaatacagctcccattggtaaatgatgctattgagacacaacagacaacttctcttgggaaccatttaatcagtgctcacttttgcactctttccagaaatgtcaatggttttgaaatatagaagtatattatacaaataaacttatacttattcagtattgtgcaatatttagtatttcttctagccatctcttgctgaatagtaagccattccaaaacttacggaattatttattgtttaatattgtttattgttattatttgtttagtaattttaataacgttatttctcatggttttgtgggttgatgggcactacaaaagttctcttttggagtctttcttgcagttgcggttggttggctgctgctgaagtcacctgaaagctcaattaggctaaagagtctaaacgggtcacttacatggctggcagtgcatattggctgctgagtgtgatgcctatctgacctctccatgttacctggagtgctcacaacgtggtagtttgtcccaagacacacaggcaaatactacaaagcttcttagggcctagccttggaggtcctagaatacgacttctgctgcatcctattggaaaagcaagtcattgtgaccagcacagattcaagaaatgggagattcgactctacctgtcaatgtaaacagcagcatgtgcatgcagggaggaaagaaattgagggcatcatcttgaagactatcatatcacaccattattccaactagtgaacattatgttttagatgggtagtactagctactcatctgtcccccagaaacccaagctaagcatggacatattgaagagaatgtcaacaccattaaaaaaactctagaaaaatcacatgtgatgactgaggttaattcagtctgtcaactacatcaatataattgccttcttgtaaccctaagtatggtgaagcagaattgaattctacaaaagtctttcatctgttttcctatggaataattaacaaacccaataaatgtataaatagc

SEQ ID NO: 24 - DNA, 1750 bp, Homo sapiens
cagatcccttgcccgtttttactttgtattgtctttttattgagttttctgaaatttttattctggatattgtctttttaatttattgattgtgtcctttgaagcacaaacttctttaattttcatgaatttcaatttactcttttgtcatttgtgctttggtgttatatctaaaaccattgcctaatttaagatcccaaagatgtattcctctaagattttatagctttttaccccttacattgggatttttgaatcactttgaattactttttggatatatcattaggaaggagttcattttattcttttctaatgtggctacacattttcttaatccagtctatcattgatggacatctgggttagtaccaagtctttgctattgtgaatagtgccgcagtagacatacatgtgcgtgtgtctttatagcaagctgatttataatcctttggggatatacccagtaatgggatggctgggtcaaatggtatttctagttctagatccctgaggaatcaccacactgacttccacaatggttgaagtagtttacagtcccaccaacagtgtaaaagtgttcctatttctccatatcctctccagcacctgttgttgcctgactttttaaatgattgccattctgactggtgtgagatggtatctcattgtggttttgatttgcatttctctgatggccagtgatgatgagcattttttcatgtgtctgttggctgcataaatgtctttttttgagacgtttctttttttaaatttcttcttttcattttcttttgagatagagtctcactctgtcactcaggctggagtgcggtggcacagtctctgctcactgcaacctccgtctgccagcttcaagcgattctcctgtctcagcatcccaagtagctggtaccacaggtgcgcaccatcatgcctggctaatttttgtatttttagtagagacagggttttgccatgttgatcaggctggcctcgatctcctgacctcaggtgatccacctgcgtcggcctcccaaagtgctgggactacaggtgtgagctaccgtgcctggtcctgacttcgttattattaaaaagattcctgagtctttcttattttaatagattcacttagtttattacaaattgttataggaaagtaattcaaccgtaattcttcttaattgataacttctgcatctcgccaatgttgcggtaattgatgatgatgatcttccggaagcactgcatgtttttcatatacctgctgaatattacagattatattctgttctatatacagattatattctgttttataaacttttattattaagtgcatcctattgtgttctaatttttgtataattgtatttcatggaaaatatttatcttaactctaatatatgtaaacctcaatacaagacacagaggatatattatctgcatatatatctcatgttattttcctgctaaatatgttcagaattagattgtataattctgaattctcttttttttttttttttttttttgagatggagtctcgctctgttgcccaggctggaatgcagtggtgcgatttcggctcactgcaagctccgtctcccgggttcatgccattctcctgcctcagcctcctgagtagctgggactagaggcgcctgccaccacgcctggctaatttttttttttttttttttgtatttttagtagagacggggtttcaccgtgtttgccaggatgg

SEQ ID NO: 25 - DNA, 12647 bp, Homo sapiens
ttttcaaaagactccagaactggaagtaaaggagtaagacttaatggaagtgtgtggctgaactaaggagaactggggaaaactgctgaagaaggattagattcctagactcagatacccttgccccctcagttacatattgcttttgctggggtaggagatagaagtctgaagattcattatttgagtttagagagagagaaccagaaaacacagaggaaggaatcatcaacaaaataaccaacgaacatctccccaaataagaagatatcagtttctagaatgaaatagtctgcgtgttcaactcaatgaatgaaaatagaccatacaaagtcacagcaccgtaaaattttaaaacactggagacaaaaagaagactccaaaaacttccagagagaataaagcagatcatatacaaaagataaggagccagaatgtcttcagacttcaagagtaacactgagctggaggaaagccatggtgagtttagtcctcccacctcagcctccccagtagctgggactatatgtgtgtatcactctgcctggctaattttttgttttctgttttttgtggtgtttttttgtttgtttttttggtagagatgggttttgtcaccttgcccaggctggtctcaaaatcctgagctcaagcaatccaccacctcggcctcccaaaatgctgggatcacaggcatgagccaccacgcctggctagtttccacattcttaaggaggtaataccaataacagctgtaagaattaaatgaggtactccatatacaagtgtctagcattggcaacttttgcttggtctacagaaggtactaaaaaatattagcttcccaagagaagaagcagaggctgtttgtccaggccaagaagaacgtccccactaaaagaccacctgtccttcgagcaggagttaacaccatcaccaccttggaggagaacaagaaggctcagctggtggtgactgcacttaagcagtgaagatgtatcttaagttgcaggattaaagcattcagttataagatattaaaaatagggaacaggtgtggtggctcatgcctgtaatcccagcactttgggaggccaaggtgggaggattagaaactaacctgggcaacacagtgagaccccatctctacaaaaattttttttttttacctccttagctaaaagtagttttccttagcctgtggatgttttagctctttgcctaaacatttcttacagcccttgtaaatattctacatattaatgatttaggtatctgtgggattataaacccctaaacaaaggaagggactacattttattcatctttgcatctgtcatagtatctagcacagagcctggcacatgatgaggagttaaagatttaatgaatattgaatgtttgtatttgaaagcttacatggctaacaccaaatagttaatttgagaaacatcatggcacaaatattaacaacagagggtctttgttaaatatttcacagactaggaaagctagaatctataccaactatagtaaaatatacatacttaagctggtggttttatgagagtaataacaggtatcactaggtcaccagaagtctagtgaaaacttagagttacagctttggttaggctagaggcaagtgatttaggagctatgcttcttaagctcttttctcatttgtttatttattttattttattttttaaagatggggtttcgttatgttgcccaggctggtcttgaactcctaagctcaagcaatctgcctgtcttggcctcacaaagtgctgggcttacaggtgtgagccactgtgcccagccctaagctgttttctactcttcactataatttatagattagacaggttgtacagttgccagggagatgtcatggctaccaaaaaagaaagcataaacacattttaaaatacaccaagtgggccaggcgcggtggctcatgcctgtaatcccagcactttgggaggccaaggtgggtggatcacctgagctcaggagttcgagaccagcctggtcaccatggtgaaaccccatctctactaaaaatacaaaaattagctgagcatggtggtggacacctgtaatcccagctactcgggaggctgaggcaggagaatcgcttgaacctgggaggcagaggttgtagtgagccgagatcgcaccactgcactccagcctgggcgacaagagcaaaactccatcttaaaaaaaagaaaaaaaaatacaccaagtgttgggtagaaaagcaggtattaaacagaattcttagctttttgtttattgatttagtttcttggggcttccttcattacaggagaaaaatctcctacaccaaagtattcaagttctcagtaaatgtattcagaagtcctagtaaatacatgtatgtggtaagtcatactatattaactataataaagttcctcttgaaacaataaagattaatacatttaggaaagaataaaataaaacctatgcaaacatggaaaaaaatttctgatactagcaacacttacatggaagagaagattggatgtgaacatggataggtagaaataattagcaggtcagaactataattaaggtaaaagagattagattaaaggacatcattcgtctaaccctggacacaatcaataaactttccacaatcccagaacacatgtgaccaaaaaaaaaaggagttcattgtcaaatatacacaaacaagagctagacaccaactgtctaatttgaatcctaggaaataggtgggaggccaggcagacaataataatgtggaaggaacattgttttaactaagcagcttttggccaagttataactaagaaggttaaagtgttacacgtctgacaaagtccttaattagttgttttaaacaaaaacagtattttatgctcattaggtattttctagtatgagttgtatcattattctctattggaactttaggaagaaaatatattggagaggctgcataattagtgtttaaggcatagactctggtgccaggtttcttgaattcaaattccagctctcccccattactagctgtgagaccttagggatgttacttagcctctctaagcctcactttcctcatccattagtaaaatgggaactggtagtagttcccatctgataggagattccacttgctatgagtattcaataaattactgttcataaagcactttgaacatatatcccacagcaagttctaaatgaatatttgctaaataaaatctgtccttgataacttagatacttatctgatttaagacaaattttggctcctatgatagagaatatctctagatatatatagtattatgatgacactaggtggaaataaaaaaaagttttctatttttgaagaagcactgttctttttctgtcctttctttcccctatgattcatatctctggctttacaatgctagctactctactaaaaatacaaaaaattagctgggcgcagtggcgcgcacctgtaatcccagctacttgggaggctgaggcaggggaattgcttgaacctgggaggcagaggttgcagtgagccgagatcacaccactgcactccagcctgggcgagagagtgaactccatctcaaaaaaaaaaaaaaaaaaaaagttaaagtctaaaaagtacacttagaaggttaatacaaggaggcaagtgtcactacggctcacgacattagtaaagtatgttctattctagtgatactcttgtggttgatatagtgatgatttcctaatacagattacaaaacagatatagacacaatatacagtagtaacgggaaacgtcacctctcccagcattggggagaggtttcattctggtaaaaaaaaaaaaaagagcacctgataaggtgataccacattgacaatttcatttctcagaaagtggagaaaacaacaaagagaacttctatccaagactataatgactgacaagaaggaaactgtaagtgatgtggggtgacaagagttttataagaagacagtatgctagttagcttcggtgttgtaatagcaaaggaagcctggaaccttgaccctaagagagtaaatttcaagcattcagaggtaggataggtaattctaagccagaaactataacagggagtgtaaccccagacagacagaaggtaaggcttcaaaaacaaaattataatataactgactctgatggggaaaaatggagagaagcaacaaaacaaaaacaggtagagattcatttattacaggataaatgtgaagagtggcacaaactcagtaaactatcaggaaaggtaatgcccagcatgaggtaaataatttttggctacctattgtttttctctcttgcaattcagaacggccagttaagttctacctaggtgaagagaccaaagaatcagaacttgggcaaagaacttgggagtccaaaatggggaaggggtagtatatattatggttttggcagtagtctgaagataaacaaacatgactgtgattttcaaaaacgaagagaatatggttcttgaataccagaacaaccgctcagaaaaggggcatgaccatgggaggccaggtcatagtaggatactaacttctgctgccaccactgtgaaatgtctctaaccacatttatgctccagagtcaaagccccaggagacagcacaactggagagttaaagcgtgtaggcaataacatttcagcatgtatctcatgtactgatataaatatatgcatgtgcccagagggctccggcatcgccaggtaaatggcctgacagtatacatttgtttggcatattaggctgttagccttaaagaaaaaaaaataaaagatacacagccaccttgggaagaaaaatttaaaaagagaggcctccatgtgatattaataatcttaaaagcagaaaaatgtaggggttaaaatcacaaccctgaatgtaataagttcatttgttaagatttcaacactgctaaattacaaagaaatgatacatacagagaagaaaacttctaatcgtccttctaagtgagcattagaacatgatgaatatttcatataaattatgcatcttaatatggaaatggaatggaccttgacaaaaaatccagtttagccccatggtctcaggaacataaaatcttagcactcccaccttagaaaggagatgattaaggcccagagaggctcactatcttacctatagtcacccagtcaataaatagtggtggtgggatggtgtgcagttctcctgccttctgctatatgatgatgttgctagtctatagacttatggtagagaagaagatgatttcaggttagaagtgaacacaggaatgatctatcatctcgaattacaaagtttaaacctgggtctggttggtgggaatataaagctgtatgaaatagctatgggtttgaacagagtagacctggccagtaattaaaacagaagtcccagccagtaaacagtgaactactactgataatttctggggattaatgttatcgtgattatcttcctccaaactctaaagcctggccacattctcaccatgggaagaaggaagcagaataacagtgtcctccacctcactcagggaattcgctaacagcattccctcactcctctcccagctaatgacctcaaggattcagggatatgaaaaacaaaccttcttcaccagaaagactagaggatcaaaagggacaatgtccgtcataagcagcactctatcacaagtcacgtttggtgcaaaaacacagactaaaaggagtcaccaaacattctgcaagtctgaaaatgcacttcaagtcaaatattcattcaacatttttttttgtacctatgacatgccaaacaccatgctggatgttgcgatttctaaaacaaataacagaccctgttgtcaaggagctgagatcactgcaatggtgtgactggtggtatgacagagattatagtaagcttcttagagagaacataggaggggtcaagtgcacagactgaagaggacttggtggcaggggtagcatggagattagggaagacttcctggagaggaacccccaagttgagacctgaagggtgagaagaaattagccacgttttcatccctgagaggtgtgagaaaaaacaaacaaacaaaaaactgtgtgtatgaagccaccatggtgatagtgcaaactttctacttcaaaaacatataaatatctaattaaaacaaacaaaaaccactaataacttttctttcacttctgaaactgcttttctctgttaatagagcagatatcactgggtatggtgggtcatgcctttaatctcaacactatggaaggccaaggtgggaggattgcttgagcccaggagttcgagaccagcctgggtaacatagcgagaccttgtctctatatttaaaactgtaggccaggcatggtgcctcacgcctgtaatcccagcaatttgggaggccgaggtggacagattgcctgaggtcaggagttcgagaccagtctggccaacatggtgaaacctcatctctactaaaaaataaaatacaaaaaaattatctaagcatggtggcattagcctgtaatcccagctactcaggaggctgaggcaggggaactgcttgaaccagggaggtggaggttgcagagggccgagatcatgccactgtactccagcctgtgcaacagagcgagactccatctcaaaacaacaacaacaaaaactgcatatttttttaaaaaatagagcagatgttgaagaatgttgacaaagcccataaagagagaaaataatagtatcattaagctcaggttctggcatagaaaatccgggtttgcatcccaattctgacatttactagctctgaatttatcatgggtgatttatcattgacttctctaaccctcagtttttacatttgtaaaataaaaataataccttattagactgttgagaggattaaatgaaataatgtgtataaagtactcaaaacagttgctggtacacgtgaaattcttaataaatgttagtgaaaaacaaaaaaagcaaaagatgttggggccattatgaataagtcaactggaaataccataaaggcttaatatttctgaacaactggacagaaagactagtctgaactacaagaaaatctgagaaatctaagaaatgttacttgcagttcttgtacatagagttaccggtacaatgaacacgttgctgatattgtcttctgctacagatatttatctttttttttcttatttcccccaagagactataaaactcttaaggataaagactatgtttctttcacctttgtacttctgaaacacccagtacagggccttaaaacaaggaggccctcaaaaaatatttgatgaataaaatgattaggatgttcagatcaatgtagttgtggtcactgaagacaggctaaataaatttggtaactttgtagcatagcaatatcttaaaatgtatacattaaaatcataaagtaactagaatgtgattcattaaagaaactgaacagtattcttaagtggtaactttgtgactagggaggcaggagtcttgacacataaaattaaatgttaggttttgtggtctcattgacctattttctttctcaagcagaatttttttttctcatttctttcttaaatattttcccaacactactttccagtaacatgaccatgtgacatgagtatcacctctgacaacggtttaaagtggaagaaaaaaaattaaaggagaaaggtaaataagcagagtattacctaagaatacaaagtgttcctccacaggaagttttttgtggttgccagattaaaggaggtaacagataccatatgtgaaatacaaagctcaagataactatacaatatgtacatacttagtggttcagaatttaatgaaccaatccaataaataaccttaggatgttcttgctttatcttcaaaggagaatttttgttgtcattgcctcaatgcaataataaaatgattggttctatcaaaagaatatcttttttttcgagatggagtctcgctgtcgcccaggctggagtgcagtggcgtgatctcagctcactgcaggctccgccccctggggttcatgccattcacctgcctcagcttcccgagtagctgggactacaggcgcctgccaccttgcccggctcattttttgtatttttagtagagacggggtttcactgtgttagccaggatggtctcgatctcctgaccttgtgatccgcccgcctcggcctcccaaagtgctgggattacaggcatgagccactgcgcccagcctcaaaagaatatctttagactaaaatctggatttttaatttaattttaatttttttgagacagggtatcactctgtcgtgcaggctgcagtgtagtggtgtgatcttggctcactgcagcctccacttcctggggtcaagtgatcctcccaccccagcctcccaagtagctgggaatacagaagcccaccaccacaccggctaatttttccattttttgtagagatggggtttcgccatgttgcccaggctggcctcaaactcttcaaatgctaaagtgatcattgcaattaaataaaaacaattgagctgaagtgccaatttcattagtacagctgaactagtgaaaaacaggtacagccaaacaaaattaatgcaaaataatcaaaacttttgagtgcatcaagtatggaaaaaagttctcaagttctaaagtatttcaaaccacagaaagggtaagttcttttctttgcatttccagtaactttaaaaataaacctttattattttccagattattttaaaaaaaccttcttattaaaaaaatttaacactacacaaatacataatatcaaaaaccaacattttatttaaacttctcctttggaggtaactggtgctatcaattgagttttaacaaccacttttcaggccaagtgccctggctcacacctgtaatcccagcactttgggaggctaaggtgaggggattgcttgaggccaggagttcaagaccagcctgggcaacatggcaagtctccatctctacaaaaaaatttttttttaattagccaggtgtggcggcacatgcctgttgtcctagctactcaggaggctgaggcggaaggactgcttgagtccaggagttcaaggctgcagtgagctataatcctgccactatactccagcctgggtgatagaaggaggccctgtctctaaaaaataaaaaaaccaaactaaccaactaaacaaaaaaccaccttttgatcgcatgagacagtaataggagagctgctctaaataagtttatactaattgcttaaacttctccttttatctgtgcccttcctactccactgctaaggaaacacaaaaacaaaaatcaaaaatacatgctaatcctccaaaaagacaacccacaaataagattaacccctgaaaaaaaatcataaggtgactgggcaaaattgtgacaccaagtggcagaaacacatttcctttagttgccctcaataataaaaaacaggaacagcatttttctttcaaagatgattggaagaacctacctaattatcatgttttttagcttttaaaaaataattttgtgaggccaggcgtggtggctcatgcctgtaatctcagcacttgggaggctgaggcgagcggatcacgaggtcaggagatcgagaccatggtgaaaccccgtctctactaaaaatacaaaaagttagccgggcgtggtggcgggcgcctgtagtcccagctactcgggaggctgaggcaggagaatggcgtgaacctgggaggtggagcttgcagtgagccgagatcacaccactgcactccagcctgggtgacaggtcgagactctgtctcaaaaaaaaaaaaaaataataataattttgtggcggggcacggtgactcatgcctgtaatcccagcaccttgggaggcccaagtgggcagatcatctgaggtcaggagtttgagaccagcctaaccaacacagtgaaaccccatctctactaaaaatacaaaaattagccagatgtggtggtgcacacctgcaatcccagctattcaggaggctgaggcatgagaatcacttaaactgggaggcggaggttgcagtgagccaagatcgcaccactgcaagatcgcaccactgcactccagcctgggtgataagagtgagactcagtctctaaataaataaataaataaataaataaaattttgtatacaatgaggcattttgtagtgccagagagtaaggaagtactaaaaaaaaataataaagaaacaaaaaacacctacagcaacaaaaagcttgcaatggccaaaggtagaacactgtgagcagcaaaataagcagtattagattataacccaaagtactaaaaataaatatccatgagtccatactaccataaataaataagtaaataaggtagaacagacaatttcatggggagaattccaaataatttacgtaaatactctgccctcaaggaagtgaaacataactcctcccgccagctctttaactgagggctgcacatagtgacttccttctgaagagtacagtatggcaaggggaaaaaaaagagtaactttacagttgagaaagctgacaaaacttccttagccaggtgatcaaggttaacatcaacagtgataagtcatgttgatactatctacttttgatatggtatgacgagaatggcattttgcctctgtggtcttcctacccaaaacccacaactgcagtctaattatgaaaaacacaacataaaaatcccaattgagggacattctacaaaatatttgaccattattctcaaaattgtcaatttcttcatcaaaactgaagaaaagtctgagtgactgtcataggaacaagaagcctaaaaaaacaaaatgattaaatgtaatatggtatcctggatgggattccagaagagaacaaggacaataagcaaatctaaataaagtatggactttagttaatagcaatatatcaatattggttcactaattttgacaaatgtaccatactaatatcttagtgatagaaaaaactgggtgtggggtatatgagaactctactaatctttgaaacttttctataaatttataacttttctaaaataaaagtcttattgtaaaaaaactttaaaatctactatatatataacatatatataattttctcagatgggataagtaaatatcataaaagtcaattattcctgaagaattattttattaataaaaataatataacactaattttaaaatagtttaaatgagatataagaaatggagatgctaaaacaaaatactggagagtaattaagaattttgcatacttaggccgggcgcggtggctcacacctgtaatcccagcacttggggaggccaaggtgggcagatcacgaggtcaggagttcaagaccagcctggccaagatagtaaaaccctgcctctactaaaaatacaaaaattagctgggcgtggtggtgggtgcctgtaatgccagctactcgggaggctgaggcagagaattgcttgaacccgggaggtggaggttgcagtgagccaagatcgtgccacagcactctagcctgggcaacagagtgagactctgtctcaaaagaaaaaaacaaacaaacaaacaaaaaattttgcatacttaatattttcacaatcatggaattgtcgtggcttttgggattttcaccttcaagttcttttggtaaaatattaatactgttaaaatactgtatttttatcttgcaggattattttggttcatttgaagacgaatggctgtttccatttatcctccaagcttaaacccaataagattacctgttatctctttcctcaacagatgagaaaattttcagggggttttcctgatataacagaggctttcataacataacatggagaaagagagacctattataattggaaagtttccatttcaattaattctgtaactttacatgcataagcaatttctacttatttatagtctaggtaagactgactaaactaaatgatgtcaggttgactttgcaagcttcttttttcacattaaagaaatactacggtctcagtctgttcacacaaaacacctgaaactaggtaatttataaagaacagaaatttgtttcttcagagttctggaggctaggaattctaagatcaagatgccagcaggttctgtatctggtgaagaccttgggtctctgcttccaagatggcaccttgaacactgtgtcctcacacagtgaggcaaaaggaacagaaggacaaaaagagctgaactcactccctcaagcccttttataagggtgctaatcccatccacgagggcagagtcctcatgacctaatcacctcctaaaggcctcacttcttaatactgtgaaattgagaattaagtttcaacatgaatgtggagtggacacattcaaactatagcaagtactcactataattttttttttttttttttttttagatggagtctcactctctcgccaggctgg

SEQ ID NO: 26 - DNA, 3664 bp, Homo sapiens
agcgagactccatctcaaaaaaaaaaagttccaactctgtccctgtactagctgggtgacctggggtgaagtgcttaatcttttggcatttgtttcttcatctgtaaaaatgaaataacacataatctgtagagttggtgcgaagtttgaatgagacagaatagcaaaaagtagtaaactaggccaggcatggtggctcacgcctgtaatcccaggactttgggaggccaaagagggaggacttcttgagcccaggagttcagcctgggcaagcatggcgaaaccccatctctactaaaaatacaaaaaaaaatagccaggcatggtggcacacgcttgtggtcccagctactcaggaggctgaagtgggaggattgcttgagcctgggaggtagaggttgcaatgagctgagatcacacagctacactccagcgtgggtgagagtgagaccctgtctcaaaaaaaataaaataaggctgggcatggtggctgatgcccgtaatcgcagcactttgggaggctgaggtgggcggatcacatgaggtcaggagttcgacaccagcctgtccaatgtgacgaaaccctgtctctactaaaaatacaaaaattagctgagcatagcggtgtgcgcttgtaatcccagctacttgggaagctgagacaggagaatcacctgaaccaaggaggcagaggttgcagtgagccaatatcacaccactgcactccagcctggacagcagagcaagaccctgtctcaaaataataattataataaattaaataatagtaaactgtatgcctcagcttagtatctccaaggtggaaatcatacaggacctaccttcagcactcctgtccctccctctttgtttatcttttttatttcccgcttccattcccctgtatttttccctcctccttgcctaagctgtgggcctgcacttggcacccttggacacgacctccccttcctagtgatactcagactaaagaagtcactgactattgtttgggaaccatgtcatgatacctagtgtcaacgttccataaacacccagtaaacataagtgtggtctaagggaagccacacatcgaaattcctgtcttggaatttggacaatggcaagatgcagccacattctttacaagcgtggaggcgttcgtgaggctctgccctgggactggcagggaatgaactggcttgggactaacataagtggagcagctatgtgaagagccacgggaaccgctacctgtgatggcaggtgggcagcagccactattgacactgtgtaatgaaaagagcaaatgtgtgcggctcggtggcagcacaactaaggacagggctcagtgatggaaaagaggcatgaagacaaggggctcccagcaagtgaggcagcgatgagttggaatgaaggctggagggtcgcagggaagctggaaagtgagttgggtggggactgtctgcagaggggatcttggctcgagtttgtcatctcaaggagcagctatggggctttttgaggcatggtaattagatgagacaaccctggcagggcatgactggcaacgtgggtggccctgtatggtcccccaggggttcccagtccccacagcttcccgactccctggccccagccattcctcaagctcccagcagctcaggaacttgcgtcagcagctcaggtcatgacaccaagatcaggcttggaaagggggaggtggagggaggggagtttttggcccggaaatggctgggaagacttcctttgctgggattaactgttgtccgtgaagctggtggcattcagcagggcacagggtgttctggggagtgaagtatgtgggggaaaggggtgtccataccttcacccctgcctccctctcagagctgcactccagctgtggtgaaagagtggatctttaggcagatacagatacagagattccccccaccccaccccaccaaaggctttcaggacctctaggttcattcgtgtgtggggatggagtaaggaggttgctcatgcttgccagccaagtgtatgtaggctgagctggggtgattttctttttcttttttttgttgagttagggtctcactgtattccccaggctggtctgaaactcctgggctcaagcgatcctcctgcctcagcctcccaagtagctgggactacaggtgcacaccactgcacctgcctggctgggggttgcctcgttagggtccccaggcccggaaggtcgcgtgcttgctattgctgccccgcagacccccatggcctgctggagctagggggcgccagaagccttacttctgtgtctctggccgatgaacaagagagcctggatactgctgcagagcagaggctgttccggagagcagggctggaaggtggtggggcggggtgaagtcctgactagaggctgggagcttctgggtgggcagggtctgccagggcaggagcctgtgtgagtgcagcttcctttctgcccgcccctagcttaaggccagagagtaggcagcttgttttcaagaatcccaatggctttcttcctcccactccctaaatcttcttgcccaccctctaaccatgcccagggcctctcgctgtgaggtggcaagtagcccgagaagcagatggtagcccaggccttgcagtccccgctccagcacacccctcccgtcctctcgccaggaggctgcctggctttgtggtccggagcaagtcacttctcgacgggcttcactttgcccatctgaagtctgaggttgttaggcgtgttttctaatggcctgcccagctctgacatttttggatcctatgtaaagggaaccctcctttccaccctcattcccagtccagagtgaggagattgggtaaattcccagagccctggcactcccgtggagcactcaggaaacgctccttcacccctcaattctgctctcacacaccccgtcacacatagactcacatacaccaagcagagaggagcaaagagaaggaccatgtaagacaatcacggacatggcgttagaaggaaactgagaaacgctctacaagagttcgatgtattacattatttttaatttagatgaaattcacataacacaaaatttaccattttaaagtgtacgtacacttcagtggcttttcatatattcacagtgttgtgcaaccactacccctatctagttcaaaaatattttcagttctcccctcctccagcatctgggaagcatccattcaccttccagctctgtggctttgcaggttctagacatttcatgtaaatgcagtcatataatatgtggctttttgtgtctggcttttttcatttagcataatgttttcaaggtttatccatgttgtaacatgtattcttttaaaaaaaattttaatgtgtaaaatatacatatcataacatttaccttttaatcattcataagtacacaaatcagtggcatgaggtggtcccttcccaatgttgtgctgtcatcaccactgtctgttttcagaactttgtcatcatcatccccaacagaaaccctgtacccattaaacagtaactcccggccagacgcggtggctcacgcctgtaatcccagtaattccagcactttgggaggccgaggtgggcggatcacaaggtcaggag

SEQ ID NO: 27 - DNA, 9137 bp, Homo sapiens
ccccctctgcctgactccagtctgggcatttctggagcatcctgtgcgcctggctcagcccagcaagctgacatttgaaagctcacagctgtcctgtgaggtgggtgattcccgtgtcgtttcatggtgaagaagccaaggccaggacagaagtgacctgtccccgggccacagctgggcaggggcggagttggcatttgaacccagctgcgtgcctcttgagtgctgctctgtgggccccgcagcctcctgtcagctccttctggcgcctgctctgtgggtgttccttttgtctaaggcgcctgcagccctcagagggtctgtggggtggggacagagctcagcaccccgcatccaccagcaccatctccgacctctgtgcaggcttcgtgttagaggtggcagccaggtcctgccaacggaagatgctgggccttggaaacagcctgcactgtaggtgacccggccggccgggcccaaactggctgccaagaaaagggagcgggaaaggaaaacagctctcggccacatcgcctgtgtaaccgaatctgttttcaaagcccctcgcaacgcgggctccgcattcggcagggcaggcactcgccgccagatccccgaggactgctcagggggtcttctgggaggagctcaaagcgagtttgttttcggggaggaggtcattgcactcaaggtccccgtgactgcagcgttctcaaacgtcctgccatgtgctgggataaccccacccaccgcaggcgtgccctccgtggggcagggaggggaagcaggtttgggctgttagggctgcaagccaaggggcctgcagggcatcttagtgagctgctttggtgtccctgcagttggcgacacccattgtcacaccccctcggcaccctcggtctcccacatgacagacttacctggggatgcaaacagggctggtgatgaccttggccctgtgcggtggggtggccgtttatgatggggcctgcactcaactcactttcaggtctagatgcggggaccgggggaggtgtcagctgggctgggctgggcacgactagactgtggccccgtctgcgggagcccggccaccacctcagcaacgccacctccttaggatgtgggggcgggatttactctcgagactcttagagccagcgggtggctggaggctcatagcctggcccaggcagctgggggagggctttgctggtgcctgggaccccccaccccctgcattctcgcctttgctttctcttttgctctcgtctttaacaacatctctccactcctcccctccctccctcctctggcctgcccgctccttcattccttctctgctcctaacccccgcatagaggagcctggggagcccgcagcctcctgaccccatgttcctctttctctcctgtcttcctggagacgtctgccactgacagtcttggagccctgtcaaggggacctgtcctgcgctgggctgtccacagaggagcagcgtggaggagctgggagtgcccagcctgcctgtgggctgcattgccgcttcctgcccaggagccctgcagccgtctgtccgcctctgagtaggacagtggggtttcctggccaggagcagagtttgtcacattccagttatgtctgcccaatgttcagcttttggtgagtgtcaaagagtcagccccactctgcgggcgggaggggacctgagatgtgaatccaggggagttaaaaggcttcggaaagcatccaaaagtatagagaaaaaaaggatagttgaggggctgggacgatgcaagccttttattttcatcctttaactttttttgcatttctgtattttccaccatgaacaaagctcattgataatagagactgaaatatttcatggatgattcaaagagataatctgaaaagggaaataacgtttttctagggtctggctgaagctgccctgcggattatgcaaaaacctgtctgagggagtgagaacgcagaggcaccttagagccagccatggctccaagctctgaggatctgcaacagacacacattggctgggcctgagcaaagagggaaagccactctccttcagcaacgaaggagtggggatagcaagggctgagcttgtacatgcacacctgtgtgcagccacacacatacacctgtgcacacacatgcatatgctcatatatgtgcacacatgcaggcccgtgctcacatgcatgcatacctctgtgcccccacacttaatgcacatacatgtgcacatgcacacctacacacattcctatgcacccacccagtgctcatgacaaacctgtgtgtacttacgtgtgtacatccagatgcacccacacactcgcacacatgcctctacgtgtacgcccatgggcacgtgtgctcacagaggcctggaaggtgctgtttttccacgcgacgatggctgccgtgctcggtgggagcagccgcgttgctgcctgttcccgtgccccagtctggccgtcactcctcaccctcgtcaggctcagggtgggagggtgagtagcctggagtggcctggtcacgtaggtgggcagccagctggggcactgacctccagatgggccacgagagcccttcctgcatcttctgagtccctgactcagtgcccagtgagggtcccggagggcaaaagaatgtctaacgctccacctgtgggcgggtctggccttacggaaacttctccatggcaggtggaggcctggttgagtggagcaaagggcaggcattcccagtgatcaggagctggggccaggcctactgacaccttgatgctgaggggccagagcggtcctgagcgatgtcccgaaggcccagggtctgggcaggtggaggcagatggaccaagcagggcctttgtgttccagggcactttgcaggcagcaggacccccaggtcctctggagagggtggctggagacccggcctgaagctgctgcccccaacaccacaggatacctgcctgcaggtgccatccattgcttgggggctgcacagagcagttttgagcaggcagtggggtgtcaccttggagtggctgtgagatgtgcgggacccttgggggccacctggggtcaagcccagccctgcctcttgggctctgggaccctgggggagccactccgtgctctgtgcctaggtctgtgaccctggaggagggcggtgctgtccatctccggggacgatggttgcatctcaagggtaagggccccaggcctgccaggtgcttcgagtacagtccaggggcggcctctcggggctgctctggtgggcggccagaccctgctggaatgtgactctgttcctgggatcaggacctgccctgttgcttgtgggcagggttgcctttgtcaggtcctgccatttctgagcctcagtttcccaatctgtggtggggttgacgtgaggaaatgagaaatgcacccagggagcactggctggcgctgcagggcagcaagggggagccaccatggtcactcttggaaaagtccccagccctgcaccagcagggcagtaagaaagtccacggctgccgctgtcctggagagaggcagcagcccgggagaggcagcagccctggccacacccctgccaagagccagctcaggggcccagggccgctgagatcactgggcagttcccaggctggctgggctgtcccctcgtcaggagggcagggctggcaggtttgtggacgccttcccaggctgacccccacaatagccgccctgctccaccctgaatctacccgtcccaggctgcgcctgcctccaagtgcctgattggagatggccaagcccattcctcatgtacaaagaatttcccgagcagccacagctgctgcagctggaacttgtctccagatgggtcgttccgagggaaaccagcgtctcctgtctcctcctgcagacatgggctggcgtccgagccctggatcccctgccctggcttggcttcctctggaggggagataaggggctcctgacatcttgtaggctgaagaacccgcccagcacgctgacagggaggcgccagaggcagccgcagaccggcctcagcccctgcagcccctcccctcttgttgttgcagaaagaagccctcagggcccaaggtcgacccacccagccaggggactgctctgtagctgtggcccactccagccaacccgggagtgaggggctccgaagcgtgcccagcacatagggagggctcattccggggggcaccgtctcccagtcagagcaggctggagctgggcacagccgaggaagagcaaacgtgttctgtccttgactccttctccaagtttgtgatggcatctgccatgggccagacaggggcacacgagagtgagcgagtggacgtggctgccctctggagccttccagggcgcgatggcaggtgtggagaggcacacagggaaaccctggagtctcgccgaggtacaaggcgatgcagaaagggccagggagttcccagagactgtcaggggctccctgggcggaggcagagacccccacctggcccctggcacctccagcaccatgggcgccctggctagggatcccttcctgtctgaggtcagcgctgcaaacctgtggctgcggttaccccaccatgttttttaaaattggaacaattcatgtaaaagcccagattcattttttcttgaaaaaaattgacagccaactgtgaccacagtgggcttgtttctacgcattgggggctcttccctcggaacaggcagtgctctcagttgccgtagacgccccccactccctgtcatctcacccggtccctgctgggcctctttgtggcccatcccctggttcagatatttcattcaaagacccacccccccagggggaggccatccttctcaggaaggtcgcttggcctggactcggaactggacactcattactggtcaccctgtgactggagcaggactttgcctttctgcacctcggtttctccatcctaagaggggctaacgcctgtgtcgtgggactgtcccgaggcgctcagaagcagtaggcttgctcatgcttaagcacagagctcacagctgggggtggcccctgtgccacaggtccctgtgtgtgcccaactcccgctgcagagggcaacgctgtgtgtgcccatgtctgtgctgtggatgcaatgtgtaaactgcacagcctttgacggtggctgcctgggttggaacgcgggcctctatgtgtgctctccaacggcctgtggcggaagggcagcccctcccttggtgggggaagttctccatagctttggtgcttgggaggtttggagatggcttagagagccatcgggatgtgaggggatacatttatctctgtcttcttggggacagacctcggaggtccctctttcacccttaaaggcctggatgaatggaatccgtggggcaggattctcaaagcaagactggtggggcctcacaggcattcctggaaaagggctgtggagttaaaaacccaagcgggaaataaacagaactaggcttaggaagggtctctctgggaggcctgtctgccctccatctttcgtgggctcaggagcactgcctggggctgggagcgagagctcggatactttacgttctctgaggcgctgaccgtggctctgcgaggaggagtgttcctccggacagacatctttcagcggcgctggactaagccatgggacaggtctgactgtggctctgcgctccccgccgccccatctgttgccccctccccactgagagctgggggagggacgggatctttgtgagctgacttggggtctcagagccgcggggagggaggagtggggctctccctgcgcgggttccttttctgggtgaggcggagcctgttcaccaggcagatcgggggctccccggcctccacagatctcctggtgtctccccccaggctgttcacactttctttacttggggggctgataagtcacgcagctggcagcatttgcacctgattcaaggaggtgaacattttccctggagattagccttgaagtcagggctggtccccacccggggacgaggagaggacagaaggctacagagggctgcaccgggggagggtagatggggcgttcacccacccctgctgccgcattttcctttgttggttttgcccgaggtctgataagcaccctgctccagccagaggccttatctggccgcctaatcccctggccttggctggagaacaccagggctttgcccagtccgccctccctaccccctccctggcccctgcaggccgttggggctgggggtggagggagagggaggtggagtgaatacccccttcctcttgctctttctcttccaacagggcaaggggtgccggtggttgaagaggcccctctgggcaggaacctctcacctggggcacggctgaaaccaaagaattcaagctccataaggaagaacctagaggccccccacgtcagcctgccccagcctggagcttacccaccatggaaatgtgtctgttggccttacagaggagaaggcatttgggcagggctttgaggtatgagtaggagtttgctgaatgaaatgagaggaaagggttttcagggcagagggaacaggttggggtggtaagaagggtcctgaggcccatagagagtgactgctatgagtgagtggttggaactggcgtgactgaagatggggaaggacatctgggggtcgggggtgccagaggagttggggatttatctggaagatggtgggtgctaaggcaagaagaaccaattcctttttctttttgccaaagcaaagccctccataggatttccttttggactttctttttgaaagagtaatgcacactgacagtaaccatttagataatacagtttctaaaagaaaagcaatgatcctttgcctctcccacacccaccttttccccacaagcccccagaaggctgggggtctgctctccctcccttgacagctgcaggatgttttgtggtggggtgtgaggggctttggccagtccctggagatggacgtgctggtgtgtccagtttccccagcccacttaaatgggtgcagtgagtggcctttataagttccccgaagggggcgtgtgggggacagttacagacatgtcgtttaacaaatgctgcagatccccttccagaagtgaagaacatctcagccgtgccctggcaggcctggctcctccccctccacacctgaagtttctgtttaaaatgtttggccactggaggggtgaagacactcacctgtgcctgaggcactttattatcctgactgagcgcgccctgcacctctcactgtcctgaagtggctcggccctcgggcttcatctgggccttctgtacctgagcctgggcttggcccagcgtggccagtgggctccgggcccctcctgccagcctagcacttctgagacagaagcctggcgcagcaggcaggcacctctggactttgagcctgggcccttgacagccagggagagggcgacccccagcacacactaccctaacctttagcaacgtccccactgcagatgggggtgctagccttgaaagttgggtgccccaagggttggggcaggagggcaaggggccgccccagggaggtggtgcatgacacagcctataacaggcagtgactcactgctcatccagccataaagtcagggtgataggctcagtgtcccagccgtgctccctggagtccctgccccaacgtcattcccttctctgcagcctgcgctgggcagagctccctccccaggggggccgcctgggccactctgggaccatccacccattccagacccacccattccaactcacttgctactgctggggagactgagtgccagggagggggagcaagggtagatggagaactaacagtgtcagagtccacaggtcatctgtcccccactttacagtgtggactgcgggaggggatcccagtgtgggctgcagagctcagggccaggatgctcggcctgtccaggctgcgatctggaggaagcgggtactctctgcttagcccagggccttccacgctcctgggggctgcggggacagatccaagaacatgggccctggggccatggtgtccgattcaacccacgcttcctccctgttgacaccgggcaacttgctgagccgctccgtgcctcagtttcctcgtctgtaaagtgggattcatagtagctccttcccgactgggctgtctggggattggtgagtgatgccgtggggcaggatcatgatttacggggtgcctgtatgttctcccagagacgggaagggccctgaggggtgactcctcaccagatagcggggtctcccagggactaagcaggtgggagggatgggcgctgccctactgtgcagagccttggcgggatcccttgacgctgtccccaggctctgcggggccaggaatagggccactgggcctggggtccttgtagttcaagggtcaccctgaactgcggggctctaactatagagaccctggggcagtgacgcctgtgcaacctgcccgcctgtcactccctcccccaacccctcacacttgccctgcctccttgacctgccctgcccacccctcaccctcaccctcacgctgcccccttatcccgcccctggcacctgccctgcccttcccctcctgtgatggttaatactgagtgtcaacttgattggactgaaggatgcaaagtatcgatcctgggtgtgtctgtgagtgtgttgccaaagaagattaacatttgagtcagtggctgggaaaggcagacccatccttaatctgggtgggcaccatctaatcagctgccagctctgctagaatataaagcaggcagaaaaacgtgaaaaggctagactggcctagcctcccagcctacagctttctctgtgctggatgcttcctgccctcgaacattggactccaagttcttcagctttggggctcagactggctcttcttgctcctcagcctgcagacggcctattatgagaccttgtgatcacatgagttaatactccttaataaagccgc

SEQ ID NO: 28 - DNA, 12200 bp, Homo sapiens
aatcagaggaagaacagcctgctctgaggttgaactttgcaaagctgggaatgttccttctttgaaggagatcttagtttaggcattcatttttattttattttttatagagttaatgaaccagtcttacagtcttcctttagccaatgagttaaagaaatctttgcataagtttattcaaatcagaggttccaccaagatatccctgtaaatgcaccttccagagccaatctgtgtgtaggcatggaagcaaacatcctctcttggcttctgcagcaaattccaagtggcaatggaactttaccttcgctgactcttttgtttcttttttcccgtggattctgtgcttttgtttttgtttctggttttggtttttatataactcagaagttatttcctaatgtgccagaaatgtttgtgaatttggttttatagcctatttgatcatcctttttaggtggagacctattctgttgggttagagatgacagaaaatcttatttgtcggttggtttgtttgttcaagaatacactgaccttctacaagaaaggagagctctttgacacctggaaattttacagaagcttgggacagctctgaatggcaacacggtcctgagatatgtgattacctgggactttcattggacctgcatttcagctctactctcctcactgccctatgctgctttgaccctaaaagtgaagccagcttggccaggtgcagtgactcacacctgtaatcccagcactttgggaggccgaggtgggcaaatcaagaagtcaggaaatcgagaccaccctggccaacattgtgaaacaccatctctactaaaacacaaaaaaattagccaggtgtggtggcacgcacctgtagtcccagctactcgggaggctgaggcaggggaatcacttgaacccgtgaggaggaaattgcagcgagccaagatcgcgccactgcaccccagcctgggcgacagagagagactccatctcaaaaacaaaacaaaacaaaacaaaaaaaacaaaaagtgaagccaactcaattgtctcatagaactgatctttacggtgtttttaaataaacatagaaattggccctcccagtcttaaaacttcaaaaacttacatttgtcttacctcagttcctttctcaggaatccaatcatcaaggctcccagatagtatcaatgaacggaaacttaccagatcacgatatctggacaatgagatgtcagatccccctcatccatcctgattacctaactgactacctgcttcctgttggccaactactcttccttacccctccctaattcttgttttcccacaaatggttacatttctgtcctgctatagaagcccttaattttaattggtcgaggagatggatttgagactgattttttgctctccttggctgttgcacctgaatagcctttttccctggcaatactttttgtctcagtgattggctttctgtgcagtgagcaatgggaccaaacttctggtgttttggtaacaaattttggtttcctgactgtgaatgcattgcttgtgactcagctgccatgagctgggagagtttcaaaagccctctaagcagctacctgaccattttggccagaggtggattttcgtctctccccatttgggcccacttctgccaaccccaaccatgttcctgattgcctaggaagaacagcctttgaaatttgacgtctatgtacagaaaggtgagtgtcttttatgggtactagacagtgggaatggttcctctccatttgggaaatcccaaaggcatatcagtttgcaggttaaacaagccaaactgatggagagaggataataccttgactgattcagtttgaacactcttggggcttgttcattgctacagaagttggattgtgttttggtgattgtttgcttgtgtatgtctatgtagttatgggatgtcagggtttgatcccagagtgcagcccacatgggtgcattctttgggttagtctgtatgtagttgtgggttgacagagcaggggaaattctacagccataccactctgagtgtggctgatcttgtctgatcgcgatgtctttgcattgtagtgctgtcttacaattgaattcattttgctgttgaatgggaaagcaggatggaggtccatagacggggttttaccatgctgctgcacactggtcttgaactcctgggctctagtgatccacctgctcagcttcccaaagtaatgggaatacagaaaagaccaaccacagtgattaaagggatgaaaaagatgacctgcttgaaaactctaaagaacccagtattatttgaaagaagaggaagctgaatggtaacttaataactatcttcagatttcaacaggactactacttctgttttatccatttctatagagtttgaaactactaaggaattattctgaaatctttctgtaactagcatatttgactcattttatactaattattataacttttttccatttaaaaagtctgaacttgtatttggcattcttccatttgaaagaataagtattaggaagagataatcaaatagtattactctctttttcttcttcttatatatgaaaagatggtattgtttttcttggcataaacaacctttgacttgttcttgccatttatcagactcaaaaatctgtggattgaagtcttctgttacttagctccagctatgctgtgagttattattgccaagccttaataatattgacaaaaaagggggaaataaacatgttagaagttaaattgcattccttgttactttataaactgaaataacaagacttggagtcattatcttgtagatttctggataaaattaatatgtagggcctttaacttgttttgaatctcttaatgaacattttctatgtgagaagtattgtttagtgctaggtttttgggtaaaagagaaaaaaagagaaagagtaagacaggatatcagagctcaagatgcttctaatctggtggtaaagataatttaatgaattagaggtcggtaagcaacacctaatcatatacatgtgtagtacctcaagggaaacacaaatcctgcttgggcaagaacactgagatagatgtctaaacaggatttcttgtttttaactctcaagtttcacaataacatagctcagttcgttttagtgcccccgtctactctcaaactccatccccgacatattttcatcagactattctttctttctctttgttgagttggtttttgctttgttgttcttatatctgagtttctccttacttataaattttttttacaacttttcacctgccaaagcctcaattttatctcgtttctgctaattgcattcttttatttcctgcttttatgagccactctcctataaaatttctcaatttaaattccagagaaggaacttctgattatccccacttagcttcataccgtattatgtcataggtcccaagccaatgcttgggtcagaagccaatatgcattcaatttagacttactcattatggcttctcctgcaacaggaactgtggtcctggcagtttcctctggaatgagataaggcatagcaagtatcgtaatgtgctgttaaattttgaagaaagtatggaatttgaaaaattgaaaagaaaaagataaggattgaaggaacatttggagacaacccagatatgctgatgaacacagtgaggatagggcttggagagatctactttatctagggagaaagcatgctcagtagtggaaacacttctggttaggcagggtgagaacaggaactagcagctctctaaagcaagccaagactttagactgattgttcttgagtccataacttaacaaacaatagttaagggaatttagttgtcctatgtgcctattaaataactggataggggttttaaaatcattttttaaaaaagcaattaaaaatacctttcattttgattagtaagggaattttttaaagagaaactcaggacatatttgactgtaggaagagattatactcctttcacttagaaaaatacataacactggaggagctagatgtgataaaccaggaaatagaaaaagtgccattgtaagtatagacagatatcgggggaaattcagccagatattgggcaaaattcacccccgatatttcatgtaggttcttttctattttccctaagcatcagccggtttgagaaataaagggacagagtataacagagagaaattttaaagccaggtgtctgggggagacatcacatgttagtaggttccgtgatgccccacaagctgtaaaaccagcaagttttcattagggattttcaaaagaggagagagtgtacgaatagggtgtgggtcacagagatcacgtacttcacaaggtaatagaatatcacaaggcaaatggaggcagggcgagatcacaggaccacaggaccggggcgaaattaaaattgctaaggaactttcaggcaccattgtcattgataacatctgtcaggagacagggtttgagagcaaccggtctgaccaaaacttattaggcgggaatttcctcgtcctaataagcctgggagcgctatgggagactggggcttatttcatccctacagctcgaccatagaagatggccacacccaagggggccattttagaggcccaccctcaggggcgcattctctttctcagggatgttccttgctgataaaaagaattcagtaatatttctcccatttgtttctgaaaggagaaatatggctttgttccacccggctcactggcggtcagaatttaaggttatctctcttattccctgaacattgctgttatcctgttcttttttcaaggtgcccagatttcatattgtccaaacacacatgctctacaatttgtgcagttaacgcaattatcacagggtcctgaggcgacatatatcctcctcagctgacaggattaagagattaaagtaaagacagccataggaaatcataagggtattgattggggaagtgataagtgtccatgaaatcttcacaatttatgtttagagattgcagtaaagacagacataagaaattataaaagtattaatttggggaactaataaatgtccatgaaatcttcacaatccatgttcttctgccatggcttcagctggtccctccattcggggtccctgacttcccgcaacagacagagatatttatatttcagcctgaccctaatcctaacccaaattctaattctaaaagagatcacatttaaaatatatctttattttggaagaattgcaaagctaaacttttctaaaatcctagtctttagcgagacaatgttattttgagttaagtcaaaaattttgcacacacacatgcacacatgcatgctgtggctgtcttgtggcttttccttgaaatgggtatgtgattatattattttccccctccctttagaaagacataacacatgtcattggtcattattttgccacatggtgaccctagtttaaagttttgttctatgttcatgttaaaggagaaaaaatgataaatgacaatgtaatcaagaaattgaatataaacttgccgattcgtctaattacagagtttagtgctgtgggttccaatttgtctcttcctagacagttgctttgtatccatgaatgaatgaattcgtagtattgaaaacctgctcccagtgctatgtaatttatcaaataatatgtgtgagtataagatataactgctgcccacaaaaactcataatttatttgaggacacaaaactcatatacataaaataattcatgaatgagacatattcacatgttatatgcaggcaggtcctgcttttactgtgcttgtggaaatccaattttaaaatatattattttaagataaattctcacctgggagtatgttgtattctaacactattatctttgtcttttggggcatatttggcttacatacaagtcaaagaatactagtttaaaaagttgttaaattcaaatttacccaacatatattatctattatatgttatgcattcttttttatatgttatcacaaactacaatttcagcactgtccatgttcttcgttttttagataagaaatggctcggaaaagttaggtaatatggccaaatttacacatctactaagtgtcaatgctgagatgtgaaagtcagtttttctcagtcaaactttaagagtctccttactgtctatgtgaatgtttgtgtcccctcaaaatttgtatgttgagacacaatccccaatgcaatgatgttaagaggtgaggttaggaggtgattagatcaggagggtggagctctcatgagtgggattattgctgttataaaagaggcctgagggagcttgttcaccccttcttccatctgaggacacatagaaggtgccatacatgaggaacaggccctcaccagagactgaatctgatggggccttgatcttggacttcccagcttccagaagtgcgggcaataaatttctgtttatagattatccagtcttaggaattttgttgtgtcagcccaaacaaactaagataaaaatcctttaaccttcatccaatgattgtgtggtaagttattgaggattgattaaagctctttactaggcattgccaatgcttaaagctctaaaatacaaaacagagagacatggatactacttatgcagagatcataaattctattgtttatatgattagactctacgactgttctacttaaatgctaattgaggaatgcaacaccaggtaaggaaaaggtctgagagggtttggttagtatgggttagcatcaggaggaagatttcatgggggaatttgactaatttcttaaaagtttaataatagcaaccatataaataaatatctttgcttttacttctttctttctcccctccctctccttttcttcctttctgtcttctatttgctgcataactactatatgtcatagaatatttgatgacattttcaagtgtaaatagctttcatctatattatctcatgttatccttgtaacaatcttttaggttaaatacagaagtattagcttctcttgctgatgagaaaatctgtaaacattgttttccaagtttttgccctacatacaaatataggacctcaaccccatataacataagttccgtcaagagttgctaaagtccctaagcagtatcttgtatgtgtttataaaccagtctggagctagctgattttccaggttctagcagggtttcttctgaccagtacttcgtttgccatgtcacatttactgggtactaccactcaagaatgcctttgctgtcacttccactggtctcataccactagcacactatgccttcagtttttagtcacatgccaatttcttttatttttaattttatttatttatttatttattgtttactttaagtttggggatacatgtgctaaatgtcaagtttgttacataggtatacatgtgccatggtggtttgctgcacctatcaacctgtcatctaagttgtcacatgccaatttcaagatttaagataggagttcaccaggagcttaggtaagaaaaaacactagtacttggctttgcctcctttattcttaagacttcgttattcagtcaaactcctgctagacttcctttccctaggaatggtttttcctgcttgccttttgcaagcaggttctttgctttttctgaatcctagtggtggtagatcaaggtggaacctatgagtaagaggtaggtcaagaactaaactttttgaattccagaaccaaaaatactgaatgaaaaaaaattaattaagagttctttttcattctaaaataggttttttacaaggctaaacagtgggaacaattttgagaaaggcacagagatgtacaaaagcttaatttataagaaacactagagttcccatatgctgtgaaaggttgctgctgagtaaggaaatgtgtagatgtttgaatgccagacaaagaaatttccaaatctcctttcaatttccttttaatagcccattaaacttttcatgccatgttttcatgccatggtttgtttgtttatttattgagagtctcactctgtcggccaggctggagggcagtggcactatcttggctcactgcaacctctgtctcccgggctcaagtaattctcctgcctcagcctcccaagtagctggattacaggcatgggccaccatgcctaatttttgcatttttagtagagacggggtttcaccatgttggccaggctggtctcgaactcttgacctcaggtaatccgcccgctttggcctcccaaagtattgggattacaggtgtaagccactgcgcctcgctgccatggtttatttgtagacccttatgatatacagcttataatttctacttatttcccatgatttcaatcacttcatgcttataaatacaaagagttttctgtattaaatttttaagatgaatttcattgattaatattatttaggacatagaaaaaaacacaacttaaattcagtgtttataataaaacaagttggtttatgcataatgtattcctatcttctagcaagcatctgctgcactaggaaccccaacactggctttttctgcaaagaaaaaaagtaacaaaaagaaaatatttacagctattttcagatccaaattcaaaattttagcttggactaggactcagtgggacttcattagaattgctgtagagaattggaaaactgaaaagagtttctgcattccctgtgcagcagcaggtctgcagaattcagaataatccccctgggaggcattaagcaacaagtcatgatttctcactttcctgtttcatttgtttgagagggtagttttccttttgtgagagagggtaaaaatgaagttattagttttggtttttgctctcctgcagtatcatgtcaagcttacttacgtctgaagttttcagctgttcctctatctggtggattaaaaaatgtgccctttataaatacgattagtatggagaattgatacattaacagttagctttataaattgacagatttctaaattaacctatggtccacaaatcaagttctatcactatttcctgccaccaaaatcagtgatgaagcctcttccacactaaatgaagagtggcgagggacagaattccacttgtcttccttttgctgcactaactacaccaggcaaagccttcttaaaaccctgatttttctagatacatgtttcttagataagttacatgtttcttagataatctgtaatatatttgactactaatgtagtagtttttaaaaatattggtagaacaacctgatattactttaaaaataaaacagaaaatagtagtggctaatgattcctttttttttctttccaacatttttatgattccaaaaattttctgttgtttttataggatcaaagatttttttaggtaaaagtagaagattttttgtggtgtgagatttgaggagcatgcaccaggttcatcttctcaagaacagtgtcttgcccatccctgagaactgacactccccacttagagatgcatttcctttgtgaattaaggagggcatgctgaagaactggaagtagcaactttattccctcaaagagggaagaggctctccagggtgtctcaatacctttatattattaggtttcacttaatacctttatattattaggtatccacaggttatcctggccttcattgtgcagcattgcatgagacactttagtttccatgcttagctgttagctgcttcaggcagggaacgaggatgctgttgatgaaagatgaaagatataaggaagggaaattaaatggcccctaaattacaagaagggtgataatattacaggctaaggttaagactgtgtaccaagacatttaacgcagtaggttaagaaggcagagtaataaagagacaaccttggcaagtgccaccacaaacccaggaagccaggactcctgcagtgggtctccatgtggtgaagagtcccactcttctgtcttctgactgtgctcctcttctaggtaggaggattttctgggtctaaggggatgtttccacccagaaccctccttctaaactatgccccagcaatcccagaaaccatcacttcatgtccagtgcctacatgaacctcttccccatatccatccttccagttatacccatgcatgttcctctagatccaagcaggatttccatttgtactcttgcccaggcctggaaaatgttaggacagcctgaccatgcttgttcgtaatacacattaatctggaactggtcctgtgtaagtctggaggttaccagagaatgaaggagaatgaagtctaattagttctttgcttatgttcttagggcttaggctgtttaggcctggatttgctcaagaaaattcacacacataaagatcaatgatgtgtatatggagatctgaaaagctgagttttacaactttggaatcaggttgtcttgttacatgggttttaggggagaaaagtggaaggagaaccatccctgcacatcagagcgccagtaatgaataaattattagttaaaagagatagcagggttgagaagagatttgacatggaagggctatattggacatgcttatagtcagagagaagtggtgagtgacaagggaagggaaaatttgctttagtatatactgacattattaaaacaagtactttgagtttattgaataatgaacgttcctctttatatagcaaataatttatcattactttttttggtagcgtgtagagttttcctataatgttttactatccatatactattatatattctatataataaagttcaatttacagactcctcagtgtaggactactaatactaatccatctagtgttgatgactcattgttttgatgaaggcacctgtacatctggagaatattatggatggaattttgtctaccaaaattcatatattcgagggctaacccctaatgtattggtatttgaaggtaactacctttgtgaggtagttaggtttagataagctcatgagggtgggagcctcatgatgacattattacccttagaagaaggaagcttggtctctccctcactctctctgccatgtgtgaacacagaaggaaggcgactatctgcaagttaggaagagggacctcacaagaaactgaccaggctggcaccctcatctttgacttccagcctccagaaccatgagaatataaacgtctgttgtttaagccaccaagtccatggtcttttgttatagcagactaagacaaatatacagacatagagttgataatttggggcataagaatgagtatatgctgaagccctgtagggcttgtcctgcaacttatttaaaatggccctggaagtcacattttttctttgactactaaaggaagcatatgtaactccacagtggaacacagtaacatatttgcttttctgtaaaattaatttgaaagtctgtggatctagcatttttctttctggtgatgcttggtcccaagaaaaccatattctctcctactatgatcagtgttctctgactggacaccattcagaacactagttctaatttatgtgctagtgacccagcaagccacagacttgcatattcacttgagcacatttatttatcttgtatgcaaggttaatggagagcaaggaagttagtccttgctatttcaagaacatgtacatgaacaacttggaagtagcttatttcaaatcgcacacattggtctcaatcaaaataactgtttacagtttatcagatgtggcatgagatccattgccagttggttgagcaaagtccaggcataaacaatggtaaaaattgtgtcttttttgataagattaaaaactatgataaatggttgaataaaaaatcaatgtgggataacttttattatgatggcttgcattcttatccatatgttaaatcagtgttgtcatattaagaagagaaaaaatgattttaaaataattctcagcatgtgtagttgattagaagtagatttccatgaccgggcgctgtggctcacgcctgtaatcccagcactttgggaggctgaggc

SEQ ID NO: 29 - DNA, 12262 bp, Homo sapiens
aatcagaggaagaacagcctgctctgaggttgaactttgcaaagctgggaatgttccttctttgaaggagatcttagtttaggcattcatttttattttattttttatagagttaatgaaccagtcttacagtcttcctttagccaatgagttaaagaaatctttgcataagtttattcaaatcagaggttccaccaagatatccctgtaaatgcaccttccagagccaatctgtgtgtaggcatggaagcaaacatcctctcttggcttctgcagcaaattccaagtggcaatggaactttaccttcgctgactcttttgtttcttttttcccgtggattctgtgcttttgtttttgtttctggttttggtttttatataactcagaagttatttcctaatgtgccagaaatgtttgtgaatttggttttatagcctatttgatcatcctttttaggtggagacctattctgttgggttagagatgacagaaaatcttatttgtcggttggtttgtttgttcaagaatacactgaccttctacaagaaaggagagctctttgacacctggaaattttacagaagcttgggacagctctgaatggcaacacggtcctgagatatgtgattacctgggactttcattggacctgcatttcagctctactctcctcactgccctatgctgctttgaccctaaaagtgaagccagcttggccaggtgcagtgactcacacctgtaatcccagcactttgggaggccgaggtgggcaaatcaagaagtcaggaaatcgagaccaccctggccaacattgtgaaacaccatctctactaaaacacaaaaaaattagccaggtgtggtggcacgcacctgtagtcccagctactcgggaggctgaggcaggggaatcacttgaacccgtgaggaggaaattgcagcgagccaagatcgcgccactgcaccccagcctgggcgacagagagagactccatctcaaaaacaaaacaaaacaaaacaaaaaaaacaaaaagtgaagccaactcaattgtctcatagaactgatctttacggtgtttttaaataaacatagaaattggccctcccagtcttaaaacttcaaaaacttacatttgtcttacctcagttcctttctcaggaatccaatcatcaaggctcccagatagtatcaatgaacggaaacttaccagatcacgatatctggacaatgagatgtcagatccccctcatccatcctgattacctaactgactacctgcttcctgttggccaactactcttccttacccctccctaattcttgttttcccacaaatggttacatttctgtcctgctatagaagcccttaattttaattggtcgaggagatggatttgagactgattttttgctctccttggctgttgcacctgaatagcctttttccctggcaatactttttgtctcagtgattggctttctgtgcagtgagcaatgggaccaaacttctggtgttttggtaacaaattttggtttcctgactgtgaatgcattgcttgtgactcagctgccatgagctgggagagtttcaaaagccctctaagcagctacctgaccattttggccagaggtggattttcgtctctccccatttgggcccacttctgccaaccccaaccatgttcctgattgcctaggaagaacagcctttgaaatttgacgtctatgtacagaaaggtgagtgtcttttatgggtactagacagtgggaatggttcctctccatttgggaaatcccaaaggcatatcagtttgcaggttaaacaagccaaactgatggagagaggataataccttgactgattcagtttgaacactcttggggcttgttcattgctacagaagttggattgtgttttggtgattgtttgcttgtgtatgtctatgtagttatgggatgtcagggtttgatcccagagtgcagcccacatgggtgcattctttgggttagtctgtatgtagttgtgggttgacagagcaggggaaattctacagccataccactctgagtgtggctgatcttgtctgatcgcgatgtctttgcattgtagtgctgtcttacaattgaattcattttgctgttgaatgggaaagcaggatggaggtccatagacggggttttaccatgctgctgcacactggtcttgaactcctgggctctagtgatccacctgctcagcttcccaaagtaatgggaatacaggaaacaaagacaagtgaagcagcaaacttgccgaacaatctctgccacaccatatgcacttcaaaagaccaaccacagtgattaaagggatgaaaaagatgacctgcttgaaaactctaaagaacccagtattatttgaaagaagaggaagctgaatggtaacttaataactatcttcagatttcaacaggactactacttctgttttatccatttctatagagtttgaaactactaaggaattattctgaaatctttctgtaactagcatatttgactcattttatactaattattataacttttttccatttaaaaagtctgaacttgtatttggcattcttccatttgaaagaataagtattaggaagagataatcaaatagtattactctctttttcttcttcttatatatgaaaagatggtattgtttttcttggcataaacaacctttgacttgttcttgccatttatcagactcaaaaatctgtggattgaagtcttctgttacttagctccagctatgctgtgagttattattgccaagccttaataatattgacaaaaaagggggaaataaacatgttagaagttaaattgcattccttgttactttataaactgaaataacaagacttggagtcattatcttgtagatttctggataaaattaatatgtagggcctttaacttgttttgaatctcttaatgaacattttctatgtgagaagtattgtttagtgctaggtttttgggtaaaagagaaaaaaagagaaagagtaagacaggatatcagagctcaagatgcttctaatctggtggtaaagataatttaatgaattagaggtcggtaagcaacacctaatcatatacatgtgtagtacctcaagggaaacacaaatcctgcttgggcaagaacactgagatagatgtctaaacaggatttcttgtttttaactctcaagtttcacaataacatagctcagttcgttttagtgcccccgtctactctcaaactccatccccgacatattttcatcagactattctttctttctctttgttgagttggtttttgctttgttgttcttatatctgagtttctccttacttataaattttttttacaacttttcacctgccaaagcctcaattttatctcgtttctgctaattgcattcttttatttcctgcttttatgagccactctcctataaaatttctcaatttaaattccagagaaggaacttctgattatccccacttagcttcataccgtattatgtcataggtcccaagccaatgcttgggtcagaagccaatatgcattcaatttagacttactcattatggcttctcctgcaacaggaactgtggtcctggcagtttcctctggaatgagataaggcatagcaagtatcgtaatgtgctgttaaattttgaagaaagtatggaatttgaaaaattgaaaagaaaaagataaggattgaaggaacatttggagacaacccagatatgctgatgaacacagtgaggatagggcttggagagatctactttatctagggagaaagcatgctcagtagtggaaacacttctggttaggcagggtgagaacaggaactagcagctctctaaagcaagccaagactttagactgattgttcttgagtccataacttaacaaacaatagttaagggaatttagttgtcctatgtgcctattaaataactggataggggttttaaaatcattttttaaaaaagcaattaaaaatacctttcattttgattagtaagggaattttttaaagagaaactcaggacatatttgactgtaggaagagattatactcctttcacttagaaaaatacataacactggaggagctagatgtgataaaccaggaaatagaaaaagtgccattgtaagtatagacagatatcgggggaaattcagccagatattgggcaaaattcacccccgatatttcatgtaggttcttttctattttccctaagcatcagccggtttgagaaataaagggacagagtataacagagagaaattttaaagccaggtgtctgggggagacatcacatgttagtaggttccgtgatgccccacaagctgtaaaaccagcaagttttcattagggattttcaaaagaggagagagtgtacgaatagggtgtgggtcacagagatcacgtacttcacaaggtaatagaatatcacaaggcaaatggaggcagggcgagatcacaggaccacaggaccggggcgaaattaaaattgctaaggaactttcaggcaccattgtcattgataacatctgtcaggagacagggtttgagagcaaccggtctgaccaaaacttattaggcgggaatttcctcgtcctaataagcctgggagcgctatgggagactggggcttatttcatccctacagctcgaccatagaagatggccacacccaagggggccattttagaggcccaccctcaggggcgcattctctttctcagggatgttccttgctgataaaaagaattcagtaatatttctcccatttgtttctgaaaggagaaatatggctttgttccacccggctcactggcggtcagaatttaaggttatctctcttattccctgaacattgctgttatcctgttcttttttcaaggtgcccagatttcatattgtccaaacacacatgctctacaatttgtgcagttaacgcaattatcacagggtcctgaggcgacatatatcctcctcagctgacaggattaagagattaaagtaaagacagccataggaaatcataagggtattgattggggaagtgataagtgtccatgaaatcttcacaatttatgtttagagattgcagtaaagacagacataagaaattataaaagtattaatttggggaactaataaatgtccatgaaatcttcacaatccatgttcttctgccatggcttcagctggtccctccattcggggtccctgacttcccgcaacagacagagatatttatatttcagcctgaccctaatcctaacccaaattctaattctaaaagagatcacatttaaaatatatctttattttggaagaattgcaaagctaaacttttctaaaatcctagtctttagcgagacaatgttattttgagttaagtcaaaaattttgcacacacacatgcacacatgcatgctgtggctgtcttgtggcttttccttgaaatgggtatgtgattatattattttccccctccctttagaaagacataacacatgtcattggtcattattttgccacatggtgaccctagtttaaagttttgttctatgttcatgttaaaggagaaaaaatgataaatgacaatgtaatcaagaaattgaatataaacttgccgattcgtctaattacagagtttagtgctgtgggttccaatttgtctcttcctagacagttgctttgtatccatgaatgaatgaattcgtagtattgaaaacctgctcccagtgctatgtaatttatcaaataatatgtgtgagtataagatataactgctgcccacaaaaactcataatttatttgaggacacaaaactcatatacataaaataattcatgaatgagacatattcacatgttatatgcaggcaggtcctgcttttactgtgcttgtggaaatccaattttaaaatatattattttaagataaattctcacctgggagtatgttgtattctaacactattatctttgtcttttggggcatatttggcttacatacaagtcaaagaatactagtttaaaaagttgttaaattcaaatttacccaacatatattatctattatatgttatgcattcttttttatatgttatcacaaactacaatttcagcactgtccatgttcttcgttttttagataagaaatggctcggaaaagttaggtaatatggccaaatttacacatctactaagtgtcaatgctgagatgtgaaagtcagtttttctcagtcaaactttaagagtctccttactgtctatgtgaatgtttgtgtcccctcaaaatttgtatgttgagacacaatccccaatgcaatgatgttaagaggtgaggttaggaggtgattagatcaggagggtggagctctcatgagtgggattattgctgttataaaagaggcctgagggagcttgttcaccccttcttccatctgaggacacatagaaggtgccatacatgaggaacaggccctcaccagagactgaatctgatggggccttgatcttggacttcccagcttccagaagtgcgggcaataaatttctgtttatagattatccagtcttaggaattttgttgtgtcagcccaaacaaactaagataaaaatcctttaaccttcatccaatgattgtgtggtaagttattgaggattgattaaagctctttactaggcattgccaatgcttaaagctctaaaatacaaaacagagagacatggatactacttatgcagagatcataaattctattgtttatatgattagactctacgactgttctacttaaatgctaattgaggaatgcaacaccaggtaaggaaaaggtctgagagggtttggttagtatgggttagcatcaggaggaagatttcatgggggaatttgactaatttcttaaaagtttaataatagcaaccatataaataaatatctttgcttttacttctttctttctcccctccctctccttttcttcctttctgtcttctatttgctgcataactactatatgtcatagaatatttgatgacattttcaagtgtaaatagctttcatctatattatctcatgttatccttgtaacaatcttttaggttaaatacagaagtattagcttctcttgctgatgagaaaatctgtaaacattgttttccaagtttttgccctacatacaaatataggacctcaaccccatataacataagttccgtcaagagttgctaaagtccctaagcagtatcttgtatgtgtttataaaccagtctggagctagctgattttccaggttctagcagggtttcttctgaccagtacttcgtttgccatgtcacatttactgggtactaccactcaagaatgcctttgctgtcacttccactggtctcataccactagcacactatgccttcagtttttagtcacatgccaatttcttttatttttaattttatttatttatttatttattgtttactttaagtttggggatacatgtgctaaatgtcaagtttgttacataggtatacatgtgccatggtggtttgctgcacctatcaacctgtcatctaagttgtcacatgccaatttcaagatttaagataggagttcaccaggagcttaggtaagaaaaaacactagtacttggctttgcctcctttattcttaagacttcgttattcagtcaaactcctgctagacttcctttccctaggaatggtttttcctgcttgccttttgcaagcaggttctttgctttttctgaatcctagtggtggtagatcaaggtggaacctatgagtaagaggtaggtcaagaactaaactttttgaattccagaaccaaaaatactgaatgaaaaaaaattaattaagagttctttttcattctaaaataggttttttacaaggctaaacagtgggaacaattttgagaaaggcacagagatgtacaaaagcttaatttataagaaacactagagttcccatatgctgtgaaaggttgctgctgagtaaggaaatgtgtagatgtttgaatgccagacaaagaaatttccaaatctcctttcaatttccttttaatagcccattaaacttttcatgccatgttttcatgccatggtttgtttgtttatttattgagagtctcactctgtcggccaggctggagggcagtggcactatcttggctcactgcaacctctgtctcccgggctcaagtaattctcctgcctcagcctcccaagtagctggattacaggcatgggccaccatgcctaatttttgcatttttagtagagacggggtttcaccatgttggccaggctggtctcgaactcttgacctcaggtaatccgcccgctttggcctcccaaagtattgggattacaggtgtaagccactgcgcctcgctgccatggtttatttgtagacccttatgatatacagcttataatttctacttatttcccatgatttcaatcacttcatgcttataaatacaaagagttttctgtattaaatttttaagatgaatttcattgattaatattatttaggacatagaaaaaaacacaacttaaattcagtgtttataataaaacaagttggtttatgcataatgtattcctatcttctagcaagcatctgctgcactaggaaccccaacactggctttttctgcaaagaaaaaaagtaacaaaaagaaaatatttacagctattttcagatccaaattcaaaattttagcttggactaggactcagtgggacttcattagaattgctgtagagaattggaaaactgaaaagagtttctgcattccctgtgcagcagcaggtctgcagaattcagaataatccccctgggaggcattaagcaacaagtcatgatttctcactttcctgtttcatttgtttgagagggtagttttccttttgtgagagagggtaaaaatgaagttattagttttggtttttgctctcctgcagtatcatgtcaagcttacttacgtctgaagttttcagctgttcctctatctggtggattaaaaaatgtgccctttataaatacgattagtatggagaattgatacattaacagttagctttataaattgacagatttctaaattaacctatggtccacaaatcaagttctatcactatttcctgccaccaaaatcagtgatgaagcctcttccacactaaatgaagagtggcgagggacagaattccacttgtcttccttttgctgcactaactacaccaggcaaagccttcttaaaaccctgatttttctagatacatgtttcttagataagttacatgtttcttagataatctgtaatatatttgactactaatgtagtagtttttaaaaatattggtagaacaacctgatattactttaaaaataaaacagaaaatagtagtggctaatgattcctttttttttctttccaacatttttatgattccaaaaattttctgttgtttttataggatcaaagatttttttaggtaaaagtagaagattttttgtggtgtgagatttgaggagcatgcaccaggttcatcttctcaagaacagtgtcttgcccatccctgagaactgacactccccacttagagatgcatttcctttgtgaattaaggagggcatgctgaagaactggaagtagcaactttattccctcaaagagggaagaggctctccagggtgtctcaatacctttatattattaggtttcacttaatacctttatattattaggtatccacaggttatcctggccttcattgtgcagcattgcatgagacactttagtttccatgcttagctgttagctgcttcaggcagggaacgaggatgctgttgatgaaagatgaaagatataaggaagggaaattaaatggcccctaaattacaagaagggtgataatattacaggctaaggttaagactgtgtaccaagacatttaacgcagtaggttaagaaggcagagtaataaagagacaaccttggcaagtgccaccacaaacccaggaagccaggactcctgcagtgggtctccatgtggtgaagagtcccactcttctgtcttctgactgtgctcctcttctaggtaggaggattttctgggtctaaggggatgtttccacccagaaccctccttctaaactatgccccagcaatcccagaaaccatcacttcatgtccagtgcctacatgaacctcttccccatatccatccttccagttatacccatgcatgttcctctagatccaagcaggatttccatttgtactcttgcccaggcctggaaaatgttaggacagcctgaccatgcttgttcgtaatacacattaatctggaactggtcctgtgtaagtctggaggttaccagagaatgaaggagaatgaagtctaattagttctttgcttatgttcttagggcttaggctgtttaggcctggatttgctcaagaaaattcacacacataaagatcaatgatgtgtatatggagatctgaaaagctgagttttacaactttggaatcaggttgtcttgttacatgggttttaggggagaaaagtggaaggagaaccatccctgcacatcagagcgccagtaatgaataaattattagttaaaagagatagcagggttgagaagagatttgacatggaagggctatattggacatgcttatagtcagagagaagtggtgagtgacaagggaagggaaaatttgctttagtatatactgacattattaaaacaagtactttgagtttattgaataatgaacgttcctctttatatagcaaataatttatcattactttttttggtagcgtgtagagttttcctataatgttttactatccatatactattatatattctatataataaagttcaatttacagactcctcagtgtaggactactaatactaatccatctagtgttgatgactcattgttttgatgaaggcacctgtacatctggagaatattatggatggaattttgtctaccaaaattcatatattcgagggctaacccctaatgtattggtatttgaaggtaactacctttgtgaggtagttaggtttagataagctcatgagggtgggagcctcatgatgacattattacccttagaagaaggaagcttggtctctccctcactctctctgccatgtgtgaacacagaaggaaggcgactatctgcaagttaggaagagggacctcacaagaaactgaccaggctggcaccctcatctttgacttccagcctccagaaccatgagaatataaacgtctgttgtttaagccaccaagtccatggtcttttgttatagcagactaagacaaatatacagacatagagttgataatttggggcataagaatgagtatatgctgaagccctgtagggcttgtcctgcaacttatttaaaatggccctggaagtcacattttttctttgactactaaaggaagcatatgtaactccacagtggaacacagtaacatatttgcttttctgtaaaattaatttgaaagtctgtggatctagcatttttctttctggtgatgcttggtcccaagaaaaccatattctctcctactatgatcagtgttctctgactggacaccattcagaacactagttctaatttatgtgctagtgacccagcaagccacagacttgcatattcacttgagcacatttatttatcttgtatgcaaggttaatggagagcaaggaagttagtccttgctatttcaagaacatgtacatgaacaacttggaagtagcttatttcaaatcgcacacattggtctcaatcaaaataactgtttacagtttatcagatgtggcatgagatccattgccagttggttgagcaaagtccaggcataaacaatggtaaaaattgtgtcttttttgataagattaaaaactatgataaatggttgaataaaaaatcaatgtgggataacttttattatgatggcttgcattcttatccatatgttaaatcagtgttgtcatattaagaagagaaaaaatgattttaaaataattctcagcatgtgtagttgattagaagtagatttccatgaccgggcgctgtggctcacgcctgtaatcccagcactttgggaggctgaggc

SEQ ID NO: 30 - DNA, 2239 bp, Homo sapiens
tgctttcaggataatgaccaaattccgtgatctgttccctgtttaccaagctatccaaatttatctcttggcttctattcccagccccaatttccatcccacacagtacgctccagatacactcgcaattcccaggattcattgtgccatcttgccttcatatgtttctctgtgctagaaatgccttccactttctccaatctgcctctttgttcaaaagccaattcaaacgtctctgggaagtttcccacaccacgagaaaagctggtctgtgcctcctctgcgccttcactgccgcgctttcctagccagattttgcaattgtatttctgcaattactcaaacgtgtttccttctgaccagacaaagctccccaaggccggacttcattcatctttactcctaatgcttgaggaagggcacatgagttgcagatgcttagtgactattttttttagtgatagactcatgggggaaggcagcttagctatagctaagacaaccttggggtgtgcaggtgggggcggtgaggtgacttccaaccagaaaagaacttgtaaatctataggcataggtcataaactgagcgtgtgtttcacccaaagatgtgttcatttctctccagggggacatagctgggggtgagagaagcgtggaggacacaagattttggcattgaaaaatagcaaagagtctaaaaatgttattcctggaagggacattcaagatcataaaacattaggacaagactgcatcttttaaatgtacattttaaaatatgcttcaacactctgctattgaggacactggctcagaaaggcggaactgactgcattaaggccataaaacaatttagtggtttcttcacccttttttttccctaagagacagggtctcactttgttgcccaggctggagtgcagtagcataatcacagctcactgcagccttgacatcctgggctcaagttaatcttcccacctcagcctcccaagtagctgggactacaggtgtgcacccccatgcctggctggtttttaaaatttttattattttttttttaatgtagagacagaggtctccctatgttgccctgcctgatctcaaacacctgggctcagccatcttcccctgcctcggcctcccaatatgctgggatttcaggtgtcggccgctgtgccatttcactttccccacagtattaagtcatagatgccattcatttccatgctatactgtcttttaatgattgccatatagtatttctttgtaacagaaataggcacttgaattccaattttaatttttaatttctcgtgaccataaactctgaagtgttacttcttctggctagaattaccattagagttattagacctaactgattgaaaccacataagtacaatacaaatttgataacagtttgcatatggagagttacattttatttattgagatggatttttaaaatgtatgttcatgtttacattgataaatattattgattcctagattggaacaggagtcactatcaacactatccttatttttttattttaatccatatatgagtttagaagcctttttcacaaaattatgtggaactggaaagagttttattattacagtgtcactcaattctttggattctttccaagatgcttggcaaaaatcacttggagctcttttattgaaaatcagtgaacagctccatcagttcctccttcagcgttgtatcatggcaacgccttttctctaagtctgttcccctgaaggagctttgctgtgatttgaatgtgtcccccaaagctcatatgttggaaacttaatatccagtgcaactgttttgagaggtgggacctagccaggcatcgtggctcacatctgtaatcccagaactttgggaagttgaggtgggagggtcacttgagcccaggagtttaagactagactgggtaacaacatagtgagaccctgtctctagaaacaaaaacaaaaaactaaattaactgagcatggtagcacatgcctgtagtctcagctattctttaggctgaggtgggagagttgcttcagccggtgtgggtgaggccatagtgagctgtgattgtgccactacacaccaacctgggtgacagagtgagaccctgtcttaaaaaaaaaaaagagagaggtgggatctttaaggggtaattaggtcatgaggactcttccctcacgaatggattaattccattat

SEQ ID NO: 31 - DNA, 4631 bp, Homo sapiens
atcctttttctctctcacatacacatataggcatgcatacagacattctcattctctttctctctctccccccacccctcccttttctcacacagacacattctctttgtctctcacccttgccccctcctctgtgtctctcacacacattctctctccctccttccctctctctcacacacagatgcatacatacacacgttttcattctctttccctttctctctctcccctcctcatctctcttcctctctctctctcacacactttctctctccctccttctctcacacacacattctctctctccccctttttctcactcatctctctctcctctgtcatctctccccccaacacacacgcattttctctctctttccttggcttcctctctctttcacacacacacatatacacacacacgtgcataatctcattctcattctctctctcctcctctccttcttgctcacacacacacatacacacacttacacactctttcattctctctctccctctacccttcccatctctccttctctctttcttcctcacacattctctctcgcccctcctctttcacactcacattctctctctcactttctctccctccctctttcctcactccctctttcacacacacacataatctcactctcattctttctccccctccttctcagtcacacacatgcacacagatacatacacacattctcactctctctctctccgccttccccaactttcttcctctctctctcacaaacacacatctcctttccgtctccctccttctcttcccgtctctctctgcctctctgtcacacacacatacacactttctcattatttctctctctcacacacacagatacatacattctcattctctttctctcacacacacacattctctttcacacacaaacacacacacacattctctttctccctctccttctctcttccttcctctcatgctgggggaatcaagatggctatattgtgagctgccctatagagaggcccatgtggcatggcacacccaaggaactgagacactcagtccagcctttcacaagaagctgcagcctcaccaacaccaggtgagtgagcttagaaatgggtcatccagatccaggcgagtcctgatgactgcagccccagccaacagcttgactataatctgatgagaggccttgagtgaggaacacccagccaaacacctctcagactcctgatccacagaaacaatgaggtaataaacattcgttgcttaaagctgttaatttaggggtaatttgtcacatagtaaattataaccagaacaccttgccagcccttaattatttatcatttatttatatttttgctaatctaatgtgagtactaccaatgttgacatctgtatttgtgtcagtatgtgtgtgtaaattgcttcaaatcctttgcttatttttctattaacctgtctatcctttcttgttgttttgtaggattctaatgtatttaagattaatgctttatttttcatacatggtgcaaatatttttttccatctgtttaaccaaacataatttataattcatgtgcagttgagtttgctgattatgtctcttgtcatgtttagatttgtattattattagaaaagcattacagttccaagatacgtaatattttcatgtattttcttccaaaatttcagagacttgttcagtatttagcttcttaacctgcccatagtacattatttctagtgaggttatacagagagctaaataaaactttccagattgataatcagttgtcaaaatatcaatgtgatatagtccatccatttttataagttgaatcattataaaaacatgaatatttctgaactctatattatgtaccatcaattttcttactgtttcctgcaataaccacactgtttaaattgctataattctgtaatatgttttgataattggtgggattagtttctcactggtcttcctttcaaatgttgtcttagtgttttgcgaatattttttccataatgaatttaaagtaatcctatacattccttagaaattatatttagagtttaattttcagataaattttaacatatagaataattttggggagagtttacctctttcaaatactgaatacttcttaaccaagaacatagtataactttttctttttttcagggcctgtgttatgaccttcaatagacttctatattctaaataggttttacaagttttcttgtcaggcctaaccataagtatttaatgagttttgtggctgttctaaatggactcatttttctattacattttaaattcatcattgctggtgtataagaaagctattaattttttaatattgatttattttaatctggctactttcctggactcttactagttcttacagttttttattgattcttgctgatttttttcttttggtggacaataactttatctttgtcatgtgtgtatatatatgtgcttgtatatgtgtctatatatatatgtgtgtatgtgtatatacacacacatacacacattttgcttttattttattgcatggaatagcatcttcagcaaacatcaatattgacgtggtagctgggaaccttttcttatttctgatttactgcagattatcttcgtattagctttcctgctaccactataacatattaccacaaactttgtaacttaacccaccacaactgtatttccttacagttctggaggtctgaattcagaatgtgatgtacagggctataatcaaagtgtctgcagggctggttccttctgaggggaacatgctctcccttctgcaagggaggatctgttccttgtctctatcagctgctataagccacctgcattccttgggtcaacgcttcttcttcataacgctccaacctcttgcttgcttccatcatcacattgccttcacctctgtctaaattcctatcacccagataattcagaataatctctcagtctcaaggttcttaacttaatcacatctgcaaaccctcttttaacacgtaaagtaacacattcacaagttccgggaattaagacatttttgcggggaggggacattgttaaacctaccacgcttaaaatatttcactattatttatgaagttttcttaaggcttctggtagatttttttaagtcactttcaagagtatatttctataactcgcttactaagagcttctttcttctgagtcagtaacaaatattgtaatgaatcaaatcatttattcatccatattgagatgtttattcactgttctcttttgttaatgtactaattaaattaatgcacatgtttcataatttgaaatacttttgcactcccagtatacaccttttgggcataatgtattaatattagtctgctaacacattcctgaaattaatttgtgaatagttcatttataattttcatatctgtattcacaagttttcttttctgtgctttttttgttaaatcttgatatcagtgttatattactcccataaaattattttaaaaaaattctatttctttatgtcagtcgaaaaacattacataacaaagaagttatctctataaaggtacagttagcctcacccataaaacatcctgcacctgatttccctttatcgtgggcaataagctctcaatatttcccctgacattatcaatatttctgctattccttaggtgaacttttgtcatttgtgtcactagcaaataattcttactaagatgcttaatttataacataaaccgtacttatgtttgatatggtttggctctgtgtcatcacccaaatctcatgttgaatttaattcccagtgttgggggaaggacctggtgggaggtggtggttacatcacgggagcagatttcccccttgctgttctcgtgatagtgggttctcatgagatctgattgtttagaagtgtgtagctctttcccctttgctctctctctcctgtttcagcatggtaagatgtgcctgtgtctcctttgccgtccaccatgattgtaactttcctgaggcctccccagccatgcttcctgtacagcctgcagaactgatggaacaccaggctatagtttcaggaagccagacttgacccagacttgaccttgcaaaaaatagcaaccccttcagaactggtaaagcaatgagaaagaattgctcagaacttcatggagctgagccattcacccatcctggaacatccaccttcctctggaattatttttttaatgttttcttccttcttgtttaatccactaattctctctcttttcctctgtttctctctctctcatctctgttcctttccatagcaacatagactatatatgagtaaatatttgaatatatttaataataaaagtacatacacaaatatttacagaactgctcaatcagaaaaaatacacttaataaataattgttcaccaatggccttgatgtgctgtaatttgtatttccaccaaatgagtcccagttaccttttatgtgtattttccatgcttgttcacctatttgactttatactaaaattatattaaatttctctctaatgtttt

SEQ ID NO: 32 - DNA, 36328 bp, Homo sapiens
agtcaatgctagaaatggacgtttagttattgaatcccgctaacgaggggagccaacaagagagggatgtcggcatcgggtgtgcggttccaagaactgattggctgtggagattagaagttaggaacctttgcaacggaaagcggcctcgggcaggcgccttttgagcagaggagtaaaaccgccagagcgtctcatctctgggcccggagccccaggctcgttctcctcagcccctgccggcggcggcgctcttgcagccattcctgtgaggtcgtttttcggagcagccgggccggccgaggagtaagtaggcgccagagttctagctcgggcatctgcctcggggccctgtcgccgccgcgccccggatcctgcgttggtcctgtccgataaagcggaggtcggccctgcttgctgacgagaccgtaaaaaccacggcgcttggcgccctgccgccgccacaccacaccaaagtgtacctgcccgaggctggcttcgggcgcgagcttgcatttgtgactttctcttaccgtctttgtttgcttcgttttaagtattacttccagataagggacacattctcgaaatactttgaaaacagttttgaattttgttcctcccgttgaaacggattaaatttggacctttcaagctacactgtgcaatcatcaatctcaataagctcttaataggctcattcttccgtaggctacaaacaaaataaagatcataacatcctgcggaggaagccattggtccatgtagagtcgccagatgtcaattaagagtagatcgcttttcagagaatacttaacgactctggtttagacctagacttggaactttgaggtgtttggaacactgggcagaattttcctttgttacaaaacaaagtttatgagaacgtaatttgtttttgttgtttttgttgttagtattgaagcaattttggtgcaaaccaaaggataacaaagcaaaacaatgaaaatcacccagagttccattacccacactgaaccaacttgaatatattggtttattttggcttttttccatatgaaatgttaaattttcttgtactcacgtgtagaatatgatagtttgctctttcatgtaacatgtctcccaatttttacatacataattctagtttcagtaagcatttttataactacactctttttcctttgttattgtatgtctaggttatttcaactttgcactgttgcttgtaactactatgtgatgaggcagtagctagattagtatttagaacgtgagcattcaagtcaggcagacctgggcttcacaacttactgtgcaatttcaaagagtttaacttttttgagcctcattttacacagtaacatggggataatggttctgattgcatagaattattatgagagtaagatgaaataatgagtggaagtgcctgcagcatgtattgttagtaaatgctgtattactgcaggcaaatttttcttttgttgtggttttttggtgacatgtatgatttatttccagattttgaatatacttaaatactattaaccacagtaggggtatggggtttgatccacagcttttcatatattttatacaatatattgtgtgtttgatacacagcttttcatatactttattataagtaacacatgaattagaaataatttttcacaataggaaaaactttttaaaaattaaaatttataatcctgctaaccgtaggtgaatagtcacattttgggcaatccttttttatgcatatatatgtagtggttttattttattttattttatttttattttttgaaacggagtcttgctctgttgctcaggctagggtgcaatggtgcgacctcggctcactgcaacctccgcctcacgggttcaagcaattctcctgcctcagcctcccgagtagctgggattacaggcgcccgccgctgcgcccggctaatttttatatttttagtagagacggggtttcaccatcttggccaggctggtctcgaactcctgacctcgtgatccactcgcctcagcctcccaaagtgctgggattacaggcatgagccaccgtgctgggcctgtagtgttttctaaaaatagaattatattataaattgggtttatcaacttgctgaaaatggcagaggccagtgcgatgagagtagggtgattaagggagtaggaagtaatgcaggaaagggagtttgtaggatttagatttcactgaaagtgtactggacaggttgggcatagtggctcaggcctgtaattgtgtcactttgggaggctgaagtggaaagatcccttaagcccaggagttcgagccagcctgggcaacatagggaaaccctatctctataaaataaaaataaaaataattattttgaaaaaaaagtttactggacagagtaagttcagggttgaggagtgacctgatttgttttagaaggctcatttggctgccatatggagatagactgcaagggaccaggggaggaagatgcaatccaattaggagagtatttaagtaatctctgtgagagatggtgttagtttcgatcagggtgtaagtagggaaaaatgattgggttctggatatattttgaagggagaagttataggattcactgattgatgggatgtggaattcaagagaaagtgacttaaagaattttggtttgggcagttaaacagatacagttgctacttaccaagatagagactgaaagttgggggaaactaaatagagttctgtttcagtcatgttacctgttgtggagtctaactagttggaacaggagtatgaaagacttaatcttctgttcttgaggtatcaatttgtcccttcatttctgtcagtttttgctacatatattctgttactaggtgcatctatccttgtaaattgttacatcttccttgtgggtttatccttttatcattaaaaatgtttctctttttctctagtaacattgttttaaagtctattttgtctgatattaatgtagctatttcagttctcacgtgattactatttacatgctttgtatcattgactctaaaatgtgtctcctgtagacatatagttggatcttggtttgttttttgtttgtttgtttgttttttgttttgagacagagtcttgccctgcctccttggctggagtacaatggcgtgatctgggctcactgcaacctccacctcccgggttcagacgattctcccacctcagcctccccagtaactgggattacaggggcccgccaccacgcccagctaatttttgtatttttagtagagacggggtttcaccatgttggccaggctggtctcaaactcctgaccttgtgatccacctgcctcggcctcccaaagtgctgggactacaggcatgagccactgtgcctggccggatcttgttttttttaatctgataatttctgccttttgatccaattgtttaatcattcacatttaatgttattgatatagttggatttatgtatgccatcttatttttgttttccttatgtcttgtctttttcttttcctgtctctcctttactgctttgttttggatcaagtgaatatcttctaatgtagcattttaatttcttgaatgattttttacactgttttaagttttttttagagactgtagtggtgctctagggcttaccgtacaattagcttaacttattagaatcagcttcagatttatactaactcaattgcagtgagatatagaaaccttactccaatatagttttattccatgtccctgtttttttgtggttttgttgttgtacatgttatagttgttacaaactcaacaatacattactacaattattacttttacatcatttaaagaaaatgaacaaaggaaagcaaatatatatttgtagcttttgttatagtaaccttatttatcatttcaggttgtttgtttatttttcttgtggattcattaccatctggagtaattttgttttctttttctttcttttttttttttttggagggataacagggtcttgctctgttgcccaggctgctggagtgcagtgtcatgaatatatctcactgtagcgtcaaactcctggactcaaagtgatccttccacctcaacctcctgagtagctgggactacaggcacatgccaccaggcatggctaatatttgtattttctgcacctcagccttctgagtaactatattactctataagcacacatcaccacacccagctaatttttaaattttttatagagacagagtctcactgtgttgctcaggctggtctctaactcctggcctcaagtgatcctccagctctggcctcccaaaagtgctgggattacaggcatgagttctttgtatgagttccttgtatattttggatattaaccccttgttagataaaaggtttttcagtattttctcccattccgtggactgccttttcattttgttgtttcctttgctgtgcagaagcttttttgtttggtttagttccatttgcttatttttgcttttgttgcctgtgcttttggtgtcatttacaaaacaaacaaacaaaattattgccaagactaatgtcatggagcttttccactgttttcttctagttttacagtttcatgtcttacacttaagtcttttcacttttttttttttttgagacagagtctccctctgttgcccaggctggagtgcagtggtgtatgatcttgactcactgcaacctccacctcctgggttcaagtgattctcctgcctcagcctcccgagtaggtgggattataggcatgtgccactgtgcccggtttatttttgtatttttaatagaaatggggtttcaccaggctggtcttgaactcctgacctcaagtgatccacccgcctcagcctctcaagggactaggattacaggcaagagccactgcgcctggcctcttttaaccattttgaattgacttttgtggatggggtaagataagggtccaatttcatttcttggcatgtggttatctagctttttcaacaccatttattaaagagactatcctttctttattgtgtacttttgacacctttgttgatgattagttggccacataaacgaggatttatttctgggattcctattctgttccattggtctatatgtctccttttatgccagtaccatacagttttgattactgtaggtctgtaatataatttgaaatgaagtgtgatgccaccagctttgttcttcttgctcaggatcattttagatattctgggtcttttgggttctgtatggatgttaggaattttttttttttttctgtgaaaaatgtcattggagttttgctagagattgcgttgaatctgtagactactttgtgtattgcagacattttgacaataatgattcttctgatcctgaacatgggatagctttccatttatttgtgtcatctccagttctttcatatatgtattatagcttttagcatacacatctttcccctccttggtaaaacttattcctaagtattttattccttttgatgctattgtaaatgggattgctttcttaatttctttcttggatacttcactgttagtgaagtgtaattgatttttgtatgttgattttgtatcctgaaactttactggattcgtttattcattctaacagtttttagtggcgtatttagggttttctgtatataggatgatgtcacctgcagagacaattttacttcttcctttctgatttggatgccttttatttcttttccttgcctaatttctgtggctaggatttctagtactatgttgaatgtaagtgataagtgtgggcatccttgtctgtccttgtcacattcagttgtatgtgcaatactggaaccatccagctcatagtcacgtaattcctctttgtgcagcctcatgtaaaatcacacccctattcacatttttttctgtctgtctcccacctctccaggtccctgccctgcaactttcagttacttcagactctcagaagactagcctctaaatacctcaatttatctgcactactgtggtctacttgaaattctcttccctcttctgcagtttgtaatggcattcaggccaaaaactgtagtagttttagggctctcttcatttgcttctctgctcctagggatcatagtgctgtgctatctgttgtccagcatctgacacagttggttttatattttgtctggttttctagttattaagcaggttaagtctggttcctgctgttctatatagcaggaagcaaaggttctctcatgaatttttagcataataacataagcgtggattccaaaaattcattacacagatcctggaaatctgtttactatgttttatacattctgtgaaagctggagaatatatatttgttttactatgtgtatcgcaaataaaatatcaatttcatgtgccagagaattgaatacattatcaaagggtcatttcataacgttataatcaccatccatcctgtaagtcctttgaaatttcttcttttctatggatctaacattgatcaataacgaattcctaagcatctatattagttagcccagtgtttctcaaagtccaccgcatgtaaaaatcatctagggaatctttctaaaatgtggattctgatttagtaggtctggggtgaggtcttcccttttgcaattccagcaagttcccatgggatgctggtactggttaatggaagtcacttagagtagcaaggagcctgtttgcctagtatttacaatgagcacgttttgggtatcatcaaaacaagagaatctaaaaatgtatggtgtgggtggaaggttgtgttacttgatatttcaaaaagatcattgaaatcagaaaatctcagagatatgttggatttcatcacatttattctatggcttaatgttgttttattttgaatatataataagagagataccacaaatctttagctattaatatttagggatgttaatgtccttaattcatattgtctcaaatgtgattcattccctctataggtatactaaaacaggcattcatgcctacaaaaccatcttcctaactttctttcctctttttagtctcttcctgaaccagtgacagtggttctcaaacattttggtctgaggacccctttatggccttaaaaatgatcgaagagcttttatttatgaaggtaatacctgctaatacttgttgtaatctattaacattgagaaatgtaaaaatttttattaattcacttaaaatatcaataaacccattatttgctaatataaattgcactttttaatgaaaaataactttagtttctactgtgtgcttctgcattttgaaaatatgtctaggatacggtatgtatttaggagatattttctaaataaatgcatattcattttttaaaatgggacaaatgtagcatagacatatttttgctaacaatatccatatagttgcaaatttcacttttagaatttgctttcaaaaacaggttgtttattcttctttgttatgccttagttagtaaatcatatattataaaacttcttcaatgcaattggtctttggtcagccattgacataggaagagttagaaagagtccagggctccttggtactggctgtgactggataagtaggttgtggcttagtttgtgtttaggtgtcataactaggctaggtttgggtcccagaaagtgctagccttactgtaggagaggaagtggtattgctgggtgtgtcctcaggtcaggaagtgggacgagtgcagtatggaagcccaggggggtccttgtgactggaggaaaggtgaggtttccagtaaaggattcagaattcgggcatggtgcagcatgcctatagccccagctactcaggaggctgaagtgggaggatcacttgagaccaggagttcaaggttgcagtgagctgtcattgcgccactgcaccccagcctgggtgacagagtgagacctgtctcaaaaataaatacataaaaataataattaaaaaaaaaggattcagaattctagaatacatattatctttctatcatgcagatctgttcttaggattgtattttccaaatcatgaataaaataatttccaaaatacttattgggaaattatatatatgtactgtattacttggaataaaaatcaaataaaagtcaaacttcttaatgtggctgtaaagccttgattatttaaaccttgcctatttttcagtttaatctttcagccacactggcccttgtgttaatcctaaaacatgccatgctttttcctacattaaagcttagggtttttgatatttctactgcctggatttctctgttctcactcttcctcttgatcaccatgacttatttttcaagtgttggcttaaatgtccgtctcacagatagcccttatctaaataacagctttccctctggttcctagataaattaggacctgtttttttctataactttcttaaagtatcctattattttccctgataaaaccttgttggactgtttgtcagtatatttatttgcctgtttgtttggtgtcagtttctctttttttcctgtgtgttttgtttgtttgtttttttgagacgcagtttcactctgtcaccaggctggagtgcaatggtgcaatctcggctcaccacaacctccacctcccaggttcaagcaattcttctgcctcagcctcccgagtagctgggattacaggcatgtgccaccatcctggctaattttgtatttttagtagagacagggtttttccatgttggtcaggctggtcgcaaactcccgacctcaggtgatccgcctgtcttggcctcccaaggtgctgagattacaggcgtgaaccaccgcacccggcctgtttgtttgttttcttattagactataaactatatgagatcagaccatgtctcttttgtttatcactctggcctacctgctaacacagtgcttacacataatagtaggtgctcaagaaatacagtgtttgatggatgaacgtaaaattgtaagagcctgaactagtgtaatatcgaaaatagggaggaagacatgaattaggaaagcctttgaaaaattagcatgttctgtgataaagctacatctaggcaatattttttgatacttttaaaaaaaaaactgtaatagctacccaatatttaggaatgatacacatcacacatctcagtgaggtatgtagccttttgtactggtgaagagagccaggtgaagtctaactctaaggatctaaacactccattctagtagagagcctggagaagtgctcttgcataagctcatccatgtaagaccatccataacttagtgaaataattttcattgctgtttagttgcaaaaatcactcactgttttgcctccataagattatcggttttagtgtttaatcgttcacagccttgtcaaaaccaaaatggctagggagagaactatttccctacattaaaacttcgagcaatgctcttcatagattttgttttgaattgtttaggcccatctcagagttcaagacacttagtctcttctaagagaaatcatggtcacaacaaacagagattaaataaagagcaagaaattagaagaaactcaaaccattcacttagattatttgttagattttggccttaaaaagagacaaagttgcttgaaacaagtgattaaactgacatttttagattattattttattcatacctttattgtgaataaattggccacatgataacattttataatgttaaataaatatgatatatataaatctgtataccacaacaattaaattggagggcgatttgccatttaaataatttatcataggatttttataagatcaagcgcttagtgcatatcaaagagacagaaagttttcattgcagttctgcacgttcactgagtaccttttatgtaccagttgcattgttctagaatcttatctatcatgtaaagctaggtacacctgaaatagtttagttatggtggcaaagttagactgcagttattggctgggaattttttgtatatctatgtacatcttccataagagggcagcaaaggaccagcatgattttttccttatcatgaagtcatagcagagattgcctcatattgcaaacttaatagaaatcttctcagagtaagggcaaacagagggcatggttacaagtttacttactgtctagcctgtcttttatatggtctgatatggctttttagtacatagattatctcacatcacagtgatagcctagtgattaaatgttgatcctggggtcagttgtcaggctttaaatcctggaaccataacttaactagcttcgtggtctagaaagactactcagtctttctgagcctcagtttcttcctcaattttttataaaaaggagggcaagggatagtaacaatgccacttcacatggttttaataaacaaaataaaatttgtgtcctgaagaggctaagaacagttaaaaggtggagctagaaaaaccaccctatactagccttaggtgtattgtatttatttaagttaaactcttattaaaaagagtctcataaaggaaaatataggtcattactttctgtaactacttagtatttttagttaactaacatatatatctatgtactgaccaattatttgctcgtacaatttatcaaaccaattaaatatacactgttaaatttatttccctgtcccccgagacagatcctggctacgttgcccaggctggagtgcagtggcgcgattttggctcactgcaacctctgcctcccaggttcaggcaattctcctgcctcagcctcctgagtagctgggattacagaggcctgccaccatgcctggctaatttttgtatttttagtagagatgggatttcaccatgttggccagggtggtctcaaactcctgacctcaggtgatccagccgcctcggcctcccagagtgttgggattacaagcatgagccagcacgcctggcctgaaaatacattttgatgaacaaaaaatttttaatttttttttttttttttttcctgagacagagctttgctctgtcacccaggctggagtgcaatggcgtgatcttgcctcactgcaacctatgcctcctgggttcaagcaattctcctgcctcagcctcccgagtagctaggattacaggcatgggccaccatgcccggctaattttttgtatttttagtagagacgggatttcaccatgtttgccaggctggtctcaaactcctgaccttgtgatccgcccccgtggcctcccaaagtgctgagattgcgggcgtgagccaccactcccagccaaaaattttttaattttaaaagtcaatgtatatcatttgtattttatagttagtgctttttttgtattgtttaaatttttaaaattcttccattaatctaaaatattttcatgtgtgctttctactaagagaatttaagttttgtttttgacattatagtttttaatacatttggatttggatcttatatcttgtatgatacagaactctaattttcgcctttaactacatgcataatcattttttccacctccacttattgaatagttcctaattttcccatcaatatcatgtgtttcttctggcatagccaaagtcccataaatgtgtgggtctgttgtagtttcctatttaattcagttaatttgtccaatttgttttattatgccttaattaccacagcttcacagtaagtctttatgtctgatagggcagcttcctctagtgtcttcagaaatttcctgactttaaaaaaaatccttattgttcatgcttttttaaagaattagctttacatgatgcaagaaaaagatctgttggaattttgattgtaattttgttaaatctataggtcaactaattacaatattgaatcttcttatgcacaaacatggtatatttctccatttattcaggtctttatttaatgtctcctaatgtctttttgtagtttttacttagagatcttacatatttgttattatatttactcctaggtacttggtattctctaagattattgaaaatgctgtcttctttttaattacattttcaggtatttgtcattggtataaagaaatgtatttgacaataatcttatattcaccttaaattctcttatttctaataaattgtactttttttggttttctacaaaaatgatcatatctaaaaataaagttagatttgtttattcttctgcatcattttgaattcagtttattatttcatgtgctattagaacctttaatttagtattatttattttttgatttgtaaatcggaatgcttttattatcttttcatttaggatgatgtttactgtaggttacttagatacgctctatggaaatctcttttattttttctaagaccttttattatgaatttaatgttgaattttatcaaatgctttctctgcatttattagaataattatgatttttctctatctgttattataatgggtcagatttatagatttttctcatactaagcctatccttgtattccttggataaatctaacttggtaatgtttacttttttcataacttttagctattaagtagataccaaattttctttcaaggtcaagtttgatagttataaaaaactagtgatactaagtcatagaaaatatactttaaaaaactagtgatactaagtcatagaaaatatactttattttataaaaagactttaactgtaaaaagtaaaaaaaaaaaaaaaaaaaaaaaaaaaaaaaaaaaaaacctggccgggtgcgctggctcacccctgtaatcccagcactttgggaggccgaggcaggcagatcacgaggtcaggggatcgagaccatcctggctaacacggcgaaaccccgtctttactaaaaatacaaaaaatcagccgggcgtggtggtgggcgcccgtattcccagctactcgggaggctgaggcaggggaatggcgtgaaccctgggggggcggagcttgcagtgagccaagattgcgccactgcactccagcctgggagacagagcaagactctgcctcaaaaaaaaaaaaaaaaaaaacccctagaattttaattactgcctttacttttaattcagtggtttttagtatattcacagagttgtgtaacaatcaccatgatcaattttagcatatttttattacttcaaaaagcaactctggactcatgagcagtcattcactccccatctgctcccaacccctttgttcccatccgcccacccagccctaggcagccactaatctactttctgtctctacagatttgcctgttctggacctttcatataaatgcaatcaggcaaaagaaaggagatttcagtgctcagtgttgccaggtatctctgcctccagttttgcaccttcctggaaagctcattttgttcagattgtctgcctgcctctatctatcctgccttcagtggatggcagagatttcatctcttttgtttgcacagccttgaaaggtgcttgatacagagatgcttggtaaatacttgcagaataaattataaaagtaacacatactcataaaaattttaaagtaaaaatatgtatagtaataaacacttggtgcttattacatatcatccagtgggataaatgcttgtaagtatagtcagccttctgtttccctgggttccagatttgtggattcaaccaactgtggctctaaaatatctggggggaaaatggcatctgtactgaacatgtacatacttcttttcttgtcattccttaaacaatacagtataactatttacatagcatttatactgtattaggtattataagtaatctagagattatttaaaatatactggaggatgtgcataggttatatgcacatactatgccattttatatcagagatttgagcatccaaggatttgggtatctgcaaattttggtattcttgggaggtcctggaaccaatctcttacagataccaaaggatggctgtattctccattccttttcaccagctgagatcgtactgttatctgcacttaacagattaagaaataggtgtgatgagtaatttgtttaaattctgtggttgattgtgttacttttcgactgtattctgtgctcttccctacaggaggattattcattcctgtttacttgaattcaggcaacatcatgtaacttgatttaaggaaccgatacatgagtggaaattctgtgtggcatttctgagcagaagttttatgaggcagcacatgctcactgtgttacctgttccttctgccatgagactggcagatggacattctctatcagccaggatatcagaatgaagaaatgtagaacatagaccaaaacaccaatgagaaataagcgtttgttgttttagggaaagtgtgttaccacagcataatttaacctatcccaagtgaatacatattcatggagttaatatctatacctgaaaattgaaactcaggttgtctacatctaactatgcctctgtcttttccaaaggtataaagtaggagaaacttccccatgatcctactcttccagtgttaactacagttaaaatttagtgtaaaattgtttaatactttttcctatgtgtatgtcaatgttcatttttttaaaactgggaccactttatatgacacatactattttagagcttccttttcctacttagtaatataaaatggaccactgtcacaggttaggttttccataaacagacactgagtttggaatataagattattttcagggatcatcacctttaaaaggagaagtgaagaagtaggattggggagagcaagaagtagagctgtgatgctggcccacagatgtctctctggggttcgtattgtttgtcagagttatcccatatcttgtagaagtggccatgcttttcaacccactccttactcagtggcctgatgtgggctgccctgagcaaggtagctttctgcagctgaagcagacactgaagttgctggcagctaactccatctttgcagctgggcagcaaatcctttcttgaagtgggatctggacatttatatttgtctagcacagttcattttttgcatcacttggaaacccttctctgttttcattccttttgttcttaatgtatattctcaagcctcttgtctacaatcactagataagtttgttgtaaactgtcttaactataaaatgaagaaggtataggtaactataatatgaagaatgcattggaagtgtaaattttaaaggagtttgctgattaataactcttttgttgtaacttttgttcaatgatgtttgacaaatactttttttttttttaatttgaggcagagtctcactctgttgcccaaactggaatgcagtggcatgatctcagctcactgcaacctccgcctgttgggctcagagatcttcccgccccagcctcccgaggagctggaactacagccttgtgccaccacacccagcaaatttttgtattttattgcagagatggcatttcaccatgttgcccaggctggtcttgaactactggacttaagcaatccgcccacctgggcctcccaaagtgctgagattacaggcatgagccaccgcgcctggctgacaaatactttttaaaaatatccaagtttctggattttattcacctctacaaaaatgatttaagtcctgtagaaacatgtgcccacaaatgacacagtaatctccagcaatgtgttcaacagcacgttgagcataattgagcataacagacatttttaaatttgttgtctcaaattccatttagatttggctattgatgcaaaattagggaggtcatttttcactagattactttcaatgctggaatccatacttaaaaaaaaaaaaagaagaaactagatttagtatatctttctttgccacttcaggcttccaaaggagaaaaattcatggataagtcattaactgttacaaatgcattatgtcttcagttgtgatggttatgataaaacatgtttattttatatttgtaatttagtaaaattagttgattcaaggagctctatcataaatgggaagtaataaaatgataataattaaagcaggttatttttctctggtcatttttgcattctttgtagctcatgaagtagatttgttgctttcatctgtgtctgccatgtatgctaggcaggaaagaaaggaagtaagaaagatatagccatgtggggaaaggagacagagggaaggaggaggaaagagaaggaaggaaataaaatcaactcttcgttttctgcactttccctgagcaagttcttttttatttgtgtgtacaatgaatctgcgtttctccctgccacgccccctcccaacccctttggctaatagaaagctctgaaaaaaattttgaaacttatatccaaatgcagtggatataaataaagttatttcccctggcttttcaaaaatatgagtgagtgttggatattagaaagctaccttacttctttagatcgagaccatcctggctaatacggtgaaaccccatctctactaaaaatacaaaaaattagccgggcgcggtgttgggcgcctgtagttccagctactcgggaggctgaggcaggagaatggcatgaatccgggaggcggagcttgcagtgagcagagatcgtgccactgcactccaacctgggcaaaagagcgagactccgtctcaaaaaaaaaaaaagacagctaccttacttattggaaagagatgatctgtgtggtcagtatcagtttcttcacaggaaaaaaaaagtagattagtaatagtgtttactaggcacagtgctttacatttctttacttagttctcaaaacaatcccattacataggtattatcccatttaacagttgagaaatctcagtcacagagagttaagtgactccccaaagttcacatggctagtaaattatggagctctggatttcatgccctgaaccaatgtgctattacaagccacatactaaggttaatacacaaaatacatgtcataagataggctccaaattgttttagagcttcccagcagtcaaacagaaaaaaggaagcatggttattttcaagacttaggatacatatgataaaagcaaagcagttactcagcggaagtgcaccttcctcagaagttgggcctggaaaaaaacttcagatatttataaaattgatgccatacaatgttgtgaacactatgtttcaaaactgccccctaaaatagtatgaagctttttttttcacatgacaaatatatgagaaaccattattattattattattactgttttgagacagtgtcttgctctgtcagccaggctggagtgcagtggctcactgtatcctgaaactgctgggctcaagggatcctcctgcctcagcctcccaactagccaagactacaggcacacacaaccatgcctggctaattttttttttattattttttgtagagacaaggtcttgctatgttgcccaggctggtctcaaactcctggccttaggcaatcaatcttcctacctcggtcccccaaagtgttgagattacagacatgagccatcacgccctgctgaaaccattatcttatgatttctgatatgtgactctttcattgtatggcatgatccaaggatagattatacatcgattcagtgaacgcatggactctattcttctgagcaatcctccatgagtatgtgttttgaggctaatcttttgataaggatagactagcaaagaatttgattgattccgtcaggactctagagtagaaatatcatgtattgtcagttaaaggcagatctttgaattttaacaaagccagcagaaggcaggattcatacacttccaggtatgtctgaacagaagcctgcctgaccacaacacagatgtgatcgtctaagagtctttcttggtgtaaaatcccatgattctacagggtttattcagatcctagtgtcttaatgagttgatgtaagagtacagtgctatattctatgagggtgttattatttgtaatgaaaatagggagaataattacacattcttgctttctttggatcagagcttctttactggtaaatactccccttttcatatttttgtaccagtcatcataatttcaaaaatagtataatactgtattctaagcataacattttaacttgtgtttatatgtgagaagtttagaaaatataataagaaaaaataaaaatctcccacaatcctactggaggctatgaatcttctcactcccatcttttcctgcacacatgccaacgaactaaaaaggatcagaatatgcacactgttatgtaatctacctcattcatgtaataatgtatcatggatgactcgatgccattacatattaatagacatagtgcctgcagagtattatgtggacacactcagggctgatgctctgctagtatcttcaaggctgctggaatagccatgctggttgctaaaatatggaaagacttccatactggttagtaaatggtgctgccctgagccctctgaatgccttcccactggacctcccccccatcacactccccagcaactaaagggttaacgcctgtcccatctggggcctctaggatcctgctatagtagtgtggccagcctgctttctgattgatcagtgcccataccaatggttaaaattttggatatcattcttaaatgtatcataccacattgttggtaatatttcgtgtgcttattagaaagtatttttctgttaaatatatatatgtgtgtatatttttaagtcttccgacagacttctttgacatgttatgtcttcaggaagccataggctctcatgggaaattggtgtctggaattatcactgcattaatgtaataatatatatttactagaacagtggtttgacatatgaaaatcttaatttatacaccaagcatacttgaatgtagacttttccttctctatagaccagaaaccatggcatttatttggaattgcttgatgtcactttaaattgagacattcaatccattcctcttttgaatatgaaaaactttttcctttaagacaatagtattttagacttcaccatcctcccatactgttcttttatatttcttcatgttctttcttcactaatccatttctaacacacccatataatttttcagatttttttcatatttccatttttaatattccacattatatgggtaattttttataatctggctttctgcatttgacctcatactagttaccagcttttattttttttaaataaacagctttgttgtaaggttcattaaaacaaaacaaaatttctttttttaattgagttagggtctctctctgtcccccaagctggagtgcagtggtgcgatcttggctaactgcaacttccgccttacgagttcaagcagttctttgcctcagcctcccaggtagctgaaattacaggcacacgctaccaagcctggctgatttttgtatttttagtagagatggggtttcgccatgttggccaggctggtcttgaactcctgagcacaagtgatccacccacttgggtcccccaaagtgctgggattacagtcgcgcaacaccacacctggctaatttttgtatttttagtagagatgggttttcgccatgttggccaggctagtcttgaactcctgagctcaagtgattcacctgccttggcctcccaaattgctgggatcacaggcgtgagccaccacacccagcgaaaagagcaagtaattcttgcaaattttttacccaaacctttagaatgtgttcttttttttttcttttttttttttttttggttttgggtttttttttttttttttttttgagcatttatgaaatggctgtgaacttcttctaacttctaactttccaagttgtctccttttggccctaggagtagaatttttctttaattctcagctggtgagatctgttgccaccacagttcaaaataacgattaagtactgaggccagcccatgcctgatccttcagtgatgttaggaaggtgaatgcttggctgtttgaaagcctccttattgtcatttccaatccattctctctgcttctattccttttctcccaaaacatttcagtgttgtcagttcatactctggagtctttggaaaaagagattgttgtctttttatgaatttgtccaaattttagttgtttctggttaagtttagaccaagagggatccatgtccctacaggattacccctatttcaaccagtagatgaggaatatccagctttaatttgtcagagcaaaaatccattaatgttttctcattactcataaaaaaaaatccagctccttactgtggcctataaacctctccatgattggccctccttaatttatctcttttagtcttgaagtttcaggcacacctccttttcttttattgaaattctcaaagccaggtacagtggctcacctgagtttattcaaggctaatccgtaattagggaaataaaggttacagctgcctgttagtgactcaggtcgtataatcacattcctttaaggctcaaaataacgttccaatagctttgattttgaattacttattttcacaagttctataaaattacagagttctcatctatttttgttggcagctgtttgcctagcagttgaaagtgcttagcacatgatagtatatgataaacatttgtttaatttatttcaatattgtcagtccatattccagcttctttggcaaaggagactgttgtttttatatgaatttatccaaattttagttgtttccagctaagtttagaccaagagcccccacagaattacttccatgtcaactagtagaggaagagctttaatttaggatttaaatgccacaccacaattatctaaagtgactgaattgagctactgaataatagtccttctaaagaagattttagacacacatttcatttctgttattgctgacaagtgttttattttacagaataaaaggcatcttgcctgggataaaatttcgaaaggctgtgtttttgtagcactttcttttttggaaggatctctttttagctactctgtgtcatggtgatgttgagttctctgttggaagctagagttcctgggttttttgatgtttctaggcttttgggttttgtttaagatttgtgttttgggaaggaacatttccatggttacgcccattccttctaccatccttgaaaaaacgagccagtagagtaatctgattcctggattactactacacagatgtcttttgtatctgcctacacatgaaactgctaggcaagttccatttccatgcatttacttccttcagtgctttttaaaaatgaagcacttttaagattaggaatgaaagacttggattggcaagttaaacagggattggcctacgttatgttaatagtctaaactcaatgtaggattaatttagaggtacagtatatgaagggagagactgttttgggaacaactaaatcgaagctttgagcagaatttgcacacatgtgagtaatactatatgcagaaagactgctgtacttaaaaatagttttcaggtttttaaatataaagtttcatgttggaatagtaaaataaaacatatgaacttttactgacatgaagcagtaaaattaacttttccttggaacagcttgcatgctcattgctgctccacacaaacctaggttaaagatgcccatgatctagcagttttcttctctgaacattgcagagcatttgcacagacatgcttgaatttacactcatgagtccatttcaagtaagaagagggagtaagagagggacctccttctcagggttaaggaaggcctaaattatgaaaaagtagtgcagcttttttcttaagttaaagtaacggtaaatttacaccacatttctctatgaatccagtatatgaaaagtttaatttgcgtgttaactattgctgtgcagacagcttgtcaagtgatgattttgacagcctggtgtctgtctccattctgctggaacatcagacgccatttctcttcttcctgagaaaaccacctctcatactttggtatccctctaaagtgtttcaattgtaaattactactaatatataattactattcatttatagaagcttctagcttaaacataaaaatatactaaaagtgaaacaaccgtaatcttaacctctagacatagattatttttctatgaacacattaacatatatgtcatagttactattgttttttacaataaaaggctcatactatacatacatacaacttgttctggtatatattttgaatcttcataatagcatttgtagatatgctttattttttgtagttttgtttttttctttagccatccttgcaaatactatgtattttgcttccttaaatcagtatttcagtaggaaaaattcttagaaattaaactgtgagggcaagcaattgtgaacatttacattttaataagtaccaacaaattaccttaaaacgtgtaccgatggatactcttagtaaaatgtaagagagtgattcactacattcttactagctcaggcattatcaatttttttttattttaaattactgcctaagaaatacagtcatatatcttgttcttttattttaaatttctatttgagaagttatgcacttttgtttgtttgttttttgagacagagtcttactctgtcatccaggctggagtgcagtggcacaatctcagctcactgcaacctctacctctcaggttcaggtgattctcgtgcctcagcctcccgagtagctgggattacaggcgcctgccaccacgcctggctgagttttgtattttcagtagagatggggtttcaccgtgttggaccagctggtttggaattcctgacctcaggtgatccccccactcagcctcccaaagtgctgggattgcaggcgtgagccaccatgcctagccagttacacactttttaatgtgattattaatcaccattatttctacttattcaagctgactgttcacatattttactctttttaaagcatgcattttaaataaattgataataaatgtttttgtcaaatattgcacgtcttctcccctacatttattgaatgcttactgcatgctaggctctgtgctaaatactttacatacattattccatttaatcctcacattaattttggggaatgtgttattttcatgttcacacaaggaaaatgggttcagagaggttaaggaatttgcccaaatttacagttagtttatttttatttttattttgagacagggtatgtctctatcacccaggctggagtgcagtggcacgatcccagctcagtgcaaactccgcctcctaggttcaagcaattctagtgcctcagcctcctgagtggatgggactgtaggtgcctgccaccatacccagctaattttttgtagaggcagggtttcaccatgttgcccaggcctggtcttgaattcctgagctcaagtgatctgcccgcctcagcctcccaaagtgctgggattacagccacgagccactgtgcccgctccacagttttagaagtggcattcaaacagagctcaatcacaataaaaggcacatcacaaactatgataatcccccacctcttggattgtcttttatctcttaactttgtggagggtttttgctttgattttgtttgttatgttataatgaagttttaaattgttaatcattccatatggtgtctaggttttccgccatgattataaagcccttccctagccccatgtgatacaattttctttcttataatacttttatatttcatttctttttaagtctttggtatatctgacagcaatttatgtatgattcagatgtatatttttttccccaaaggtcccaacacctttactgaataatctttttcccataatttgagatgacacctttatcatacacttatatgccctgtatatttgagtctatatctggactcccttctggtataaagaagtgcagttgacttttgtataacgaccttatacctgtccaccttgttaaaccctcttactatttctaatatcatgtctacagattctgattttctgttaaaatggttaataattctgtctctctctctttttttttttttttgacatggaattttgctcttattgcccaggctggagtgcagtggtacagtcttggctcactgcaacctctgcctcctgggctcaagtggttctcctgcctcagcctcccaagtagctgggattacaggcgcctgccactacacctggctaatttttgtatttttagtagagatgaggtttcaccatgttggccagtctggtcttgaactcctgacctcaggtgacccgcctgtctcagcctcccaaagtgctaggatcacaggcgtgagccaccgcgcctggcccttaacatggttaataattctctgataaagattgttctagtctttttcaatcctttctcatccttttgattcaacttatttttcttatgtgctattgaagtccttcaagtctatgttgtttttttttatttctaaaaataaaaccaagaataccagaaaaccctaaggctgaagtaactgaaaaccaaactcaaaaattgatctgtagggttattcagttactctgttggttagtcaccaggtcgtgtaagtgcaagtcctaatcaggaaaaaccaagactttgtgaattaggatggggacactccagaggattcggagacctccttgactccatggagtactctgaactcaatgccttgagcctcctctgcttgtcaaagcctttccttcctcttaatcctcccgagggtgttttcctcctgacaccaaatgtgtgatgtccgttctaacaccagccatttctccagttctctagacatcaaccggatgtccaataattcaattaaattctgatactgtctgcctgcgttagcatccacccctacaagttaaaggctcagtcccacaatacttccctacttcagatgtcagctgtaaatggggtgcccaggtgatccacatttctgcccaggtgactacaaatttgggggttcccatggccccttcccctcagtttctataatttgctagaatgcctcacagaactcagcaaagccctgaagcactgattattctcattttattataaaagataacagctcaggcctggcacggtggctcacacctatagtctcagtaacttgggaggttgaggtgggagtattagagcaggtagttagacgtgagcagggcagaagagggtccttccaccaccaggaatgttaggcaaccatcaggtgatggtcaggtggttgttaactgtctctttaaaataataattggttgcagccagtgctagggaaaggcagtctcccaacagatagaaaacacctgaaactggtgactagcagcttcccaatatgatctcaggagttgggtgagtgggctcaagcatgtgcactcaaaggcaaaatggcagagtttaacgggtatatgaccttcctctaggaacattcaacttgtaggaaagaacgcctcaatgtgcatttgttcaacttcagtaaacacactgtgcattggccccctcctaagtgctggcaggccaccgcacatgcagaataccagcatatgaaaccccaagtcagaggtcaaactgggcacttgaactcctcaagactcctgcttggctatcttccaagtgtaccttacattctttgattcctgctttaaaactttttaataaactttcacgcctgctctaaaacttacctccatctctctctctgccttatgcccttcagtcgaacgaattctttctcctaaggaggcaagaattgaggttgctgcagactcgtggatttgccactgctaacaggaggattacttgagcccaggagtttgcgtctccagtgagctatgatgttatcactgcactccagcctgggcaacagagtaggaccctgtctcaaaaaaaaaaaaaaaaaaaaaaaaaaaaagatactgctgaggaactgccaaatggaaaaaatgcagaagagaagatatagggagaggggcagagagcttttacgccctctgtgggtgcaccagccctcagtacctccaagttttcaacccggaagctctccaaaccctgttctttaggagtttttatggaggatttgttgtgtggacttggatcgattaagttattggccattggtgattaactcaactttccgtcccaagagattgggagtggggctagaagttccagcctctaaagatgcctaggtcttttatcaatccaccctcatcctgaggccatccaggcaaccccaggcaccagtcagctcattatcatacagaagataatcttatcacacgggagattccaagggttttagaagccatgtacctggaactggcacaaagaccaaatatgttttcttgtgctttacctctcttttaaaaacatgtaactccttgttatgggttgaattgtgtcccctgcttcacgaatttcatatgttggagtcttgacccccagcacctcagaattgttgatgaaaagagtcaaactctgtaaaatatttgaagagatttattctgagccaaatatgagtgaccaatgcccatgacacagccctcacgagatcctgagaacatgtgcccagggtggttggggaatagcctagttttatacattttagggagacatgagacatcaatcaaatacatgtaagatatacattgatttggtctggaaaggtgtcacaactcaaagatggagggtgaggggcagttccaggtcataggtagattttaaaattttctgataggcaattggttaaaagagttatcaatagaatgtctgggtttcgataggggttgtggagaccaacttttaaattatgcaaatgaagcctccagatagcatgcctcagagagaatagactaaatgtttcttattagacataagttctgtgttgatgttaaatgctggttggctctttctgaattccataagtggggatggtataacgagccatgtctgacccccccatttccatcatggcctgaaccagtttttccggttaactttggaatgctctggcagagaggaggagtccattcagatggctgacggatcttaagattttatttttggtttacagaatatagccttatttagggataaggtctgtaaagagggaatcaagttaaaatgagttcattatgtaactgagtactctcatttttcagtttattttttaattattttctcctctcccctttcccccggcttatgcccccaaagcatgcctgcctcagaaccttcaccctctaggaggggttgccttggaactcccacccaccaggagggcatgtcaaaagcacgcccacttggccacttttataacttctgcccaggaaggcaccaactcagctacccagtagttaaggcactgggccagcagggggacccctcgcccttgctcactccttccccggccttggataagtgcctactttctgctctgggagcaaaacgtcacatgtaaaggcaggactaacgttcacgactcttccccaagctagcttcggaagaaaccgctttctttatgccagacctcgctcttgttaattggactacgcaggcagcaagcaactaaccctctgtttggtgacggttatggatgggcgccctaatccggtatgactgctgtgcttatagaaaggagaaactgtccaggcgcggtggctcacgtctgcaatcccagcactttgggaggcacaggcaggcggatcatgaggtcaggagataagaccatcctggccaacatggtgaaaccctgtctctactaaaaatacaaaaattagctgggcgtggtggcgcgtgcctgtagtcccagctactcgggatgctgaggcaggagaatcgcttgaaccagggagtcagagcttgcagtgagccaaaatcgcgccactgcactccagcccggtgacagagcgagactccgtctgaaaaaaaaaaaaaaaaaggagaaacttgtacatggagatatgcgtaaatgtacagggacacaggaagaaaatggctttctacaagccaaggacagaggcctgaaacggatccttgcctcacagcccccagaaagagcccaccctgccccaacaccttgatctttgattcccagccttcagaactgtgaaacaatacatttctgttgtttaagccacttggttacggcagctataagaaattgatacactttttttttttttttttttttttgagatggagtctcactctgtcagccgggctctggagtgcagtggcacgatctcgtctcactgcaacctctgcctccctggttcaagcaattctcctgcctcagcctcccgagtagctgggattacaggcgcctgccactaccgccagctaattttttgtatttttagtagagatggggtttcaccatgttggccaggctggtcttgaactcctgatcttatgattcgccctccttggcctcccaaagtgctgggattgcaggagtgagccactgcgcctggccctaatacacttttttatatgaggaagttacattgtaagagcaagtaaatattcctctatacatccccaaccacttccactgtatatagaccagtagctagagttaaatccctgtatgccccaagggaaattacagatttaacacaagagaaggcttacacatcaaaagacttgtaagactttgataatttatgtcttctcttccctgagataattcttccaaagcttagcattcactggcttttgtttatcatgctcatgtccactgccattttttgatgtacttaattcataggtcccttgttggctctttagtcctcattattcatttgaaagcttctggactaccataaggctatctatgagatgttggtatagcgccctgaacatctctcttatcttacttagtacacttgtatgactttaacttgtattttccccactaggccctgttttgtgtgaggattcccagtgtctagcacaatgcctggtacataccatgtgtttaatacctagttcttaaaggaagaaggaagagaggaagaggaaggaaattctatccaataaatgctatctaggaacaatgtggatttatctttctctttagttacttaggagctacattagtatccttagaacttgtgctggagagattagtgttggcagtttattatttcgttacccttcgaaactgcatgggtaataacagactgtggatagtctcacatgctgtctccaaatactttctccctaaaactagagcatatcctcttaaacactggccttgttcgccaccaccatggcccagaagcaggcccaataatcctggggagtgttcctgactggaactctgggtcagaaaggataaagatgacttaatctcgcaatcccactttctactcggttctgatactcttgatgtacacatgttcctctgctaggtgcttttcatttttttgagggccttcagtcttctgttcaagtgtgcatggtgcttctaagccttctcacttagttttgaaattagcattctactcagaatagataaatgctgccaacttgcagttcttttgcttggcccagattcccttatagtttgcaggtaattttcagggtcttcagtatgagattattttcatttcctagtttcaacacagatggttttctctttacttttggttcatttccgtgcattttggggaaaggagatagataaatgtgcacttttcagctacctttctggacaatattagcatttcccctttacttctgaatatcctttggactctcctatattggaaaaagagggtgatttatgactattttaatggaaaacaaaaataaatctatagacaagttgttagatatattaagagtttaacaaggtgaatattataacagctataccttcacccagctacccttgctgggctctaactcgctgtctctttctcttgttattgttgttgttttcccccatgggtgagttctttatggcagtctccaccatttcctcataatcattttccttttgatttctatattctgacatccagttcccatcatactgcggcagctgatctctcaaaataaattcattgatttttttttttataattgcagttacattttttctcctttactttccttgcacacaggactgtatttgatgctgttaattaacccttctttaaaactttgttttttgtttacttctgtttctttactgactgtgtacagtaatcagaaaaatcagaaaaagacctgattttctctaaatcaggcctttttccctcaaggatctttgtggccatttcccctggttttccttgaggagaaaactatctctctacatctccctcttaacccaacttccactccgctattttaatagtctactggatgctacggtgaacaatttaaaagacagaaggactgggtgacaaacgtgagggaatttggactgatgtctgcatgtctggcttgagtaacagtagggacagcagtgctgtttcacatatacaaggaacatgagggagaaaagggctcaagaggatcattttgattacaacaaacaggaacaatggaaaccacctgacaccagtcccaaaccaccagtgacattagtccaaccactttaagagagtctgaactaggtagaaaggcaaactgatagaggctctcgggaaaggagtaactactgagaagtcagcaagagaaaaagtaacttgacaacactgttttcaaaccattgcagctacctgaaaagatcccctttcctgctctgggaggctgttccatcttcagcatcagcactttatcacagaaggcctaagcaggggagaatgttgccacagaagccaaagagggaaagtcttagtgaagagtcaagaaagaaaagtcttggagaaatacttttcggtatggcagtgaggagtgtggtggccttcttgagagcactctcactgccttggtgataggggtcattttgcagcatgttggctgcagagaaggcaacctaaagaaggcattcatgaaatgcagcctgcttcttgaacgaatctggatgaaaggcaggagaatgcatggcagctggaggaaagccaggatgcaggagggcattccttagggcagtaaagtggacgtacatgcggggttagagagcaacccagaagcaggaagcatgagccagagtccagggtgctttggaaagatttagatagggggtagggcccatccttctctgtcataggaagcaggatgtaaatggagtttctctggttggctggaggttgaggaagtttgcttcctatggcttctattctcatctactgaaatgtgagaagaggcagtgggaatggaaaagctaccatgggagtgagaggagaaactcaagataaatgaaggaatttctgcaagcagtgtggaaagctgaactgaggctggagccatgcatttggggtgacatcagatcttcagcggagtgctttttttttttccagcttcacttaataatgtgaataaagatgattttggtataggaatttgcaggatggctaatagtggaaaacaaaggaaaatggggtaataatagagcctgccatttcagagagtgatcaaagtgactcacagtgagatctagactagagagggcagaaatgaaaggaccaaagaggagaagatgatctcagtggagataaaaggtagatggacgaggaaaactagagagctagaaggttgtgattggagatcaggatgatgacatttaagagccagaggtgaagtttaaaaatagggattgtgagctgtccatgttggcacatgcctatagtcccagctactatggaggctgggcggggaggatcacttgagcccaggtgtttgagggtacagtgagccatgctcatgccactgccctccagcttgggcgatagagcaagaccccaactctaaaaaaaaaaaaaaagaaggaaaaatagggattgtgcaatagaatcaaacacagaggtcactggataataacaaacagtagtttatgagtagtttttgtgtagctttgtttttttgatttttgtttttttgttttttgtttgtttgttttttgagacagagtctcactctgtcaccaggctggagtgcagtggcacaatcttggctcactgcaacctctgcctcccgggttcaagtgattctcctgcctcagcctcccgagtagctgggactacaggcatgtgccaccacgcccagctaatttttatatttttagtagagatggggtttcaccatgttggccaggatggtctcgatctcttgacctcgtgatccgcccaccttggcctcccgaagtgctaggattacaggtgtgagccactgcgcccagcctttgtgtagctttttgagcagcaacacaatagtggatagagctgtaaagaacacaaggagaggaagggaaaattcaaacagctgcggcttgttggtcttttaatgcctggttcttgattttgaatccactgctgtctttacaggagggcactaatttccagcgaagaagtgtaagttgctttgatcgtatctcattcttacaaaatgtagactcaccaatggctgttgtttttttcagtgggcctaatgcatatagcttccagatgtaaaggtaaagtactccagtggatgattcattttaaattagaaattagcttaaaggctaataaaagttgaaaataaaatttatctcaaacctagttaggtgttttttctttttggcaagagaaaatggatatgaggaaagtattcttcctgtagtgggagatcaggggcaatatggtgataccatagccatggcacagataaagtgggatctaataatttagttaattttatctgtttatttgactgtaggtacttgagcatatagttgttttgttgttgttgttgtcatttttttaagaaaaagcatcggtgttcttttgttttgttttgttttgtttttttgagagagagaggtctcgctgtgttgcccaggttggtcttgtactcctggcttcaagtggttctcccaccttggtctcccaaagtgttggagttacaggtgtgagccactgcacccagtcaagttttccttcttaagtgataagagtgatacttagaaagatactcacttggaagaagagaaattaaaaattttagcactttttggccacctaaaataattgcatggaagagtgaccaagaaaaacgctgaaaaaaacttttctttgggaaaatatatattccttatattccttaaagcaaaaatgaatagagaaaaattggcacccctgttgtgttagaaactatttgaaaaatgatgaattgtaaatattgtcaatttcaatactctggttttgatttaaagtttgaaatcgagattttgtgatggaatgatttcttctgtttgtatggtagttaaagcttgcttattaccaccatactagaaacttggccgtaaacaggaatctatgtgcctgggcagaaactaccccataaacacgttgttattttaaaatcttaaaggagagaggatatcaaagtatattctttatcattttctcttagaaaatctgacattgtgtttttggactagtaagtagaatagatatttagcaggaaatttatatgtaggcctttgggcttcaaaaatacttatccctgtgatcctttgggcgtatctatgatgtcatgatgttgacggtgtcagcatagtttattttgtcacatttgtgctttcatgaacataaaacctttaattcgttttctttaaaaggtacagcagcaccatcttagttaagcagaacaagtttcacttcatgtgactcaatcaatgaaggaaaatacaacttttgataaagacaccagtgagcattttattgattaatgggatgcgttatttagctttatgcttgcagacaggctcaagattagatcttagtacattgggaaaaacttcagttatacaacatgtcctaacttttgttgtgttgacattcaagctagagtttaatactcctctgatgaaggtattaaataatgtaggtttctaagctgtatgcaactaaagcatatttgcttcatgaccaacatctatatgctgtgatgttatccagtgagtgaaacacaggtcaactctacacgaagcctttttttgtattcctattttgtcttctccatctctcctttcttattatagcatatttttttcactctaaggaaagaacatttatgcagggcttgcttaccccaacaaagcatagcacaggcagggctgacacaaaatcaacgggagaagtttgaaaaaagagaactgctgggattaaatgttcagtgatttacttgttgtattagtccattttcatgctgctgatgaagacatacccaagactgggcaatttacaaaacaaagaggtttattgaacttacaattccacatggctgaggaggcctcacaatcatagtggaagacaaagaggagcaagtcacatcgtatgtggatggcaggaggcaaaaagagagcttctgcagagaaacccccatttttaaaaccatcagatctcatgagactcattcactattaggagaacagcacaggaaagacccacccccataattaaatcacctcccaccgggttcctcccacagacatgtgggaatcatgggagttacaattcaagatgagatttgggtggggacacagccaaaccatatcacttgttgaatgcacttggattgtacggagtggggctgagctgctgatgtgtgtgcttcatccactttggggcaattttcttattgtataaactgaatcatgcgcctgtcctcatttggcttcacgttagaaccaaaagatgagagatatgtgccctttaaatgggcttttagtcacattttataacataataaatctaattttcaatgaatataccaacgtatatatctagaataagccatttgctcaggaaaacatatgtcaacatacttatatgcagtaaacgccaactgaagcttaactttttctaacaattctgaagtctcagaacatttactacctctttttaggaattgcttccagagccataagcacatttttataaatattgccaacagtgatataatatcttcatccattaacattaaattgaattttttgcaaatgatcaaaaggtcattccgagtaaattctgttgtatagtgcagatgatcaagctgagtatttgccatgtttttattttagaaaagagatgttgctataacataagtaaatagattctcgtatgtggcagataaatttacttgtaatctgctctagagtgaaattattttttacatataagcattgtcatcattctaaggattattgaataatgaatataaaatgttcttgtgtatttgtgtatgtgtatataattttttgaaagtttctttatcctattgacccttctcataaacagtagcatatatatattatatgtagtagaatttatataggaacattgtctttttcccagtaatgctgattctaaactagattatgtaaatttcatgtaacatgacattaagaatagtggggtgctaaagatatttagaaatgatttccaaaattgttgtatttctaacatagaaggatattgtcattttaaaataatgtaaagaaaaaatgccccaaactatctctttaataaagtttttttttaaaataaaaaaccatttgttcaacactttataatgtatatgttatttctcatacctggtgttttttttcataacaactagagaaaattgctattatcattattcccatttgaagaggagcctatgaagtttcattagaggtaaatcatcttgctcaagatcacagagcagtaagtgttggaactggaataaacctagattgtctgactccaaatctgtgcgtgtgtgtttaatgttttaacttttattttaaaagttcagggtacatgtgca

SEQ ID NO: 33 - DNA, 7113 bp, Homo sapiens
gcgctgacccctaggcgccgctggtggccccgcgcgcggccctccggccagccccgcccctctcggggctcctccttggtccccgcgccatggcgcgtccgcgttgaccgctgtcttccctttcgggctgtgctgatcgcgaacgctgcgcagtccgtggtggcgtcgaggcacctttctcgtgcctttacctgtgttcactcctttgctttaaaaaacagccctagaagtacacatcgttggccccgaaggagccccagcagccatgtcggaccgcgaggtgaccttggagggcgggaggacggacgaggggcctggcggagctagactgagagggcgccgccggcgtcctgaaggccctgctccccgaatgtgtgggagtgtgtctgacggtgcgagggtggctgtggcggggcctgagcagcgtgtccgtgtcccgatgccgcccgcctgttactgagttaggcaggagtgcccgagtctggcgaacttcagcagttctcgttccagagctccacacgaggttggccaaagctttgcgggacttacatacccttcttcctccgcccagtcctgcttccttccccttcctttcacgggtgttgataccatgtcaacatcctcgtaccccaaactcagtcgcagcgtctgcttctggagaaaccattctgcagcattaaagctggtgagaagatgggattcgaggctgcatcactcaccagtggtgaagtaggagggtgaactagtgaaatggaatccacgagtgggtgaagtatcagacatttcatatatggtgaacgtagtagataaaaggaaggaaagggggattggatagctattgcttagtgccaaccgagactcttaagaatagtggtcagctgaaggcaagcaacaaacagttgtaagccagtgaatctgtcccgttacatatagagaagcttcatttactgcagcaggtcaaagacaagaaccaggcccaggaattaacatccctgtttgactgaactccaaaaatagcaaaacacccaaacaaggcaatactcttccactaagtttggatccctgctaagaaaagatgaggctgggcacagtggctcacacctgtaatcccagcactttgggaggccaaggcgggaagattgcttgagttcaggagttcaagaccagcttgggcaacatgacaaaaccccatctctactgaaaacacaaaaaattagccgggcatggtggccacggctgtggtcccagctgcttgggaggctaaggtgggtggatcacctgagccctggaagtcagggctgtagtgagctgtgactgcactccagcctgggcaacaggagtgagactctgtcttttaaaaaaaaaaaagaaagaaaagaaaagcccgtcatacatgggttggagatacctgggtagatgccttcaaaggttttgactccccaaactgccttaaacctttttttcgtagacagtgtctcactctgttgcccaggctggagtgcagttgctggatcatggcccactgtagcctcaacttcctgggctcaaacgatcctcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctccctccccctcagaagaactgcgttattagtttgctggggcttcagtaacaaactgggcagacatttattgtctcccagttctggaggctagaagtctgagatcaaagttttcacagggttggttccttctggggctgggagggagaatctgtctcatgcctctctcccagcttctggtggtttgctggcagtctttggttccttggcttatagaggcattgtcccagtcctgcctttatattcacatggtgatcttgttgtgtgtgtctctccagacgaaggcataagtaacatcattgacaaaggtcattcgacatgggcctctttttagaaggacaccagtcatactgattagggcccactctaatgagcgcatcttaacttgtctacaaagacccatttccaaataatgtcacattcacattgaccaggggttagggcttcagcatcttttgagagggacacacttcagcccataacaagctgtaccacccagccaacatgtactgacaggagctgggaaagtttggggctggattatgagggtgcttgatgaagggagctggaatgtaaacttgcatagatgtgtttattgaaatacgtgatttaacaccttggcaaagagtggctgcagacttcctgcaaggatggctcctagaatggcggtatagctactgctgcctaacaaattactccacacttcgtggcttaaaacaagaatcatttcttatctctaggttactgtgggtcagacatagtggggatcggtgatctctctaggttactgtgggtcagacatagtggggattggttatctctcttccacagtgtctgaggcctcagctggagcagttcagaggctagaggttggaatgagtgaaggttcatctgctcgaatgtctgacagctgatactggagattggctgcagcccagattggggatgtcagccagcacacccctacacggccggtccctgtggccgaggctttctcacaatatgatggctggattccaagggcaatctaaagacaaaggacaaaagaaagctgtatcctttttgtgaaccagcctcagaagttgcataccatcacttcggctacttcctatttggaagaaatgagtcactaaattacccatattcaaaaggagaggaattaggcttcatcttctaaagggaagaatatcaaaaaatttgccagtatatttttaaaacaccacacttggaaaaagccatgggccatggtaagcaaaattgaaatggcaaaattgctatggcagacagtggtggaagggagtaaaaggttcaggggtgtgggcatgttgaaatttatatactccgtgcatctagaagacatttgagacgatcatattccacatgaaggtgtaaataacacgtcatttataaagatcattagacataggatgatgaaaggggcactgatgtcactaaaatattcagtgatggctcatctctgtaggcaagaatgacaatagaaaggctgttccagaacttggctgggtgatagcactggggatgataggatcctaagacaaaagaggccattctgggacatagtggggaccaaagaaaaaaacccaagaagccaaaggcaacacttagctggcagaagtcagaggattgcaattatagcagccagcagggtctgagtggcagccaaggggacctcacttgtatggttatagaactggtcaataaacatggcatccctggaggcaaaacaggtgggcagctaagaagggtactactcagctggcaaaaaaaaaaaaaaaaaaaaaaatccatccaggcacggtggcctgtgcctgtaatctcagcatttggggaagctaaggtgggaggatcacttgagcccaggagttcaagattacagtgagctgtggttgcaccactgcactccagcccgggcaatgtggcaagactgtctcaattgaaaaaaataaataaagatgcttgtcccagttttaaaaaatcaggattccatgcccagcttctggaactgagccagttttcagaaatggaaacattacttgagaggtggccaaacaccaggaagaaggacctataacagtacaagtacaacagaaatgaatccccaggtacttttccaaagggtctgatagcaatttcttttgataactacatcctggagaaaagtgattagccaaacatttggaagacttgtggacacagggtctaaattgatgtccagatgcctagaatatcatccccttctgttagagtggctgcatgtggtggccaggtaattgatggagttctgctaaaggtccagcttacagtggacccgtagacctagtggactgatctagtgatattttcttagccttcgagtgagtaattggcattgacatacttggcagtgaatgctcattccaggtccctgacctatagagttagataacaaaatggaaaaagccaaacagaaacctgaaactgccccatcccctaccaagattataaaacaattatcccagagcgggaatggcagagataagtgccacttctaaggatccaagtgatgtaaagtggtggttaccaacatttttaatttaccagcatgacccctgcagaagtcacaaggatcctggagaatggcagcctactctatttgctgtcaaccagtagttgttttgggtacactgctgcaaactcatctaagaagtatccctggccgggcacagtggctcacgcctgtaatcccagcactttgggaggataaggtgggcggaacacgaggtcaggagttcagtctggccaacatagtgaaaccctgtctctactaaaaatacaaaaaattagctgggtgtggtggtgtgcacctgtaatcccagctacttgggaggctgaggcaggagaatcccatgaacctgggaggtggaggttgcagtgagccgagatcatgccattgcactccagcccaggtgacagtgtgagactctatctcaaaaaaaaaaaaaaaaagtatccgtaatagcctctctgccagatatggtaggtagttgttgactaggtggatttgttcttttctgtacctatcagggatcaaaaacattttgcatttgcatggaattaaaatgcagttttgccggaaggttatgttacttctcttgctctctgtcgtaatccaaagagatctggaccacctagacatcctgtagaatattacattgttcctttacatcagtgacatgttgatcagccagatgagaagtgcagaagatcctggagacagctgctccagagagtggcatataaaccctacaggaatccaggagcctgctacaatcctaacatttttagggctccagtggtcaggggtgctctagggcatcccttccaaaagcgaatgaattattgctgcttgcacctcctgccgttaagaaagcaagacgcttgttggttctcgagctagttcttgcctcaggttctggaggcagcatgtcccacacctgggagtattgctctggtccagagactagtggaattgggagatttccaattttggaaagagcccagaactggaaacgtctgtacagtagatccgggttgtgatgaagtaatgctattgcctgggccatatagtccaacaggtgtttttttggtgttattaatggtgcagaatgatgcaatgtagagattctgtcatgccacctggagcagagaattgtatgcatttggggggcgggcgggtgtagatctgtcttctggtatgccacttgtctctgacagagatggaacgcctgaccgtaagccaccaggtgaccatgcaaccagaactgcctgttaatgttaaactagcaaaagtcataacatcagttggggccagcaacggtccctcataatatggaagtagtatattcaaggttgagcatgagaatgtacagaggttaccaaatgagctgcagagcacagatgcacatgacttccagaactgttggatcagccacaatgtcatttcacacctgtgacagtgtgagggggcccttatagccagttgacaggagtaaaaatcgtgagcatggtgtataaatgggttggctcagtatgagttcaaaatgaaaatagcagctacattacagccttctcaggggtgaccttgaaaaatggtgataagggcatatcctctcaataggcagaatttcaggcagagctcctggtcgtccacttttttgtggaagaagtagcccaaggtgagaatatacatggagccatgggcaatgctagagggcctgggtaactggttaagggcctggaaggaaaacaatcggaagttggagataaggaggtgtgtggtagatttatgtggtcagataaattggaatagcacgaagtacaatgttctttgtatacaatgttaatgcccaccagagagcatccatgaaagaagcattatacaaccaagtagacagttgactcagccagttgatattggacagcatcttttattggctactgtactactggcatgatgggcacatggacaaggtagccaaggtgatggacgctgttcatgggcctgacagcaacccatgctctctacccagctttggttaatatctagctgcccctgaatatctaacctgccagcaaaagagatctacccggctttggttaatatctagctgcccctaaatatctaacctgccagcaaaagagaccagtgctatactcccattgtgggtcacttcatcaaggagcacaaacatccaggtttacagaggtctttagacatagtccccattttataaggagagtttactgtattggaactctcccatcctggaagggctggtggttcacttttcacaagaatagtctcatattccagatacgaggcttgtcttttcctactcacaagtgtcagccagaaaggcttaaggagtgtttgtttcactgacataagcacacaacatttcaaacgagattcactttatagccaaggaagtgtagtgtccatgggccctcctgcctggcagagcgctgagacagcatgctaaaggcacagcctcccaaaggcatgagccactgagcccggcactgaagacttccttgaaaccgttctttgcaatctttctgttattgaccagctggacagtgcgtaactgcatgggaatgcttgcagatcagtaaattcagacaccttcctttccacataagatggaccaccagctgtaccctcccaagttttgccagctggaaatcttcaaaaat

SEQ ID NO: 34 - DNA, 2578 bp, Homo sapiens
tctgtgacctgctgatgggtcataacctgcagggtttttgttttattttgttttgtttttgttgacagagtctcgcactgtcacccaggctggagtgcagtagcgcgatcttggctcactgcagcctccacctccagggttcaagtaattctcctgcctcagcctcctgagtagctgagattacaggcacccgccaccacgcctggctgattttttttttttgtatttttagtagagacagggtttcaccatgttggtcaggctgatcttaaactcctgacctcgtgatccacctgcttcagcctcccaaagtgctgggattataggtgtgagccaccatgcctggccataacctgcagttttaaacatatcgggctgaatatagttgagggtgcttaaatgctatgatgctgtgattcagctgggccaggaatatagagaacagtggcaccctactctgtgttgggccagagattgctgaaatgtctagcatattagatcaaccagatttttagttctaaaggtgaaaccagaagcatttttttttcctctcaaaaacacacatagactcagaggtatggatacaatacctgaagggctatagttctttttccaggattgtccctctcagcaggaatggaggatccctagctagagaggagagctgggggtgacaccttcttgcccagtggaggacagctggtggtgtggcctcaacaggttcttaggaaggtgagttccttagcctttctactagtgaggtgtttgggttaaggtgcagcaccattgactgggcccgtgtggggaggatattcaaagcatttcacaattacacagctgcctgggcaccgacagagtcctagagaagtgtcgactgtgccaggtccaacccttcagtcgctggatcatggggaggcatggagtcccattgtagaggctgggtggtggtagtaggcatgcaggaattcagggaagctgctacttaccaccatgtaaaaaggatttcaatattttcaccctggtagggatgcaccagtgtgtgcttctcagcctcagtcctggacgtatgccccattgccctaaggttgtcccaaagaggccaccattagacctcaccttttatggacaggtgggagatgtctgaacacaaccacatgttgcccagtgacaggggctgggctgaccaggacacggagagtgacttgccttctggggctgagccagtcactcatactcccagcgtagccctggagcttcactgcaactgctatgttacaggaagttgtaccagcagctctacactaaggtgtatagtcggtgaccactttaaagaaagactcattagaaagaggcattgtttggggaggccaacaggccagctgttggggaccatgccagaggtactgtgtcaaggtacctggcttgatgcttacttcccattgtctgtttcttgagtttattttgcgccatctgccttcttccacctgatttggaattccaggactgctgtgtaggcttctcttcagatgagatgcagcagtgttctcaactggcaggggcagctttcttgggggcagggactgggcatctgtgttatctatcctgggcccatctgtttctttccccttgacacccaccacaggggtctgtgtacaagagggttggttgataccagttttaatgagggaacctatcttcttggaaccatccagaagctgtggtctttttccctggaacaccccacccccgacatcccagtgctggattcaagctggtgaaccacaggtcaaaattttcagttgctgtcttccagggccttggttgttccattgtcccctctccctgtaccaggatcatcgtgatccaatggatttgatggagttgctacacccagcttggcgtgcagaggtgtttggcacatccctgcctgtggaattctacgctctaagggagatgctgccagggtattacctgattcacgaggcatgtcctaccatctgtgttatattttttttaagatcagaattatgaatatttcaggagtcatctgggatctgaagaagcaagaacccactttctgagtcttttccttaaccattcatagggggtaagaaatgtcacaggtttgttgtgaaggtcaaatgaaagagaacttgagaaaatttgcaaatccttcagttcaaggtgaaagaaggtaatttattattaattcatattgttattatgtagcatttcttagaatatgtataccaaatgccttttttgactggtgcaatctttctataattccattctgggatgttagcttatttgcttagagaatggtgtaaagaggggagcccgaggccggcagatcacctgaggtcaggagttcaagactagcctggctaacatggtgaaaccctgtctctactaaaaatacaaaaattagccaggtatggtggcgggcacctgtaatcctggctactagggaggctgaggcagaattgcttgaacccaggaggcggaggttgcattgagctgagatcatgccattgcattccactctagcctgggtgacaagaacgaaattccatgc

SEQ ID NO: 35 - DNA, 7401 bp, Homo sapiens
gcaaacgagtcaggcatcgtggtaggacctggcgagtggggccggggagagcgggacgcctggatcgggaacttgtcgcattcacattggctgctaggaggcctcggcgaccacttccggatccggggcgggggtcgcaactcccagcccttgctcagagggctgaactagaattcccagaagcctctgcggccgccttcctgctccttcactcctgcttcccccacaaataacagtgagtgaaagcatctaacaagcgtttccaactcgccgaatcattactagtgcaggcattttattctaagctgctttttactaaaacgtgctcttgtcgctctgaacctttaggactacaatacccagaagtctctgggagtcgccgagccctgtagtttagggttgttttgcggccagcgagacgccggaagtctgggaataaggcgggaccagggaaaaagcaggattccgattggtgaagaggccacatggccttctttaaaggacgggatagagttgcacacgcgcattgaggcgtgtcttccctggttctgcgtccgtgaagcctagagattcccgagcctgggtcacccgggcggtgtcgcatgtcgtctgcggggaggttggggctgctcgcgcgaggcgctctgggtctcatttccgaggccgaaaatgctggctccaaagtggtgccctgggagatgagggcgactcgcagattccaccctattctctgaatgggcttcgagtctccatggtaacggcccctcccagttcccctgtgacttcatagctgcccacgggaggggagaaagctgatgtgaaggggctgtgggttctcagccaagctctgtctttgaggccacctaccctataccactcgtcccggaaagggtgagccggtgacctttcaccctctctgggcctcagtttccctttttgtgaaataatgtctggtacccctgctgtgctcccttactatttcagggccccgggcaagagacacactctgtgtctcagtttccgcataggtaaagtgaggatgatgttagaatttgatgttaaaatttaggtggtggttgtgagaattaagggaacctcagagcaatggccagcacacaatgacccttcaaatgtcagcggctttgatgatcaccattcttaccttttctttggagatttggacaagttaccgccccaccttcctccagggtctttgtgtattgatctgcaggttggatgtattggatgttacgaccactaaactttcttctgagcacacacgagcagtggtgttgttctctctgagaaatactacaggctttggtgttaagacactggaattccggaaacctgtccctgtcataccagttgctgtgtgacctccgtcaatcatggttctttactgagccctgagactccgcacgtgaaaatggatggggatgaacttccagtccaggcagtgccactgactttgcttggggacctggggcaagctctgtggcccagcattgcaccatctgtaacaacataaccaaggggtgcgcaattgagctttgaggttaatttcggtgctaaaatcccggtcagtagttccgtcatcttcacagacctcaccctacccaatgcccttattgtgctccacatcccaatcaacacttactgattccagatttgtaatttttgccattgtagtgagaagtaattaactattttatggttttttaaatttgaatttttgactatcaggattagcatattttttttttcttcgttaaagactagtcaagtgcattagtgaggaggggggaaagagtagaccaaggaatttggtctgtaactgactgtggacaatacattggtagaactcactacctttgagccagccagaatctttttattattcactggatattcaggttttgcctctgtaaattttctttcattgccatttttttcaaatagttcattcaatctttgttttcagatgtgctttccacaatcaggttacaaattctctgccactaatgatcattacaattcctcttctcagcctgtttattgtttggtctgtttatggtttctcaggcttcttatttatttatttagacagagtcatgctctgttttccaggctagagtgcagtggtgtgatcttggctcactgtagccttgacctcctgggcttaagcaatcctcccacctccgccacctgagtagctgggactacaggcgcatgccaccacctgcagctaatttctgtatattttgtagagatggggttttgccacattgcccaggctggtctcgaactcctgggctcaagcgatccagccgccttggcctccagagtgctgggattacaggtgtgagccaccatgcctggactaggcttctttaaacattgaatagtgttcctttctagatgaaggaggatcacatagcacttgggagcaaagatgcagccaagtaacccagtgctggagcccacgatggagaagatctcacggccactctggccttgccctgggtgctttagtaactcgggaggaaggccacccagacactgcaggacaccagcatgctgaaggtcaggaacttggcttcgttgaaagcatcaggcaggttccttgccagaaaggctacagcaagggaccctaaaaccaagaagcccaagtagcccaagacagagtagaaggcagtgacggagccctcattacactggataatgatgtagccaggcatgaactgagggtccttgtttacgaagggaggctctgtccccagccagattccacagagggtcacttgggtaaaggagcaaaggaagacaacagaatttgttttttggggacccatccactttcggatcctgctttctggccttatagcctggaaggccctgcagaaaacacagccactgtgaacacagctgcaaaggtggtctgtgagaggaggcaggtggcagggctggggcggccgatgaagagcgaggaagagagaaagcagagtgtgagggagacaaggagggtgtagctcagagtctggttgctggccttgactatgggagtgttttggtgccacacaaactccacaaggatcagaacagagaggacagagtagaacaaggctgtgcatgccagagtcaggcccaaagtttcatcataggccaggaaggtctcctatttgagaaggtatgttcccttttcttgtttggataatgatattcaggacaaagcctgcattgttttatatctgaaataaacaaaaagggtgtcactgtctccaaaacagagcactgcacgtttggtaagattccattgcccagagctctcaccaccacagcgccatttaggtggactgtttggctggtgtgtgtgtgtgtgtgagagttgtgtgtgtgagttgtgtgtgtgcgtgcacgcaagcatgcgtatatgtgttctgcatgtgttttaaaggaaaacataaatacttcaccagcttttttttttgaccattttaatcagttttattgattcatgcttccggttcttattcagttcaaaacaaggcacattaaatacatcctcttattgctttataaatgcacgtagctcattctctatatcaaaagtaataaataatggccataaaacaccaagacctttataaaaatgacaacccagccttgaacatagtatttaacagtccaatctagaacaataacccaacacggtacatcaaagtgccacatatgaaaacatgcagtgtgtgtagtcactctagtactgagcttgcactggctattctttaaaaacatactagggctttttcactccttaaaaaaggtggacatgatgcaaacattgcaagttatagcatcactgactttaatattacatttatgtgccaaaaatctttacagatacataagagaaaataaaatcaatgataacaccgtatatttaataaaagtgaaaatgagttttttgttgtgccaaagaggaagctacatattttgaaacagacaaagccaagccagaaactgaagcagaagagggatcacgcatttaatagcagaaatcctaatacactcagtataaattgattgaaagcaggaatattgcaaacagcatgatggatatgaggcagaccaccgtggctaaacaaataatccagcattatcattattgttatgactgtggtggggctatttaaaggagtatccaactctctagcacagatgggggttccttcacctgactccccttaaaggctcttgaaataaatcacttgataataaaaggcaatccctgcatacccaccccaaccccaacagaatcaactaatgtcaagtttatatgcaaatggaaaattttttcttttgttcttggaacgaatttcaaagaagctcattcccccctatttcttgtctccctttcttaaatcaggtaaggaagctgtacaggcttaattcagaacttatggctgggtgcagtggctcacgactgtaatcccagcactttgggaggctgaggtgggtggatcacgaggtcaggagtttgagaccagcctgaccaacatggtgaaaccccatctctactaaaaatacaaaaattagccagatgtggtggcgggtgcctgtaatcctcactacccggggggctgaagcaaaagaattgcttgaacctgggaggcagaggttgcagtgagccgagattgcaccaccgcactccagcctgggcgacagaccaaggctccatctcgggaaaaaaaaaaaaaaaaaaaaagaatttacacaaaatgctggggtgctttattcacagtaatggcttgaaatcagttcatttccaaacgagtctctgggattggtgaaggaccgtgtgttttagcatttagcagattttaagtaaaagcagatatgctcaaaagaagaaaagtgtgcttttctttgtccttaaaggaacttcattcatagcaaaatatgcacaaacaagacctgtttaacaaacacagatctgctcgggccagtcgcatcctaagcccggtccctcctgtaactatggtccactggaattgggactcttctgtcgaggttctcttctgcagttttcattagtataaagagccggcttccagacacccttcctttttgaatagcactcatcagctgcaaaaattcattgagttcaacctgtccatttttattcaaatcgacttcatttagaatttcatggagtgtattttcatccatttggacattgatactctctaatacacatggaacatcaacaatggtaataaagcctttctggtctgcatcagacttacaaaatctcttcttatacctgtcactgtctgaaggcagtaggctaatttcagagccatctgttaactgttctgatcaaagtttagtctgtttcataatatagaaacttcctggttgtttcaagttgttcctgtttcttataatcatctcaattctgttctctgcccattagttcaacaatcctgagtagggcttgctctgctgcccggacatttagaaaggccaggcgaggctgaggcaggcagatcacctgaggtcaggagtttgagaccagcctgaccaacatggagaaacccaatctctactaaaaatacaaaattagccaggcgtggtgatgtcctgaccaacatggagaaacctaatctctactaaaaatacaaaattagccagggtggagacccaatctctactaaaaatacaaaattagcctgtaactccaggtactcgggaggatgaggcaggagaatcgcttgaacccaggaggcggtgattgcagtgagccgagatcataccattgcactccagcctgggtgacaagagcgaaattctgtctcaaaaataataataataataataataagccaggcgagtacaacgtgaaatcatatccacggtggtgcaggaatactccttaatcccatagttcacctctgcttcaatatatggaaattctgacacaagacgtactccaacaataggccaccttttgctagtcacacttgccattgtggccacctcaaaagccttatcaccataggtggcagcaagatgctgtgccccctcgctttcaagtccataatcctggacaagcttcatgtagagtgtggggttccaatctttacccccttgaaggaaaagcccagctgttctacttggtcctgctttcaaattgtgggttttgatagcagcatttagggtatcttcgccacagaccggtaagttgtccactttccacctgctgtagtaataagacttctctcactgacatggacaacatgatttcaggagatagactgagtatctgcagatttgggatctgtaacaaggggacggatactgctccacgctgctaggatgtcgcccctcttctcacctcaacatcacagctcaggtaattacgtgcttcattcaaaatgaagttaatatcttcttctgaaggacttggatggtgtgtaatatcagttggggtatcagtagtgccagcaatcatcatcttttgccagggtaagaagaaaataactcgcccatcactggtcaagaagtcccatgccctctgggctgtaataaccaggcatcacaatgtggacaccagcagttggctggcagatagctgcagcatccttatcatctattttgcacacagagtctgtgaaatgtccaacggcattgataacacacttggctttcatgtcaaattcctgccctgtgaggacatccttgcaccatgcaccactcacacgcactttcgctgtctgtctgggtgtctgtcttcttaagcaagctcactacctccctgtcattgactgtggcatccccatatctggcagcagtcagcacaatggcaaggttcatccatgcatcgttatgtcgtccatcatagtagacaattcctcctaccagtttgtccttctggagcattgggaaatgttcaagggctcttgatttgctgaggacataactgcttttcaggcaattacttcctgcaaccaaatcatacagcttgattcctacccagtagtaaggtaactgccaccacttgtaaactggaagcatgataggcaatggagctgataaatggggagaaatttctggcaggttggcacgctcatcaagggcttctgttaccatccggtactgctcaatatccaacttcatcatggccttctgaagatatctcacaccaccatggatcaaattagtgcttctgctgctggtccctggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaag

SEQ ID NO: 36 - DNA, 2457 bp, Homo sapiens
atgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaa

SEQ ID NO: 37 - DNA, 4554 bp, Homo sapiens
gcttagttgtgcgcgcccgcgctctgctgtctgcagaccgcgtgcgccggcagtggctctaagggggccgcgagggcacagcggggcaggaccgcggcagagcgcagtaaggagagtgtggaccctcgccctgtcctctaagctccatgtgaaatgtggataatattccttactgccataaatagccactggccgctgactacgcgtaaggcaaacaagcgacctgcgttcaagggacccgaagactaggggagaagcagcgagcgggtcgcggccgcctacccaacggacgcctctgcccaggttctctgccgggaagcttcgtccttccgggccccagcgcagccggaggctggggagctgctgcctggaagggtcagataccgcctgttaggcggagggtgggaaagacactctcctgcttcaggagctatcgcagacaaccggagggcggcttatcgcagagtcccagagccagccagcaaggcaaggtcgcgggtgcacctttcactcccagaagcttgggtctgggactgcaccacgcaacgtttgcccattttgagggctttaggtgtttcatatttcagttaatagaatttcgattaatacataatttgataccattttaattgtttgctactcgggagcaagttttatgtttagctgtaggagttaggctaagttaaatgttgcaatgctatatatatttaataggatatgaaaaaactatcttacagccgggcgcggtaactcacgcctgtaatccccgcactttgggaggtcgaggcaggaggatcgcttgagctcaggagtttgagaccagcctggacaacatagtgagaccttgtctctatttaaaaaacaacaacaggcctggcgcggtggcccacgcctgtaatcccagcactttgggaggctaaggcgggcggatcaccggaggtcaggaattcaaaaccagcctggccaacatggcgaaaccctgtctctactaaaaatacaaaaattagccaggcatggttgcgggcgcctgtaatcccggctactcgggaggctgaggcaggggaatccttgaacccgggaggcagaggttgcagtgagatcgcgtccatgcactccagcctgggcgacagagcatgactctatctcaaaaaaaaaaaatcttactatttggtatggaattttctgatagctagggtaaagatgctctttttccaagaaggaatccgagtatccgaatacaggtggtttagtgttactctttgtttattggaagttgtagcagctgtgtttagatagtctgctaaaacaaaaactgcctaaaccagaagagtttatcttttgccattgtgtattaaaactcttcatagaaatatttattttggagtttgaaatttaagtgaaaatgtggctcatgcataggtgtgggtgtacatatgactttcaagtgacaaagaagattcttagcaaattgtacgtgttcattaagactcataagttacctctttcctagaaaaacaatatactcctccaaaagctcaactgacaatgagaaactgcatttctggacatgaaaagtcaaatgaatgcggggaaaagtaaattgcctatagaggtattttctgtatttccctagagggggaaatgtgtaatttctcaaaaggaagaagtcctcatttatccttctgaaccacaatcatatgaatccattcaattaatattaatcttatcttctattctccatcactctctacatctttctataattgcatcattttcttgtccgtataatacatcaaatgcagaggtgattttaagggagccacaaatcaagaagtctcaattcaataatttcgttaaaatgtaagaaatatatacggattaagaatattcttaggtaattatgttctgtttcaaatatcagtgaaaattttcatagacatttaaggggtaaaagacatttaacagatagaaaaaaatatctaccttttaaaaaatgaccttctcttttgtcctacgtgatttgttgagcagactgggttttttaaaagtttctgttgaaatgagcatgttgtaacatgctcatatcccatttcaattgacaaatatcacttggataataattgtatatcttaaatatgaacatatgaagcaatcagcagcagcatcctttcactgagcaaggcttaaaaataccaaagaatcagtgccagaagaaattctttaacttaaaatatacgtaatcactacattaccatataaaacaatgatttctaaatgctggaaagtatatatcttaatcatgagacgaggcagcactatgcacattgtgcataatatgtgagacattgaatggtataaaataaattttaacttttatctaaggtttacaggaaaagcagcaatacctatgattaagccacccgacttaaatgagtgtttttaagatgtggtgcttgcacataagcggaggagtggtggtaacaacccttgtacagttcacaaatccaggactggcaggaaggtagacaagtgtcattctcagatttcagaacccagcctgaaagtgagaggacgtcaggcaacaataccatgcaacgacagcgtgcaacaaatacacaactggattatctttttaagggagaagcttgtttgggtttctaattgcttttaatgaaccaagtattgattactgttttacccaaaactgtaccaaaatatgtgtaaaactgataagataatttatagctttctagttatggaaaagcttgcaaattaaataattcaaatctcaatttaagaactgtaaaaatgagaaattggttcatgtaccatagtgataataataccaacaatacttaacagtagactatgcagacactaaccataagagatttgtagtggctatactaatatcagatgaaacagactttaagaaagaaatttctttttcttttttcttttttttgaagtgcaatggcacaatcttggctcactgcaacctctgcctcccgggttcaagcaattctcctgcctcagcttcccaagtagctgggattacaggtgcccgccaccatgcctggctaattttttgtatttttttagtagagatggggtttcaccatgtcagccaggctgatctcaaactcctgacctgatgtgatccacctgtctcggcctcccaaatgggattacaggccagcgcgtctggctgacaagaaatatttttagagacagaaattccatactgataagagggtcaatacattgagaagatataacagttataaatgtatatgcacccagtaacagagccctaaattcatgaagcaaaaatgattgaattgaacagagaaatatacaaacaacagtagtttgatatttcagtatcctactcacaataatgtgtagaacaaccaggcagaaaatcactaagtatatagaaggcttgaacaagactctcaacctaaccaacatgtacagaccactgtacttaatgacagctgaatttatgttctttttaaaaagtatactctccaggatagccttatgttagaccataaataagtctcagtaaatttaaaagaattgggatcatacaaagtacattctccagttacagtggaattaaattagggattgacaatagaaagaaatttggaaaatccccagatgtttggaaattagattactcatgggccaaggaagaagtactaaaggaaattagaaagtattttgaaatgaatgaaagtgaaaacatattgaagtcatgcactgcagctaaaacagtgatcaaaagggtatttagtcctttaaacaccaagaaaaagagtctcaaatctacacttccaccttgaaaactagaaaaagaggaggaacgtaaacctttagcaaagggaggaaataatgatcatattgcaaatcaataaaataagtaacaaaaatagagaaaatgaaaatcaaaagtttgttttttagaaaaaaaaaaaaaccagtaaaattaatgagccaacattaaactggccaaaaaattaaaaagaccaaaattaggaatcaaaacaggtacatcactaccaacccaaattaaaaggattgtaagagactgtaaataacgttgtgccaataaattagacaatgcagatgaattggacaaattcctagacagacacaaattgccaaaactggctcaatagaaaatccaaaaagactttattttctatggtggttgtaaaaaaaaaaaaaagtattataaactaggtggcttaagacaacagaaatttattatctcatgttctagagacatgaagctcgatcaaagtgttggcagggctctgctccctctgaaacctggaagagagaattcttgtctctttcccactgctggtgttttcagcaatccttggcctttcttggtgctccttggttttacaactgcagcacttcagtctctgcctgcatctccacatgtgctgttccctcacgtgcctgtctcctagaggctgaagtgcccagcctactccagtgtgacctcatcttaatgaattacatctgcaatga

SEQ ID NO: 38 - DNA, 1710 bp, Homo sapiens
cctggatgcagtttgcctatgtgaaagatcagtagaacttaaaaatgatcacagtgaataacttacagtagaaattgaaaaaatgataaatgagtttagtgtactaccaaaggaactatctgaaacaaaagaaattaggtcatcacagctagagagccaacaagttgaatgggaacaaaaactcagcaattttttactttaaaacaagaagaagagaagaaatgctgatatgttatatgaaaaaactagggaagatttaggcagaaaagaagaggaatataagaaagaaatcgaagtgaaacaacaacttgaactcagtccgaagatatgttgcatgaaaattgcatgttgaagggagaaattgtcactctaagactggaaacggacacaataaaaacccaggaaacagtaacaaaaacagtatctgactgtaatggagagctgaatgttttgacaggtgagagcaggtgagagattattgctcagttctgaactgaagaaagaaaaagaaaacacggaaagactggaaacagaagttgaatcctatggttatacactggctgctgctatatgtgatcttgatcaaggcaagatatcaaggaaacacctagaatttgctctccagagtgcaagagatgcttgtttacaagaaaaaataaattttgacatgtctaacctaaaaagtaacaatgaaattctttctcaacaactttctgaagctcaaagtaaattcagtaacctaacaatttagttccataacacaagagatgctctcagagatataactttggtttcagaacgtctacaaagagatctacgccaaacacgatgtcagatgaaggacactgaacaaatgtatgaaaatgagcaagataaagtgagtaaatgcactgcaaagcaggaagccatggaagagagattatcccagctacaaaatgaaaatatgctgcttcaacagcaactagatgaggatcacaagatgcagatacggaagaaaagataattaatactcaagaccaatttcttgggaatgaaaagcaacgttgttcactagaagataaatataaggagttattaaatgagtgtgatcatttaaaagaaatactatatcaatatgaagaagagaaagcagaaagagaactaagtaagaaactcttacaaatgacagaaaagaagctcaatgaatgtgaaaatggcaagtttagtttttatggagatgtaaagaccaatcaatttgatgtagatattcagattaataatctaaaatatatctaaatctggatacagagaataaattttttcaacaggagttattatctatgaaaacaatacaaaaaatgtgaaaaactacagaagaaaaaaccatgtttgaacaagaagtaatagacctcaaaagtcatgtagacataagtatggtagaatgtggtcaagtcaaacaatataaacaggagattggagaaagagcaagacagcgtatagaagaattacaagaagtcaatttttaaaaatgtagctgtttaatttgctttagacagaagcagcatctaaagaacatttagagcagttaagatggcatgatattacttcaataaataagatggaactcaaaattaaagctctggaagctgagcagtcccaaatgtaaattgctcaagaaaactttagtgatagcgaattagaaaaacagaagcagctatatctagaagaatt

SEQ ID NO: 39 - DNA, 21561 bp, Homo sapiens
gccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 40 - DNA, 1960 bp, Homo sapiens
actcttgctgcaaacattgggatcagccgtgactatcccataacataatatttctgatttcattcttttcctttctcctaccaatttaatctgcaatcacttcaagagaagtctgtttaaaggatattcacattctgttcacagagtttgagagaaactgtattcaagttgctgaaaccaagaagctacactcacgagtctcacctaaactcgaatctgatttagatgacatcatcctggactttgagttgatgaaaccttggaggtcttgggagtaaagcaagtgtgatttgcatatgatggatatgaattgtaatggccagagcatggctgtggtaggtaacatctagagatggccaccattattttttttttcctctatccgcacatactacttctcctgtactcttgaaactgggatgaaattagcaactttgttaaccaatataatgtgccacagaagtgacttttgcgacttgtgaggttagatcttaagaagtcttgtatcttctttctggatcacttggaatgcttactacgggaaccaagccactgttctatgagaagtgcaagtcacatggagaaaccatgttttggcaagctagtctgcatcttcagattccggtgcagtcctctgaccatattgggaaggatatgtaaaatgatacgagtttcagggaataagaatgggggtgagaggaatcactgaggatgcccaaggacaaagcagccggaacaagtttatagctcagcagtcccaagatggccgaataggaacagctccagtctacagctcccagcgtgagtgatgcagaagatgggtgacttctgcatttccaaccaaggtaccgggtttatctcactggggcttgttggacagtgggtgcaatccacgaagtgtgagccaaagcagggcggggcatcacctcacccaggaagtgcaagaggtcggggaattccctttcctagctgagggaagccatgacagatggtacctggaaaatcgggacactcccatcctgatactgcacttttccaaaggtcttagcaaatggcacaccaggagattatatcccacgcctggctcagagggtcccacgcccacggagcctcgctcactgctagcacagcagtctgagactgaactgcaaggtggcaatgaggctgggggaggggggtccaccattgctgacgtttgagtaggtaaacaaaacactccagcctgggcgacggactgagactctgtctcaaaaaaaaaaaaaagaagacatttatgcagccaacagacacatgaaaaaatgctcatcgtcactggccatcagtactggagaggatgtggagaaataggaacacttttacactgttggtgggactgtaaactagttcaaccattgtggaagacagtgtggcgattcctcaaggatctagaactagaaataccatttgacccagccatctcattactgggtatatacccaaaggagtataaatcatgctgctataaagacacatgtacatgtatgtttattgtggcattattcacaattgcaaagacttggaaccaacccaaatgtccatcaatgatagactggattaagaaaatgtggcacatatacaccatggaatactgtgcagccataaaaaaggatgagttcatgccctttgtagggacacagatgaagctggaaaccattctgagcaaactatcgcaaggacaaaaaaccaaacactgcatgttctcactcataggtgggaattgaacaatgagaacacttggacacagggtggggaacatcacacaccggggcctgttgtggggtggggggaggggggaaggatagcattaggagatatacctaatgtaaatgacgagttaatgggtgcagcacaccaacaaggcacatgtacacatatgtaacagctgcacgttgtgcacgtgtaccctagaacttaaagtata

SEQ ID NO: 41 - DNA, 2646 bp, Homo sapiens
agacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacagagctggaagacagctgttcctggatcacaccagaatggagaagcaagctcctcccactagcagaaagcctttgctttctgtgcctggattcggaagattagttaagcactggaagaggaggggggaaacaacaactcgtttttgctgtatgttttttttttaattgtttttatatttatagaaagttatgctttgtctgattcttgcgctaatttgggttctgaaatttgagtaaaatcaaatttaaacatacaaaacaactttaaaaccacaaggaacaggaagcaaatgattatacataaaagacatatagaagataatgcatatgtgttcagtggaaaatagaaaagcatgaaagtaagatcacaaatatttattatttaaactcttccttgaactattggtctgccctttggaaaagcagactttccttaatgcagtagctcatattaatattttttgtttgcttaggaccagagcaagaaggttggacttgggagctagtttgctgtctggctttgagaccttgaacaagttttgttctccttctgtttccagttttcttttttgtaaattaggagattaactcatgtgatcactctattttcaactttttgttatgggaaatattcaaacatatgcaaaagtagacagaataaaggactctcatgtgaagatcatccaacttttacattttttcaatgcatggctgatcatgtctcatccataagtccactcactttatcactaccaatcctccctcttttttttttttttttaccaaattcaagctttatatatatcttttcagctgtaaacattcagtatgcatccacaaaatttaaggactgtttaaaaataaccacaatatcattagatgattctttaaaattgcagtgtaatttacacctagggaaatgctcagatgttgtgtccctttaaatcagttttgaaaaagccatgcattagtgtaacccacactattttgaagacacaggacattttcatcattccagacagttaccttgtaccttcatgtgcatattctagaatgtcataaagatctaatcacgtagtataaactttgttttatatttgtctgacttcttttactcagtataatatttgtgaggttcgttcatgtcgttgcatgaatgggtgttttgttttttattgctttttgttgtttctttttactactgttaatagtataagttttccattgtgcctctttacaactagtatctcaatagagtattacaacaattatttaatatattatttcacatgacatatttatagtataaccatgacctccttgagacctagtgctttaagtcaaagaggtaaataaaatgagatattttaggtctcattacaacagaccaatgtgagagaattatttctggacagttgcacttcttataaacgtttaacatgattccaaacttttatttggtaatttgttagtcctttggcaaaggactaatgtactatgttatttagtcataacaagcagatcaattacattttatgtaacttttatagacagagaaactgagctccaagagttttggtgatatgctgagatcacctagctattttaagtggcagagctgagacaatttagcagaaactgttacagaaggcacaattgtctcctgaattagcagtttgtgtctgaagcctcacagattgggtgtggtaaagagtgagaaggaaaaaggtagaacccagctgtgttagaaatagccttcaaatttggatgtgacaatggaaatcaagaagaacttatgttattatgaaacagttcattcatatttaaagttttgccttttctatattggtattcctcaatagggggagatgatttcttactacctacaaaaaaagaaaactgtaaactaatttcgttgtcattttgaattacaactatatgtttaactcttgtcactccttaaaatgccttgaacacagtaaacatccaatgaacttttaattacacataatattgatagtgatattgcatatgttctaggtctgtattcttaaggagggaaagctgctcaagtacaaagaagggaactagaagttaaaataaagtttttttaatttttcttttcattattgatggacagcatggtcttcagtaaatctttagcctctctgaatataacgttaaactaattgaatggcttgtacctcataagaaatatgaagttatgaagtaataacatatttggaagcattactaacatgcatattctgttcataactacaatattcatgttttgttttctctttgctaagtgaaatataaatattttaccagacc

SEQ ID NO: 42 - DNA, 5044 bp, Homo sapiens
gaacactgctttgctctgcagcaggggagccatctagctggagctctggccagattgcccacaaactcacctgtgttgcctcctcgatgggaaaagaaacaagcgcactaatggtgcatttctgtggagaggagataagtgtcctaattaggaaggctctgaaaatgagtgattgaggcattattggatctgatttggggagcactacagtctaaagcctgaatgcattaaacaagagtgaattagagtcaaagggtttgttaggcagaaagaaaaaagtggaaagtctgtgggggaagaaaatccttaattgagttttctattgaaataaccaataacttaaaagtgcaagagggaggcagaagagagggtcagaatgatgagaggtcaggacttcacccaccattgttgtatctgcagatggaggaagggcacgggagccaggcatgcgggtggcttttgagagctaggagaggaaaggaagtggatatccctgtagagcactcagaaaagaatgtgtccctgcctacgccctaactttagtgcagtgagatccatgtcaacattttaacttttagaactgtcaggtaacgaatttgtattgttttaagccactacctctttggtcatttgttagataacagcaatagaaaatgaatacattcatctcaagtatcattctccctccaacaaccagaggggtcttgccaaaaccttggaaaattcatgtgccttttctgcttgcaaccctccaaatgcatcattttcactcagaggactccagagtccaacaatggccctcagggcactgtgggatctggctctgccacctctctggccctagctctgtaaatcttccctcttttgctccatggccattcctcagacacgtcaagctgtctcctcactgcaggttctttggctcaactcaggttccctctacctgaaatgatccaccttcagagaattggatggtgagtaaacacaattaaagaagttggccaggcctggtggctcatgcctgtaatcccaacacttggggaggccgaggcgggcggatcatctgaggtcaggagtttgagaccagcctggctaacatggcaaaaccctgtctctactaaaaattaaaaaattagccaggtgtggtggtgcgtgccagtaatcccagctactcgggaggctgaggcaggagaattgcttggacctgggaggcagaggttgcagtgagctgagattgcaccactgtactccagcctgggtgacagagcaagactctgtctcaaaaaaaaagttaatctatgtgaacaatttaagactgtactagcttcagctagcaagtaactgtcttaataactgtctcagctcatctgtgtggctcactgtgacttcctgtctctgctcagcttagcaccgtcattctccatcatttatcacattttccactctatacttatcactctctgatatgttaagtatttattggctagtttttattttctcctctagtagactgtacactctatgagagcaggaactttgttttgtccactgttgaactctcagccactgggagactgtgtagcaccggtaggctcctagtgtttgagaattaattcattcccaccaggaatgctgaaaaagggtacatctacagtgaatctgaggttgaactgagacctctaagtttattttcatctcgaagttgaagacattgctaattttttcttttcttttcctttctttttttttttttgaggcagagtttggctctgccacccaggctggagtgcagtggtgtgatcttggctcactgcaccctccgcctcccgggttcaagtgattctcatgcctcagcctctcgagcagctgggattacaggtgcccgccatgacacccagctaatatttttgtatttttactagagatggggattcaccctgttggccaggctggtcacgaactcctgatctcagatgatccacccaccttggcttcccaaagtgctgggattataggtgtgagccattgtgcccggccatggtgctcattttcataaagccaataagaggtagaaccagcacttgaattttgattttttttttgtttgtttaaggcaaagtttgtcacaggtattttctcatgttgcctctagctgatgcctttcccagcagggctctcccatgggacttcttggtttcaccatgtttctacctctgggaaacatatcgcacttgcctgagtccttaagcacctgcttgctgccatgtgatagttgttactcatgccttaataaaacaatcacatacacttaggaagcatgcagctctaatggagctcaaaaggtacatggcctcagaacacctcaaaaggtacaaaattttggccatgagatgaggctggcgggagggaatggcttgaaaggagtgtctccatatcgtatcacacaaagagttggtatttggagctcctgacacttgagctgtgatttttcagtcgttctgtagaaactgcaaaatgtaggatatgacctatttgagattgaagtcctgcagtggtataggccattgatagtcatcttattggaagatatttgtccctggatcttggtggcatttttttgccacatgcagactttgtgtacacagaaatactgggtcaattattttgaataaactgacttgcttagtctcttttgtgttgctttatataaaggaatacctggagctggataatgtataaagaaaacagatttatttggctcataattctgtaggctgtatgagaagagtggcaccagcatctgcttcttgtcagggcttcaaactgcttctactcatggtggaaggcaaacggaagccagaatatcatatggcaagagagggagcaatagagtaggaaagcgctagtctctttttaacaatcagttcttgcagtaactaatagaacaagaaatcactgaagatggtgacgatagcctcaagcctttcacgagtgatccgcctccatgacgcaacagctcccaccagatcccaaccctaaatttggggatcaaatttcaacatgaggtttggagggaacaaatatctaaactatatcactgactattcgggctattgatagatttttttaaataaaataaatgatggtgtatttgattggattaagaaaatcaaggctgggtatggtgactcacacctgtaatcctaccactttgggaggctgaggcaggagaattgcttgaggccaggggttcaagaccagcctgggcagcatagggagacccctatctctacgaaaaggaggaggaggaggaaggggaggagaagatggagaggaggagggggaggagaagaagaagaggaggaggaggagaaggaggggaggaggaaggggaagagaggagggaaaggggatgggggacaggaggagggagctaggaggtggagaaaaaagaaaaagaggaggaagaagaaatgaaaaaggaaaatcaactggttgtctaaaatgtcaatcagcattttggtgcagataataaacaccactttttaaaatattttctttctttttattgtggtaaaatatacataacatttaccactttaataatttttaggtgtacaattcagtagcattaagtacatctacagtgttgtgcagccatcaccactattcatttccagaacttgtccattgtttgaaacagaaactctgtacccattaagaaaaactgcccatagccccctcctcccagctcctggtaaccaccattctactttgtgtctctatgaattttcctattctaggtaatctatataatgggaatcatgcagtatgggtcctattgtgtctgacttacttcacttaatatgctgttttcaaggttcatttatagtgtagaatgtatctgaacttcactcattttaaagactgaatacttttccgtttatgtatagatcacattttgttgtccacttgcctgttgatggacatttggatttccactttttggtactgcaggtaacattgctatgaacattgctgtacaagcatccgtttgagccattgctttcagttcttttgggtgtatacctagaagtggaagtgctggttcatacagtttaacttaactctatgtgtaacttttaaggaactgccaaacagttttccacagcagctgcaccactttctgttcccaacagcaacgcacaagtgttccaatgtcaccacatccttgaaagcacttgtcattattatttatttttttttaggataatagtcatccttatggatctgaaatggtacttcattgtggttttggttatcatttccccaacagctagtgatgttgaacatcttttcatgtgcttacttaacatttgtgtatcttctttggagaaatacctgtataagtctttcgtccatttttgaattgagttatttggttttggttgtgtttgttcagttttatgagtacttcgtgtgttctgaatgttaatcttctcaaagtttcatagttttagctcttacatttgggactttgatctattttatttatttatttattgagacggagtctcgctctttctcccaggctggagtgcagtggtgcgatctcggctcactgcaagctccgcctccagggttcacgccattctcctgcctcagcctcccgagtagctgggactgcaggcgcccgccatcacgccctgctaatttttttgtatttttttgtagagacgggttttcactgtgttagccaggatggtctcgatctcctgacctcatcatccgcccgcctcggcctcccaaagtgctgggactacaggcgtgagccaccgcacctggccaggacctggatctattttagattagttttcgtatgtgttgtaaggtaaaagtccaacttcattcttttgcgtttggatattcatttttttgcagcatcatttattccaaagatgaaccttacccaattgaacgggctttgcaccattgttgacaatcaattgactatatacgtgaaggtttatttctgggctgtatt

SEQ ID NO: 43 - DNA, 1919 bp, Homo sapiens
gcagaaacaggacggagaagggggctgtatttcccctggcgtgtgaaatggatgttagtgactaaagctcaattttccagttaagggaggagccgagacttttaagtcgagtgttcctgtggggccaaaaggatggtttcagagaaatcccaggaagtgagagtgctgggatatgcgaggggcccacggagccctcccctgcgtgtctgagatcacaccctgcgggtaccctgccgtcgtgtgctgaaggaggtgactggatctcgactccagagtttgctcctgagatcgaaaaacaaaacaacccaataatagtaatgacagccctgggtggggacagttgcagcaggtctcatgagaaactcactaattttgtaggttcagggaaggcgtgggcatgttggggaaatcaagggagaggagaagaggggaggagggaaggtgaggtgaggtgattggtattctgccaatcccattctgcacactagtgagacctagcaaggactagagtttcagggggaaaatacgagaataatgaaagataacagagaggaaagaaaaaagaaataattgaaaagtttgaaagaagaaagacaacagctgaaccaatggaggtgaaaatagaaggaaatgaaaattctgcaagcttttgtttcatggataaaaggactgtattttctggtccattatcaggatacaagatggaaaaaaaagctattgaacttgtggagaaagtggctggtttaaattagtcctgtccctgaaaatccaagctgcgtgtttgtcagtcttatggctgatttaactcataggcccaggagagaaaggatagaaggaagcctgaatgaccagcaaagaatctgcatccaatcaacactcagagcatgtatgctacattcttcagaaaccttcaggagtcatagactgtggtcagttcttcgtcagaattattttagatttacttcagttgttttttcatcaaatgcacataaaacatggaattgttcttagctgtgcagaccttgtctattttctgaaaggaaaaacaatgttaatttttaaagccctacatacattacatctttgtacttttcaaatcattgtgtcacccccttcccttctcttttgaaggtgcctggctgaatctctcctattctcacaatggctttgcctccattctgctgaagtcgcttcccattgctcacattattatactgtttttacttcacttccaagcttgtttctgactacacaaagggtgctgtaattctgagttccctatatatagagttgcttttccaggaacattattaataaaaggaaaggtcttccttttccattatggagatatacccatgttacgttgtgctttgatgatctgggctctgacttataaaaccagtgttactataattttcacatctttgagcagctctgcccagtcagttccccataggtccctcgggagtttttcttgttttatttttgaatcttagctggaatctatcttcattaggagtctagcgtcttgttctccgtagagctctgaaatggtataacagagaaaggggtactagaaacagcaggctgactctctttaattttctttttctttttttttttttttttttgagacggagtctcgctggtcgcccaggctggaatgcagtggcgcaatctcggctcactgcaagctccgcctcccaggttcacgccattctcctgcctcgccctcccgagtagctgggactacaggcgcccgccaccacgcccggctaactttttgtatttttagtagagacggggtttcaccgtgttagccaggatggtctcgatctccagacctcatgatccgcccgcctcggcctctcaaagtgctgggattacaggcgtgagccaccgcgaccggccgactctct

SEQ ID NO: 44 - DNA, 4860 bp, Homo sapiens
gccatttcttttttttctttttttttttaagataagagtctttctcttgtcacccaggctggagtgcaatggtgcgattttggctcactgcaaccttcaccttctgggttcaagcaattctcctgcctcagcctcccgagtagctgggattacaggtgcccgccaccatacccagctaatttttgtatttttagtagagatgggatttcaccatgttggccaggctcctctggagctcctgacctcaggcaatctgcctgcctcagcctcccaaaattcaaggagtacagatgtgaacaaccacgcccggcctccatttcttttttgtagtctttaataaacagctgctatcattgcagacttgctgtttaggcacttaggaatttttcactagaaggcatgtaaataaagaccatgggcaattgtaatgaatttcgccttcattctttgactacatgactgtccccagagctgtaactttattgaattttttagaagccatttagctagcaactgagcctaaccagccactcactgtcattattcagtgctcttttattattgtctatttctcctccaacttggctacactcacaaagtgataaaaacttgcatttgttttctttccttttcagagacagcgtcttgctctgttgcttaggctacagtacagtgacatgatcatggttcactgtagcctcaaactcctgggctcaagtggttctctcacttcagtctcccaagtagctgggactacagacatgtgccaccatgtccagctaattttttatcatagagacgggatcttgccatgttgctccgactgggctcaaaactcctgacctcaagtgatcctcctgcctcagcctcccaaagtgctgggattacaggcaggcatgaccacctgtgcccagccccctattattattattttaaataatagctttattaaaatattcacataccattcactttatttattgaaatctgcaattcagtaggttttagaatattcacagagctgtgcatcgatcaccacagtcacttttagaacctttcattaccctatagagaaatccataccccttagccactacctcctactctccccacctacctttgcccccagccttaggcaaccattgattaatttttttgtcactatagatttgcctaatctggacaaatagaattgtacaatatgtgatcttttgtggctttttttccctcttagcacagtgttttcaaagttcctttatgtcatagtgtgtatcaatatttcattccttctatggcagtattccatggtagagacacactgcattttgtttatctgttcatcagttggtggatatttgggttgtttccatgtattccatgtattggtcattatgaataatgctgctatgaagattgttgtacaagtttttgtgtggacatatatttttatttttctgggatatatgcctaggagtgaaattgttgcattataggatgactgtacatttagccttttgagaaactgccagaatgttttctaacgtggctataccagttgggtgcaatggctcacacctgtaatcccagctactcaggaggctcagctaggaggatggcttgagcccgtgaattcaagaccagcctgggcaagatagtgaaaccccgtcttgattttttaaaaatccaattaaaatgacaagaaaagaaatacccaaacaaaatggttacacaattttatgttcccaccagtaatgtttgtgggttccaattcctccacatcttcactgacattttttttttctagataggggcttgctctgtctctcaggccgcagtgcaatgatgccatcacagttcactgcagccgtgacctcccaggcacaagtgattctctcatctcagcctcctgggtagctgaaaattacaggtgtacgccaccatgcctggctaatttttagatttttctgtagtggtgggattttaccatgttgcccaggctggtctcatactcctggcctcaagtgatctgcccacctcagcctccctaagttctggaattacaggctgccaccatgcccggccttcaccaacatttgccattatctgttttttttttcttcctttataccttaaagcagtataagaacaagtgtcttcaattataggaaacagtataatcccagggctttgggaggctaagacaggaagatgtcttgatgccaggagttttttttgttgttgttgtttttgtttttgttgttgttgttgttgttgacagtctcgctctgtcacccagggtggagtgcagtgatggggtccactgcaacctccacctcccaggttcaagtgattctcctgcctcagcctcccgagtaggtgagactacaggcacacgccactactgcccagctgatttttgtatttttgatagagtcagagtttcaccgtgttggccaggctggtctcgaactccagacttcaggtgatttgcctgccttagcttcccaaagtgctgcgattacaagcatgagccaccatgcccagcctgatgccaggagttttagactagcctgggcaacctagcaagaccttgtctctacagaatatttaaaaattagccaaatgtggtggtgcctgtgtatagtctctctccctctctcttttttttttctaactttttgtgacatggtctggctctgtcacccaggctgaagtgcagtggtgtgatcatggctcactgcagcctgaaactcctgggatcaagtgatcaatcctcccacctcatcctaccaagtagtagggaccacaggtgtgtgccacccaggtcttgctatgttgtccaggctggtcttgagctcctggcctcaagcaatcctctcaccttggccccccacagtgcaaggattacaggtatgagccaccatgcctggcccctaccctgcctactgagaaccaaaggaaggatccaaattctccttagctcaactcgagccatttcctgattgcttcatcagcgaggagctggttattgggctgtccaggcctcccaagcagcacagaaatgaggtgaaggagttttcctgttgctccactctgtaaggagttggagggtgatgtttactcgtttgcagagagagatgccttgtaggcacctcaggatggagagggccctgattccaatgtcctttttttcttcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaaggtgacattgaagccaagtcctgaaagatgaggaagagttgtatgagagtggggagggaagggggaggtggagggatggggaatgggccgggatgggatagcgcaaactgtccgggaagggaaaccagcactgtacagacctgaacaacgaagatggcatattctgttcagggaatggtgaattaagtgtggcaggaatgctttgtagacacagtaatttgcttgtatggaattttgcctgagagacctcattgcagtttctgattttttgatgtcttcatccatcactgtccttgtcaaatagtttggaacaggtataatgatcacaataaccccaagcataatatttcgttaattctcacagaatcacatgtaggtgccacagttatccccattttatgaatggagtgatgaaaaccttaggaataatgaatgatttgcgcaggctcacctggatattaagactgagtcaaatgttgggtctggtctgactttaatgtttgctttgttcatgagcaccacatattgcctctcctatgcagttaagcaggtaggtgacagaaaagcccatgtttgtctctactcacacacttccgactgaatgtacgtatggagtttctacaccagattcttcagtgctctggatattaactgggtatcccatgactttattctgacactacctggagttagcacagaccccacaagttaggggctcagtcccacgaggccatcctcacttcagatgacaatggcaagtcctaagttgtcaccatacttttgaccaacctgttaccaatcgggggttcccgtaactgtcttcttgggtttaataatttgctagaacagtttacggaactcagaaaaacagtttattttctttttttctgagagagagggtcttattttgttgcccaggctggtgtgcaatggtgcagtcatagctcattgcagccttgattgtctgggttccagtggttctcccacctcagcctccctagtagctgagactacatgcctgcaccaccacatctggctagtttcttttattttttgtatagatggggtcttgttgtgttggccaggctggccacaaattcctggtctcaagtgatcctcccacctcagcctctgaaagtgctgggattacagatgtgagccaccacatctggccagttcatttcctattactggttcattgtgaaggatacatctcagaaacagtcaatgaaagagacgtgcatgctggatgcagtggctcatgcctgtaatctcagcactttgggaggccaaggtgggaggatcgcttaaactcaggagtttgagaccagcctgggcaacatggtgaaaacctgtctctataaaaaa

SEQ ID NO: 45 - DNA, 4706 bp, Homo sapiens
ggtttgaataagggttgctggacgctgttttcctattgacaaatccttctgttctgcaggtacacaggggtgggatggctggaggatggggaagggagaggatccaaaggcactaagaactgtcttggcctttctacaataaatttcccagcatgacacagaagcacagttacacacttgcacacacaccactgagcctcccaagtgttgaaatactacatccaggcatatattaaactaacaaatttaaaaagaaactaccatgtccagcaatactctaatcatccaaagtagtaatagtaaaggtaactgatgctaatgtctattaatgccccaaaacatttaaaaactcaagaagaaaaagaaatctaccctgataaatatgaatatatgtttttaatttatgcttttctttatttttaatttatgcttttcttgaaaaattattgtcttccaatgattaattcttttgagtcagggtgatgtatggttttgccctgaaactttctttctaaaagaaatccctagtctcagtttgctttctaaacaaatgacaggagaaaccataggaaaatgtaattcaaaatcaaaaaggctcataagtttcactttctgaaaaagttgccagcacctggatatataaaattatactatttctacaaacacaatccttgaattggaagctggcccagatttctacttccccagattcctacattccctgtgcaaccctcttcaatcctgggcttggtgtctttttggcttttcaccagtattcaaaacgttcccctagttcaggctctgcagccagctgtccaggaggctccctgatggttgcattaacatcctggggcaatactgccgtcgtgtgggcatgtaaaatgctgcaggttcatcccaaagtgaagttgcattttcccaactacaggcacaaatgagtcttctctctgctctttcacttctaggttaatgggactcctgggtgactgaagatgtcaagagggttttgggtagacaatttgtagtgcctgtttgtcctgtctctgagatcttgaataaactttgggaacctattgggtgagagttgttggaaatgtaaatttacaagatgcattcttaatatatcagacctaattaaaaattttgccaataaaacaatgtggcaaccctgtaccatgtgtgatggcatgcttgtgacttgatttatccttgtaaaaatgactttactggatatgtggtcaccagacctaatggcctctgtgatttaattttttaaatatgggaaatatctttgctgccgaaactcactaacatctttttgaactttacgggaattgatgtttccagctgaaagatggatttagagtttgggacagaaaacacagtgatgctaaaaaccaaaagttatttggaaaaaacatttgaatcagcaccgaaatgatgtagtttagcaaaaacattaacaataaaacattacctttcttgtcataagactattttcttttttacaaacagcttataaactttctctgtgatgaaccttcgtatacagttcagctgaagactataagcctgttagagtcccttgggaagaagaaacctatgcatctaggttgttcctaaaaaagctgttgttcaactaagacatgctgtccttacagtgctgtcaccgccagaaataatctttaattctgtcttcttggtgtgaattctcaactagtaaaactctatattgaaatgcaaattagctcttccgagtacaagcttgtaaaaatgtcaaaacacctcacaaaaattctaattgccacataattaggtatctaaacaaaagttctatgctgatattttaattttgcttcattgcaataatgtacattcaataatgggcccaactaggacaaggtgataagttagggaagaaagtagctaatagcaccaaataaggatgcccctgaacccagagcctggcagaaaatagaatggacttccagagaaacatcatggggcctagggaaataaacaccgcttagggagaattagattagccagagtacaacaaacttccattacaagctggaatttcttttagaaggaatacatgaaagtgtgtctttataaagaggtggtatcctggagtgagcactaaatcagtctaatgccttcaatcttcttgatttccccctacagaactgtacttcttattaatgtttgtaatgaccacctgtggcactgtaggatgctgaattaccaaagaaagattaaattatgtcctattgatgacacttaatagacgtctagcaggtgcacatgttacagaatgatatttgacaaatgtagaaatgataagggttatctgatctgtctgaaattaatcagaagcttcagttaagtagaactccagttctgataacattccattattattatcatcattattattgttactattaagaattatagccccttttcaactcatcactacctttattgtggaatcacctgtgttcaatgtacctatattttagaaggacaacggggcaccaaagttgctagcctgatcctataattgccatcttcatctttcagtatggaatatattatatttacattaaaaattatcccttacaagatccctttgaacaatttttcaaatatatgtttaaagacaagtacattaatttcaagaaaatttcttatgagattagaggatgtaatgttagtatgatctactaataacctagtaactatcatttattgattacctacaaagtcacttgtgttttatattcattatctctaatttttaaggtacccctgcaaggttggcagtattatcttcactgtccagaagaagaaatagtttcaagaggctaagtaatcacagtaagatcatatggtcaataagtgcaaaaacaagactcaagcctcactgggttttaatggaagaaccatgtggtgtttgagtagaaaaatctattccctctcctctctctctccctctctctctctcttttcccagtgataaacagtaggaagtgggattagtctgtgttgaaccctattacttcagcccacattcattgctcatctttccactatttttagtttttccttctgttctggactcttcctttcttccttcaaatagaaaaaggtcacacctctatttaaaacatcacagaacacccatatttttgctcttctatcaacttaccagtctaaatcttttttattttcagctaaacttattagatgaatgtcataattgccccattttcactttgctttcactctcatggccaccactggaatgaagctgttcttcagacttacttatgacatctgctccagtttcaaaggctgtctccaagtcctgactttctgaaattctctgcagcatctgacacaattaatctcatccaccctcacctactgccagtaaaaatactggcagctgacacacatggaacagcgacttggtgctaggctctgggttaagcactttatatgcattatctcatttaatccccacaacatccctgtgaggttggcactgttatgggtccccattttacagatgaggaaactgagtctcggggggtaaagtaacttgaccagtattacacaagcaaaaacatggtgaagatagctgttgatccaatatgctgtgctatctttaaaattatttagccagtcttttactatctgctgggcacaaagccaagttcattagaggtattatctgattattttgtgttatattttctcctattatacctaactctaggtctattgcaagatcaagtttgtgatcctctgcctatttctcctcttgactacttcaaattccaagtattttttagaagattttaacttgcatcaaataattattgatgtacaggtcatggtggcagggctctggacataggaaagtgaacaaggtaggcttgctgcctgcttgaagttgacaacatagtggatagaaagtgagacagagaagccacaaatcattacctgagccaatcagtggcccactgagaacactccttccaggtcatgaaatttcaagtgaagtggcacaccagctcacccacctacttcccaccccgaccccagaatccccttcctggaaaccttgtgctacctccaaagccaaactctcaaataaaccccagcaccttccagagatgccgtttcagtggtggggtttgaggtgagtactctgggacccagcctgggtttcacagaactaggagactatctgccctgggctggccccaaggccagtgtcagaagtacccccaccctcctgattatcagtcaacccagaacaaacgctttcctctactttcccttaattgtacttggtgctagtcatctctgtggcaagaatatgagcttctcacaagctaataatgaaacatatctttggttctttcacagcacccagctttgggctaagtatgtaaatgtgggcgtcagatacacctgcttgagtaaatgtctcctctcaatacctggaagaatgatgagtgtttgctcttctacaaaccaactcaaggcacccagaaagcaaggaagcttccaaagaaaaatggagttatattaaaaggatgtaggcattatcttgaagggttttctactggtcaaagttgggataatttaagcatcaaataaatgatagctgtaaattgaatatataagaa

SEQ ID NO: 46 - DNA, 4158 bp, Homo sapiens
aaaagctttattgctcacacaaagcctgtttggtggtctcttcacacagacgcgcatgaaatttggtgccgtgacttggatcgggggacctcccttgggagctcaatcccctgtcctcctgttctttgctcggtgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcactctcccttctcttaatttcaattcctttcattttctgggagagacaaaggagacatgttttatccgtggaccgaaaactccggcgccggtcacggactgggaaggcagccttcccttggtgtttaatcaatgcagggacgcctctctgattattcacccacatttcaaaggtgtcagaccacgcagggacgcctgccttggtccttcacccttcttccaaacgcctgaaccgcagcggccaggcgttcctccagaacctcctcccacaggagcttgctacatgtgccggaaatctggccactgggccaaggaatgcccgaagcccgggattcctcctaagctgcgtcccatctgtgtgggaccccactgaaaatcggactgttcaactcacctggcagccactcccagagcccctggaactctggcccaaggctctctgactccttcccagatcctctcggcttagcggctgaagactgacaccgcccgatcgcctcgaaagccccctagaccatcacggacgccgagcttcagagcactgctgatggctaacatttttaggttgcaagtgttctggccttgaagatatggtaactggttgggaacacaaagttgtcacctaggcaaaggatgagagtggatgtcaagaagcaaggctatgctggatcctttctgctgttctaccagatccatcctccaccgtcatctatcattgtctgtgtggatcttgatcaacggactttgcctctggctcctgattgggtttgcccaatgggaagcagaagagagtgaagttgtggctccttcttttcacagagctgcaggtttcttgaacttttcatcttgcaaaactgactctatacccactggtcaagtgatcttcaacaagggcactgagactataaagtggggaaagaatattttcttcaacaaatggtattgagaaaactgaatatctatgtacaaaagaatgaagttggactcttacattataccatattttaaaatgaagtcaaaatgggattaaagatctgaaactttaaaactcctaaaataatagggaagaatctttacaaagctgaatttggcaatgatttattggctatgacaccaaaagcacaagcaatgaaagcaaaaatagacaaatggaactacatcaaactaaaaagcttctgcacagcaaagaaagcaatcaacagagtgaaaagacaatttatggaataggataaaatatttgcaaatcatatatctgggaaggagtcaatatcaagaatatatgaagaacacctgtaacttaacaacaaaaataacccaacttaaaaaattggcaaaggacttatatacatatttctccatagaagatatacaaatgcccaaaaagcatatgaaaaggtgttcaacatcactaattatttagaaaacgcatgtcaaagccacagtgagatatcactttatacctattagcatggctgctatttaaaaaacaaaaacaacaacaaaaacaaacaaaaaaaaaacaaaaacagaaaataacaagggctggcaagaatgtggagaaattggaacccctgtgcactgttagtggtgatgcaaaatggttcaatccccatgaaaatatatctctggactctattctggtccactggtctgtatgtctgtctttacatcaataccatactgttttgattgcagtagctttggaatatgttttgtaatcaggaagtgtgaggattctggttttctcatttctcttaggattgttttgactatatggcttcttttgagatttcatatgaatttgagaattttttatttttaaaaattccattgaaatttcatagggatggcatcgaatctgtagattactttacatagtttgcatattttaataatattaagtcttgcaatctgtgaaaataggatgttttttcattgatttgtgtcttctttaatttctttcagcaatgtggtgtagtttttagtgtataagtctttcacctctttgcataagtttattcctaagtattatatatttttgatgctataataaatgaatttttttcttaattatcttttaaggttgttcattgttaatgtatagaaatgcaactgatttttgtgtgttgattttgtatcttgcaactttgctgaattcatttattagcttaaacagctttttttgtggagttcttacaggtctctacaaatatggtcagaggcgttcgaactagagtgactccatcttgaatagggggtgggtaaaataagactgagacctactgggctgtgttcccaggagattaagcattcttagtcacaggatgagaaaggaggtcagcacaagatacaagttacaaagaccttgctgataaaacaggatgaggtaaagaagctggccaaaactcaccaaaaccaagatgatgatgaacgtgacctctaaacgtcctcactgctcattatatgccaattataatgtattagcatattaaaaggcactcccaccagcgccatgacagttcacaaatgccatggcaatgactggaagttaccctctatagtttaaaaacaggagggaccctcagttctgagaaatctctgtccctttcccagaaaactcacgaataatccaccccttgtttagcataaaatcaagaaataactataaatatatccagttgagcaacccatactgctgctctgcctatggagtagccattcttttgtttctttaggtttttaataaacttactttcactttactctttgaactcgccccaaattctttcttgtgcaaggtccaagaaccctttcctgggttctggatcaggatccttttccagtaacaatgtcatctgcgaacagataattttatttcttccttttcaatttagataccttgtatttctttttctttcctaattgtttttgcctaattgctaggactgccagtactatgttgaatagaagtggagagagtggacattcttgccttgttcctgatctcttatatgaaaagctttcagtctttcattattgagtatgatgctagctgtgggcttttcatatatggcctttattttgttgaggtaaagtatctctatttctagtttgttgagtgtttttataataaaaaggcattaaaattttgtcaaatgctttttgtgtcaattgagatgattatgtaatttttatcctttcttctgttaatgtggtttattacactgattggtttttatatgttgaataacccttgcctcttagagataaaacccacttagtcatggtgtgtaatccttttaaggtacatttgaactctgctagaattttattcagaatttttgcattaatatttatcatggatattgaacctcatagtattcttttctcatagcagattgatctggctttgctatcaggttaattttgggctcagagaataagattgggttttgcctcctctttaattttctggaagagcttgagaaggattggtgttaacctttctttaaatatttggtagaattttccaatgaaaccatctggtccttgtcttttcttttctgggaggtttttgattactgattcagtctccttactggttataggtttgttcagactttttatttcatgattaaatcttggtagatggcatttttctagtaatttatccatttttttctaggatatccacttggtataaaataaaatatttcctgtcatatgcaaaacaactttcatttcattcttgagtggtgcttacttctgatcacaattgtgtataacagagatgtccaatcttttagcttccctgggccacactgaaagaagagttgtcttgggccacacataaaacacactaacactaatgatagctg

SEQ ID NO: 47 - DNA, 1003 bp, Homo sapiens
cacatttatgtgtttaacatagacacatttatgtgtttaacatagacacatttatgtgtttacaatacatatgcagactctatataaacacataaatgtgtgtaatattcatactgtcaccttttcttactcttgcaaaggtgatgtaattcaagtttgacttccttgaaacaattctcgggatatgtctagttatattagaagtttagttgtgtcaaatattgttctaaaagagactaaaagcataggtgagaaatattcctggatgtagtgggaagtttttttaatttttattttttaatgagaattactaaagcagcaaaacacagcacaatatagtagaaagcactgtagatttccaatttgcatatattactgcagagtggattttgctacagacccactgtgtgatcttaattaattcatttcccatctctgatccttagttttcacatctgtaaaacaagaataaatgtctcccctacctcaaggcaggttgaaatagtatatgctaaagcccattaaaactttagaacactatatagatttaaggtggttgctgttattttatacagctgcaaatcactgtaagggtcatatttattcaagctaataataagaactccagactttgtacataaaatgctgtgtgtttgagtttactggactgaaactcatttgtttaaaatttagtttgaaaaataataaagaccagaataacaaaaatcttgtgggccctacattctttttcttactttccaatatggctttatccatttgtttcctcccagccaactaattgccattttataaaagtaatcttccctcacatttatgtaatccaattatagaacccattagaaattataaagtggaggccaggcctgataacaataactgtaatcccaatactttaggaggccaaggtggaaagaccacttgaggccaggagttcaagaccaacaggatgtctacaaaaataaaaaataaatgtggtaaaaca

SEQ ID NO: 48 - DNA, 3803 bp, Homo sapiens
gccttcagccagaatgctggctttatttttgcggtttatgagcttgagacagggaattcatttccttggtataatatgaccctctggagaaagtcttgtccagatatattttgctcccaaacgccgccctagaagaaggactacactgaaatgaaacggagatgattaaagtctgatttataggctgtacaagccctgaaagcaagaacggggttcacggcatcttgatacccccatgtggggacgttttggcgattttatttacaagaaagggattttacaccggagaggcttttaaatatgctaacagactggaccagctttctcatccccactggctgattaatgattcctccatgccaacccggttctcagagacaccaaggccagctctccaaagacctgggaaaaaattacttcatgtccttgtaaaaacgttttcacaaatttaagtgcaccagctttgaagcaagacagaattgggatcaagtccctgttccacccttaccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggcccagtttcctcaacaatgaaatgggactaattatcccaggtcacacttctctctgggcttaccctgggaatcagatgattgagctttggatctcactctgttgcccaggctggaatgcagtgatacgatcatgactcactgcagcctcaaactcctgggttcaagtaaccctcccacctcagctttctgagtaactgggactacagaatgccccaccccacttagtccatagtgatgcccacctgtggttaatggagctgaggctgctggaccaaagggaggaagtctgttaggcatatgtggaacccaaaagaggaacttcatcaactgtcatggacagctctgccactttgtgaccctgtggactttttgggaagtgtttttgtggttcaccagtctctcattaggcaaggccatttgtcctgggttggtcttcttcattggtggaaagtacagctgggagatttggaatggttgcagattgacttgactctcataaggaactgccaccatgagcttttggggaaagacctcaagctgtggtgtgttgctgaggattgtgggattcctccaaatcttggggaacattttgagtcatcactggcagcagatttctgttgacaacttgagcaacttcagaatgaagaagccatcttcatctctcacatgaatatgactttgggtaaatcatctcgaaatctgaacccatggttgtgatccacactcctcctgagttctgatttttagtgtaacctttttcttctcattttttcttctttgtgcatctcttaaggaggtttttaaaatctcataattaaaaaatttatttcttcaaaactttttattttgaaatcactgtaaattcacatacatttgtataaaatgccacagaaaaatcctgtgtgccttttactcagtttattctaatgataacatccttaaagagatttaaaaattactgagatataattgaaatatgagaaaattcactcttttatgcatttaaatatcctttatgttttttcatagcttattagctcatttcttttcagtgctgaataattcttaattgtctggatataccatagcttatttatccattcacgtattgaaggatgttctagttgcttttaagttttggcaattatgaataaagctgctgtatacattcatgtttaggtttttgtgtagatataaattttcaagctctttgggtaaatattccaagagcacttgccgagttgaatggtaagaaactacccaactgtcttctaaagtagtataccgttttgcattcccaccaacaatgaatgggagttcctgtttctccacatttttgtcaatatttggtggtgcctgtgttttggtgccattctaataggtatgtagtggtatctcattgttttattattcatatatattcattgggtaaagtgcaattttgctgttgacatattgcactgtggtgaagtcagggccttcagtgcatcatttatcactagagcaaggcacattgtacccaccaagcaacctaccatcacccaccaaccttctatccttctgagtctccattgttcattatcccagactccacattctgctttgtgtgtacacattatttagtttcctcttataagtgagaacatgaggaacatgtctttttgtatatgggttgtttcatgtcagaaaatggcccccagttctatccatgtttctgcacaagatataatttcattctttttatggttgaatagtattccattgtgtatataccccacattttctttatccagtcctccattgatgaacacttagattgattccgtatctttgctattgtgagtaatgctgtgataaacatatgagtgcagatatctctttgatatagtgatttcttatcctttgggtagatactcagctgggtaggactgctggattgtatagtggttctatttttagttccttgagaaatcttcatactgttttccatagaggttgtcctagtttacattcccaccaacagtgtgtaagagttcccttttctccaaatcctctccaacatctgttatttttttatctttttagtaatagtcattctgattggtgtaagatgatatttcattgtggttttaatttacatttctctgataattagtaatgtgtaacttttttcatatacacgttggctatttgtttatcttgttttgaaaaatgtctattcatgtctttagcccactttttaatgggattattttttgttgttgagttgagttccttgtaaattctggatattagtcccctcttggacgtattgtttgcaaatattctctcccattccacagattgtttatcactctgtcgattatttcttttgctatgcagaagcttttaactttaagtcccatttgtctatttttgttttcgttgcttgtgcttttgaggtgttcttcacgaattcttgactagcccaatgtctacaagagttttccctatttttttctagcatttttatagtgtcaggtcttacattcaagtctttaatctattgtgagttgatttttgtatttggtgagtgataggggtccagtttcattcttccacatatggcaattcgatttttcccagcacaatttattgaaaaggatgttctttctccagtatatgttctggtcaattttgtcaaagatccgttggctgtaagtgtgtggttttatttctgcattctgtattttgttctattaatctatgtgttgatttttatataagtatcatgctgttttggtaactatagccttgtaatataatttgaagttaggcaatgtgataccttcagctttttttttccccccttaggattactttggctatttgggctcctttttggctccatatgaattcatttcttctaactctgaatcctgaattatttactctaattctgtgaaaattgacattggtactttttttagacctcctgtgtggacatgacattggcattttgatagggattgcactgaacttgtagattactttgggctgtgtggtcattttaagactattaatttggc

SEQ ID NO: 49 - DNA, 1000 bp, Homo sapiens
gaaaagtctcaagtagtcggcatatctgtttttggctctaactctctgccatccctgtggaacttttagcctacacactgcagttgttttgagaaaacaaaggcatcattctcttctcaaggttatggtagtgatttaaggccaacagacccaagactcatcttgtaatgcatagccaaacagtcatagttcataagcagtcacgtgactggtgacattttaaatctccagtctttgactttgtcattggttgacttttgtcttcaggaaatattctacatttcttggaatacaataaaaatgcccaagtcaatttggttgttgtcaaattattcagctttttcttaccacttactagtactccacctctttgctctagcatccagccaactagactacatagaatttcacagtgatcttcctcagctccagctcttggcatttgctcctcccttctatctgacatatgtttttgttgtccttctggtatcaacctgcatatctcatccaccaaaaagtctacaatattgacccaaaacctggatgtcctatctgtgtgttccagtagtgccctattttaaatgtgtcatgatatctattactttgtgtgaaaattacctgtttgttttttcaggttatataatagtataacactgccaaggagcggattatctcatcttcatcctgtaattccagtgtttgtcacgtggttgttgaataaatgaataaagaatgagaaaaccagaagctctgatacataatcataatgataattatttcaatgcacaactacgggtggtgctgaactagaatctatattttctgaaactggctcctctaggatctactaatgatttaaatctaaaagatgaagttagtaaagcatcagaaaaaaaagtgggtattcctacaagtcaggacattctacgtgactacaatataatctcacagaaatttaacattaatacattctaagatttaattcttagattcttggtaa

SEQ ID NO: 50 - DNA, 1768 bp, Homo sapiens
caaaacattgttatatatgggtataatgatttaatatttatgaattatagcaactcttcatcatctatttccaggtttctactttccaggtccactggtgtttggtgtacccatgtgactaatttgtccaaagagaggtgagtgaaagtgatgtgtcacttccagatggaagctttttgggcaagtatgtattttctagctcttttcttctgtgttatagaaactaggaatattccagttggtgactgaccccttagttgggttcctagagtgagtttgatgtggaggagcccaaaatgacctgcagtgaagttggagtgtgagcaagaaataaacttttgttttttaattttctgaggttttggaagttgtagattataactgcataacctatcaatattgatatgtttcaattcttaatgaaaatttctaatattctttttgattatttctaacttattaacttaaaatgtcaaatatctataatttcagtatattctgtatcctacatttaaaaataaaaaatagaatgttgaaaatgaaatcatttcaatgagatgacaactcaaaatcttatagtatcatccagaaacatgtagaacagatttaaaaatacacagtactgagattggcaggttgagaagaagacacatatgaagggtaacttctttggaaagaagcagctatgcacagtacttaagaatgaaatttccatgtcccgttaatacatctgaaacagttttactttctatcccaaactttaatgatcctagaaagctggtttgaatcagtttttacagggttgttttggatttaaaataactaaaacttgagagctgggagaaattttatttaacacttttttatcattcatggtttaatgtttaatgaataaattcttcactaagcttatgtggtgagggtctggtggtgaaaagtactttttcaactagatatattagaatgacaacagcaaagcaagaatgtggtagggtcacataaaggagtcgtgatctgtgggaaattattttttatgattctccaagatggctgtacatataagcataaaagtcaataaacaagtgcctaacctttagctctaaattaacttttgagcgctttgaatgcctggcacaaaaatatttaggggtttggcgccatctggtggccaaatatcaacttttcagcttctcttttatgactaagaagtgaattactctgcactttccaataaacactattaataaataaaattatttaaaatgttgatttccagaacttgagaagacaaatcaaagacagatttctgttatgttacctattgttatatgacagaatttcagtcttgagtaggttcttttatacttgcatttgatttatttatgaaagcattatagacataaatctgctatctttttcttaatacaagagaagactctttccccaaaagaaattagacgtgctcaataaaatctaaatttattttttcacaattctgtaaaagattgagctaggggtgcgtgtgtgtgtgtgaatatcagaatttattttaaaaatgcaagagggagaggggaaggagctggtagtgacattgttaattgtctgctttgcaatagcaaagacttggaaccaacccaaatgtccatcaatgatagactggattaagaaaatatggcacatatacaccatggaatactatacagccataaaaaaggatgagttcatgtcttttgtagggacatggatgaagccggaaaccatcattctg

SEQ ID NO: 51 - DNA, 3307 bp, Homo sapiens
tacatacatacagattccaaatttgcacttaactgctatattatgtatgtacttgttcatgacaccacttggaattcaggtagaggtattttcaatcagctccaacatccctttccttccttggatgtttccaagacaccatcaagccaggcacatttaggcagagaggttgctggggagaatagaacattgccaagctctggcgccaaatactgcactctggcaacgtgtaagtgtaaggcaggcattgtgggtgtgtgacctctgcaatcacacagggcctcatgctcaggagggccctgtgcttgattcaatactctgctggccccatcttgaaattcttaatgatttttgaacaaggggctccacatgtccatttatcagtgagcccctcaaattatatagccagttttgtgtgaggacaaagcaatggacagatactatgaagctcctttctgggtggcattttctctttcttttctccttcctttcagagctaccaagtcaccccacactctagctcaagagctctacctgaccaaaactcaatggcctttcctcaggaaatccagctatgctaatgccaccagaactgagtcagaactcctaactctacaaatatggctcctctgtattgagtgcctgctaggtgccaggcacaacactcaactgggaccaatattatttctgatctgggagatagataggtatgatcagccccatttcacagttgaggacattgaggctcagagagattcagtgacttgtccaaggtcacacagtgcatcaaacacaaatctgatgagccttctcaaaggctcttgatgccacctgcttccagaacattctgccactcactctgcctaggctgctgccctgcctgacttgagctcaggcagttctgccacttgggtcagatcggctacaagtcctggagtatgggcccttcctagccccatgcctatagtttctggctcctcttacctcttccagatttggatgaaaacactctccagcatggggtgggaactggtctcctgagaggctgccattaggactgggtgatacaatcctgaagtgcagaagagttaacccccactaggaaaactttgaccagtggaaaataggagttgagagggagcaggacacatacattccttcttcctctctccatggactgcttcatgacagtctgccttgccgctcatccagctgaatcccacgtgtcatgctgaaaggtcttgtgcagtgaccttctgggtgtctccatggctgtttgtgacataatagccatcaaggaaacacaccacttagtgtggctttgcatccttctttgcctcgcttccttgtgtctcacctttgctgccatggatttgcatcttccaaatgaaacatctcactttcaatttttgccccaggctctatcttctagagaagctagcctaacatacatataggaagggcagccttcccactcagcccagggtgtggtggaacttcatttaggctgcatgtgaaaattggccacctgctttgctgtaaatgtgatttgtggttctctactgtccaactgctgtaggaatggcccccacctgagagatgcaatggccattccagcttgctggccagtacaggccttccttcttctctctctccccactccatctgcatgacccgacccaccccacctcaaggcatggttaattgttcattagtgacacctggcccaagttgacccaatgaatctctccctctgttgggatttttaaactcaggactaagtgattccatctccgcttctttctacatactctctccaaaaccacatatgcagtgtctacagctctaagtaagaaatcctgggagtggtcagtggacatcctttctgttatgtgggtaatgtcaatctgcagcatgagagaagaattccaccaatatgcagagagaaacagaggcaggagctacagagaatgtcctaatggcagtctcaggcttggagtccttgacagattggaaactccagatttctatgacagtaggattgaagccttgaaagatcttaatgtcaccatcatgagcctaaaagagatctttgaaaaagatactacatggatcatatgtgtctttcacagagcagaaatttttaatttccagccattatattccttgacattcacctcaaagacttgaaaattatgtccatacaaaaacctgtacatggatatttattgcagctttatccacaattgccagaacttgtaagcaaccaagacatccttcagtaggtgactgtatccattgtggtacgttcaggctatggaatattgttcagcactaaaaggaaatgagctatcaagccatgaaaaacatggaggaaactcaacacatattactaagtgaaggaagacaatctgaaaaagctacaaattgtatgattccagccacatgacgctctggagaaggccaaactatggagaccgtaaaaagatcagtgtttcctgggagtaggaaggcgggagagatgaataagcagagcacagaggacttttagggcagtgaaactactgtgtatgataccataatggtggatacttatcattacacatttgcccaaacccatacaaggaacaacagcaagagtgaacctaatgtaaactatggactttgagtgattatgatgtgccagtgtaggttaatcaattataacaaatgtgctactttggtgacagatatcgataatggaggaggctgtgtatgtgtggggggcaaggggtatataggaaatctctgttaacttctgctccattttactgtaaatccaaaattgctctaaaaagaggtctattcaaaaaggcattatataactcaatttaatcaatttaatcaagaccatgtttacacagtactttgtgtccacacatcatgatcataagaccaaaatcatgttggaaactgaagaaagaaaattacctgacagtcttccaatccagaggcgaagtccaggtcccatctcctggaattctgataggttccatgcctacttcaactaacacaatgtggacactgccagtttccagagccaggacttatgaagctggcagtttgtattctccgctatttgaaatactgtctctgggagcaatggacttcaaactctgaagccaccatgctaatgtggctgcatgtaggtgttctagccaatagttacaactcatatgtaagttgctttgctggagggatggcttgaaagcctgcctgaatttctgacccacaaagttatatcataataaaatgatgttatcttaaa

SEQ ID NO: 52 - DNA, 3306 bp, Homo sapiens
tacatacatacagattccaaatttgcacttaactgctatattatgtatgtacttgttcatgacaccacttggaattcaggtagaggtattttcaatcagctccaacatccctttccttccttggatgtttccaagacaccatcaagccaggcacatttaggcagagaggttgctggggagaatagaacattgccaagctctggcgccaaatactgcactctggcaacgtgtaagtgtaaggcaggcattgtgggtgtgtgacctctgcaatcacacagggcctcatgctcaggagggccctgtgcttgattcaatactctgctggccccatcttgaaattcttaatgatttttgaacaaggggctccacatgtccatttatcagtgagcccctcaaattatatagccagttttgtgtgaggacaaagcaatggacagatactatgaagctcctttctgggtggcattttctctttcttttctccttcctttcagagctaccaagtcaccccacactctagctcaagagctctacctgaccaaaactcaatggcctttcctcaggaaatccagctatgctaatgccaccagaactgagtcagaactcctaactctacaaatatggctcctctgtattgagtgcctgctaggtgccaggcacaacactcaactgggaccaatattatttctgatctgggagatagataggtatgatcagccccatttcacagttgaggacattgaggctcagagagattcagtgacttgtccaaggtcacacagtgcatcaaacacaaatctgatgagccttctcaaaggctcttgatgccacctgcttccagaacattctgccactcactctgcctaggctgctgccctgcctgacttgagctcaggcagttctgccacttgggtcagatcggctacaagtcctggagtatgggcccttcctagccccatgcctatagtttctggctcctcttacctcttccagatttggatgaaaacactctccagcatggggtgggaactggtctcctgagaggctgccattaggactgggtgatacaatcctgaagtgcagaagagttaacccccactaggaaaactttgaccagtggaaaataggagttgagagggagcaggacacatacattccttcttcctctctccatggactgcttcatgacagtctgccttgccgctcatccagctgaatcccacgtgtcatgctgaaaggtcttgtgcagtgaccttctgggtgtctccatggctgtttgtgacataatagccatcaaggaaacacaccacttagtgtggctttgcatccttctttgcctcgcttccttgtgtctcacctttgctgccatggatttgcatcttccaaatgaaacatctcactttcaatttttgccccaggctctatcttctagagaagctagcctaacatacatataggaagggcagccttcccactcagcccagggtgtggtggaacttcatttaggctgcatgtgaaaattggccacctgctttgctgtaaatgtgatttgtggttctctactgtccaactgctgtaggaatggcccccacctgagagatgcaatggccattccagcttgctggccagtacaggccttccttcttctctctctccccactccatctgcatgacccgacccaccccacctcaaggcatggttaattgttcattagtgacacctggcccaagttgacccaatgaatctctccctctgttgggatttttaaactcaggactaagtgattccatctccgcttctttctacatactctctccaaaaccacatatgcagtgtctacagctctaagtaagaaatcctgggagtggtcagtggacatcctttctgttatgtgggtaatgtcaatctgcagcatgagagaagaattccaccaatatgcagagagaaacagaggcaggagctacagagaatgtcctaatggcagtctcaggcttggagtccttgacagattggaaactccagatttctatgacagtaggattgaagccttgaaagatcttaatgtcaccatcatgagcctaaaagagatctttgaaaaagatactacatggatcatatgtgtctttcacagagcagaaatttttaatttccagccattatattccttgacattcacctcaaagacttgaaaattatgtccatacaaaaacctgtacatggatatttattgcagctttatccacaattgccagaacttgtaagcaaccaagacatccttcagtaggtgactgtatccattgtggtacgttcaggctatggaatattgttcagcactaaaaggaaatgagctatcaagccatgaaaaacatggaggaaactcaacacatattactaagtgaaggaagacaatctgaaaaagctacaaattgtatgattccagccacatgacgctctggagaaggccaaactatggagaccgtaaaaagatcagtgtttcctgggagtaggaaggcgggagagatgaataagcagagcacagaggacttttagggcagtgaaactactgtgtatgataccataatggtggatacttatcattacacatttgcccaaacccatacaaggaacaacagcaagagtgaacctaatgtaaactatggactttgagtgattatgatgtgccagtgtaggttaatcaattataacaaatgtgctactttggtgacagatatcgataatggaggaggctgtgtatgtgtggggggcaaggggtatataggaaatctctgttaacttctgctccattttactgtaaatccaaaattgctctaaaaagaggtctattcaaaaaggcattatataactcaatttaatcaatttaatcaagaccatgtttacacagtactttgtgtccacacatcatgatcataagaccaaaatcatgttggaaactgaagaaagaaaattacctgacagtcttccaatccagaggcgaagtccaggtcccatctcctggaattctgataggttccatgcctacttcaactaacacaatgtggacactgccagtttccagagccaggacttatgaagctggcagtttgtattctccgctatttgaaatactgtctctgggagcaatggacttcaaactctgaagccaccatgctaatgtggctgcatgtaggtgttctagccaatagttacaactcatatgtaagttgctttgctggagggatggcttgaaagcctgcctgaatttctgacccacaaagttatatcataataaaatgatgttatcttaa

SEQ ID NO: 53 - DNA, 2534 bp, Homo sapiens
ttaaaaagaagtaaacatgttaatgaaacagaaaaaaagtaaattaatagaccaattcctggcaaagatgatgagaatgctaattcagtttaagagggagaaaataaatcatcatctctgggggcctacaattcagaaagacagtccagggcaggcgggcagactctgctccacgaagtcatccagagattgaaactagcaggtgctctgccattgtataaggcatcctttttttttggtctgcatggcagaaattaaatctctgaaacatttgtgttccagacaataggaggagaaagaaaggagggagcattacaaacaagatcttaagaccaatgttctggaagtgacatgtgtctcttctgctcatattccatcagtaagaacctgatttttggtgagaacacaggggactgagaaatgtaatatagctgggatgccatgtgcctggctggtagaagaaaggaaaaacatatttttgtggtctacttagcagtgtctctcacacctgctacagtggacctttataaattatgtaaaagtagtgtatatatggataaaactaaatatttcagtgacatgaagtgttctgagaaaatgtaaatgaaccaaattgaagaaaagagaagtagaaaatatgaaaagataataattctttccaacattgcctttgtctaaggcagttttactgctttactgctgtgtcttttaactttcaataagtagataaataccatattatagaaacttcttcagagcattataaaaaacaatttgccatcaattccttttgaaaaggtagaataatcctgatgctcaagcttgaaaaatataatacatcaaaggacattctagacccatctcattgagaatagagatgtaaaactcctacataaaatattaccaaatataattcagtagcctattaaatgcatcatgcatgatgatcaagcatgacttatctcagaaatacaatgaagatttaagaaaactatcaatatgtgattacttatatcatgcttcccaaaagaaacactaaataatactactccaaaaatgaaaaggcaaaaagcatattttcttattcctgatttctttgaaaattgttttttatagtactaggcaaaggatgattttttagtatgataaataatatgtcctcaaccaatagccaaaatattttactgtgctttacactaaagttgccaacataagatacctactatcattattttaagtgtttctcataaagtacctacagatggcttatgtcttagttcattctgtgctgctataacagaatatccgagactgggtagtttataaagaacataaatttatttattatagttctggaggcaggaaagtccaagattaaggcaccagcatctgggtctggtgagggctttcttgcagcatcctcacatggcagagggaaagctacaaaaaactccttccatcaagcaagcccttttataaggacgtgtaataccattctcaagggaggaaccctcaagacctactcacctcctaaagggcccgcctcttaatactatcacactggcaacacctgaattttggaggggacacattcgtaccatagcatcttaaaaagagtacagatggctaaataaggaaaatctataatcccctgctcagcctcttcctactcacccttccctttaatcccctttccagtttctaataatcatagcactattttaatttctctattattatcttcatatacttaaaatacttttcatacacatgaaattatttttcctattttaccaaatatagactgtcttgattcttcactgtataattaggcaaacagttctctagcattcttagtaaataaattgttattcagtgtgtagaatcttgataaatgctaattgtgtttagtaataaattgcatcctaattttatttttaaacaaatttgtatttaatgcctgttgctttgaaactttcatacagagtatatacaactttttttccctaccagagaccaacagtgataataactaaatttaaaaataagaaggtttttaacttttatttcaagtttttatttaacaggacaaaaatataaaataggagtatatttctctgttcttgaaattcagaaaatatggaattagaataaaatatttttaaaaatcagtcacataatagcatttcagagaaatggggaaatgggaaatgatgaaataaataacataaacatattgactcatgctttcttagagggtagaatgatataagttcaaaaagttccagagaagatgaccacacaaactgaacaaaatgtaagtacatagaacatgaagaaagatatcatggtaactctataagttcattttaatatttccttgagaaaacaaataattgttccatactttaattgatttgagaacaccaaatttaaaatattggatttataaaaagtcagtaaaattatatttgtattttgggaaaatgaaaaagaaataaaaaagttgtcactctccaaaaaaaaaaaaaaaa

SEQ ID NO: 54 - DNA, 1180 bp, Homo sapiens
catacagggaggaaatcatataacaatgataaatgtggaaaagctgctattaaaatgtcaagtctcattagacaccaaagaagacatgctggagagactgtccttcctatgcacataaggaaggtgggaaagccttcagtcgcaaatcacatctcacagagaatgagaaaaattcatccaggaaagaaagcccggaatggaatcaatgtggaagtgtcttagctagaagaaatacttcattaaagatcagaacattcacactgtaaataatgagaactctatgaatgtaagaaatgtggaacatcttcagccaaaaggaaaacttcattattcatcaataatccatataaaaaagaaatcttatgaatgtagtaggtatgaaaaagcttttattcggaagtcaaactttataccagagaggtcatactggagataaaccctacgcaagtagggaaggtgagaaagcactcagtggcaaatcaaattccactgggcatgagaaaatccagatttgaggccaggcgcggtggctcacgcctgtaatccctgcactttgagaggccaaagtgggtggatcacttgagcacaggagttcaagaccagcctgggcaacatggcgaaaccccgtctctactaaaaataaaatatataaaaactgaggtctctactaaaaataaaatataaaaacgatcacctgagcctggggaggcggagactgcagtgagccgtaatcacgccactgcactccagcctgggtgacagagtgacaccctgtcaaaaaataaaaagagaagaaaagaaaattcagatctgaggggtgccctgtaaagataatgaaagtgcaacgatcttcgggcagaagctattcatcattaaatattacaatattcatgacgagggcgacaccctatactaagggtgcagaagttttctctgtaatcatactgcttattgtacatgtaagaacccgtaagtatgaatgtaaaatgtgtggtaaagtcttctgtccattcttagccaatgctctacataagagaaccaataccaacgaaaaaaactaatgaaatatctcaaacagaagtcatgccatatttgacaccaaagaattcatactcattaaaaccttatgaataccttggatttaggaaaggctttagcaggaattcatatttcatagcac

SEQ ID NO: 55 - DNA, 2613 bp, Homo sapiens
tcctgtgcaggacagcttctatccccgtcacttaacaatggagaggattcttccccagcttccttccagaggacacaaaagctcagagctccacagtctagagtctagaccaacaggcctccacactcacgtcccagagatttccctggtcccacctactcccagtggcaaccagacttctgcacataggagagatgtcatactcagagtccagcctcccacatccacaggaccacctcttcctcctctgagtcttgttaatagggccatcccctgccttagacctggcccagtggactctgatcttacagccaatatggggcagcaaagtgggacatctgtctacagggccagtagccccaggtcatctgcttgccaaaaggagggggaccagcccccggggggagcccagagctcggcagggctggggttagtaagaagagaaaacagggttagtaggggctgggttagtaagtcagagcacagcaccagcggacagggcacctcagcagacacacacaggagtcgctaagagaaaaggaagaacgcacgcaggtccgttagtttgttaagggatgatcggggtgcagttgaggcaccccaggggttagacgggttagtaatcgaacaaaagagctgcctacagaaaagaaagctgagacggaggaagaatgtggggaagtgacatggattcaaagccaagtgtcttgccccaggcagaaggatctgtgtgcagaacacccagagaggccagggcctaggcagcagacgtgttcaaccaggtttgaggggccttcctccatcctcatactttttttttttttaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagttgagaaaaggccatgtgaggacatagtgagaaggtgccacctgcaagccaaggagagaggcctcaccagaaaccaagtcttaacaccttgatctggactttccagcctccagaactggcagaaaataaattcctgatgtttaagccatccagtctggcatggtgctgtggcagcccaagctgatgaatagtacacaccactccgcattctgggaaaaaggacatctggcttttaaacttgcctaagggaggccacaagctgctctcttgcaaacgctgggactgtctcctctggagggagctggaattgcagattgtggggcctgtcctgccaccttctgttccccaagaacagaatccaggagcagtgcaactagaagcagcgatctgattggagaagagtgtcctgagactgggctaaggtgaccccttaagcctttgggatggtgcactctcagcccctctggctgcccctcccagagttcaacagcacagggggaaggctccagctcctcccagatcctgactgtctcctctttgtaaccatcagggagaggaaaagcatggaaaagccccaccaaggaagtcccccacaaaatgacaattacgcactgagcaaatggagacaaaggactccagccagcggcacccgaggagctgcatctgccctctgcctgacagcccctccccgactcccatccttgttcctgtccccatcctgtagggtcctttgagacccagccttggggaaagtgtggtcagtggggacttggcccaggccaggctctgtctggtcaccggcagaaacgcgaggaggaatcaagttcacatggggcaggaaagggcccccagacccagacaatagggcccagcaggcagggcccgagcaggtgaggagggagtagtgggctgccaggcctccctcatacccctggagctgtcctccagagccagatcagtcatctgctgagcatcaaccaggaagagttcctatccatgggaggctccatcccaacaggtgtgaagaggatgagatcttcagggagtcacccagcgggctagaaaaccaccggagtctgaccgctaagtcactgtggccagaatccaaggtcacccgaggtccaaagagaagtccaggccaggagtcctggagatgcggcccagatggagccacctgggggagaagacagcgagtgaggatgaggccacagcctccatccccaacttcccacatccccccagcctaattctgcatctgaggggactcatgttcagagatccccccagtctctcatgcccccagcacacacacagggtggaagtgagggttttggacatgaaacatttttagaagaaacttaggccaggcacagtgactcccacctgtaatcccagcactttgggaggctgaggaaggaggatcacttgagcccaggagttcgagaccagcctgggcaacataatgagactctgtctctacaaaaaataagccaggcatggtagcatgcacctgtagtcccagctacccaggaggctgaggtgggaggatgtattgagccctggagttcaaggctgcagtgagccgtgatcataacactgtactctagcctgggcaacagagtgagaccctgtctctgag

SEQ ID NO: 56 - DNA, 3694 bp, Homo sapiens
gagattcatctcacagcccgggccagggggccggggccggggccggggccacggcggccgccgcccgcagacaaagaagccagtgcggcttggctgggctcggctcggcccgggagctggtcgggacccgccgccgcccccaggcccccagcctgggctgggcagagccgaagggggctccgcaggctaagccgggcggagaggggacggccgggaagcgggaaggggaagccgggtgggggggcggtcaggtatatatttttcttcgttcccccttccacgaccccccccttttccctcccccccttttttccctccttctgctacttggatttttttagctgctgcgtcatgagcataatttatgcaaagagctttgccgcatgctgcaccgcccgcgccagccgccgggggcggcgggctgggagggcggtcagggaagggaggggagcacgggagccaggagcgaggggtgggggtggggaggggaccctctggccctggccgagcgggaggtcccggaggctctctcccgggacagggatggacggtcagtgggtctggttactcagcccctccgaggtgccgcggaggtggtttcatttcggaaggtgccagagtaggagctggagtccggaccctccatgccacatggccttcagctgagggttggggcggtgactcccggccaccgcctttcctctaggtagtcaactgtcctcaatgttgaaagtcaagtttatgtctatccctccctccctagaaaggcgggggaactcagacatcgctcagccaacgtggagaacctctgaacagctgtgccccagcgccaaagcagcgaagggtcccaggtctctcacccggtggcggccgtgggctgtgttgtctaaaagcagatttccggccttcttgtccaagtagacaaggaaatgtgaacagaaagacaaagttcagtggaatggtgaaaaacctctagcagcttcttaaggtagagaggggaccagaaaaggggtggatgtgggtggctgagggaaagcagattggagaagtggtggacaactgaaagaggaaaaagttggaagaccaaagtggaagcgtgggaatggagagaagaactgggaaggaaggaggctctgtaaatccagtgaatgtggatcccaatactgaggccacctgctgtcatcctaggctgttccccctcccaccctctcccgatatttggtggtctgaggatagctagaggtagatgggttagaggcagtgtgagaatgcagttggaggcctcagtcctccccgggactgctccgtaaggcctcgtggtggaagggcattgaatggcccggcctcgtcgttaacctggccagtggactaggctgttatcagcttgctgtttccatctggaagtgagcaggtactgctggcggcggatttatgagtaaccaatgtattaggagtcagaatacttaggttttagtcccaactcttccactagccgtccaggcaagtaatttaacttcttcattacttataaaacaaggataatatttataatgacatttataatgactacttcatagggttaagtttgtgagcctgtatgtgaaaaaactgaaagctgcaagctctatacaactgtaaggtgtcattccttgtacaatagtttgaactcgttttaatggccctgtgaaactctactgcgtggcttgatattacagttcttggggtttttgtttggccggtagtccctgtagtttctctccctggactgtgaattctttgagagcactggttgtgacttactcatgtttgtatttcccactactctttatgtgaaggaggggctcagtattgctgctgaactttgtcacatgaaggttgaaacttttcatttatgtcacttggtttggtgctacacatagatcaaaggctttggatagcatggatatcagcgacagtttgaagaaagaaatatggatgtgatcagaggagttcagggagacatacataaaaatgttaatcacggttttctttatgttgtatacacttctgcattgcttaaatatttgatgagcatatattactttttgtttctgtgtttattggggcataacatgtacacagtatgtgtataccttgataaatttttacatgtatatacatatgtacgtgtatgtatgtgtgtatacatatgtacgtgtatgtatgtgtgtatacatatgtacgtgtatgtatgtgtgtgtatacatatgtacgtgtatgtgtgtgtatacatatgtacgtgtatgtgtgtatacatatgtacgtgtatatgtgtgtatacatatgtacgtgtatatgtgtgtatacatatgtacgtgtatatgtgtgtgtacatatgtacgtgtatgtgtgtgtatacatatgtacgtgtgtgtgtatacatatatacacgtgtatagatacgtgtatacatatatacatgtctatatatacatgtatatactcacacacatatatatatccatgtaatccccacccaaaacaagatatagagcctttccaagacctgaggattcccttatgtaccttcaccggccataaattcccaaagtaaccattattctgatttctgtcaccatagattgattacttgagctgattcttgaacttctcataaatggaatcagacaatatgcaatcttttgtgtttggcttctgtcactcaacaaaatttttttttttgagacggagtcttgctctgtcgcccaggctggagtgcagtggtgtgatctcggctcactgcaacctccgcctctcgggttcaagtggttctcctgcctcagcctcccaagtagctgggactgcaggtgcgtgccatcacgcccagctaattttttttttcttttttttttcgagatggagtctcgctctgtcgcccaggctggagtgcaatggtgtgatctcagctcactgcaacctccacctcctaggttcgagtgattctcctgcctcagcctcctgagtagctgggattacaagcacacgccaccatgcccggctaatttttgtatttttagtagagatggggtttcaccatgttggtcaggctggtcttgaactcctgacctcatgatccgcccacctcagcctcctaaagtgctgggattacaggcatgagccaccacgctcccagctaattttttatacttttggtagacacagggtttcaccatgttggccaggctggtctcgaactcctgacctcaagtcatccgccctcctcggcctcccaaagtgctgggattacaggtgtcggccaccacacccggcctcaatatatgtttttgagattcatccatgttgttgaatgtagaagtattttttattgctgtgtagtattccattgcataattatactacaatttatccattccattattgatgggcatttgcttgttgtttgggcctcttaggaataaaactgctatgagcattcttgtacaagtattttggtgaacatatgcacttatttcttccaggtaaatactgaggagtagaatagctattctattttatttagcttttgtccatactgctaaatagttttctatagtgtttgaaccaatttatatctttatcagcaatgcatgagagagttctaattgttttacatcctcaccagtatgtggtattggtagtcttcttgcaatgaaag

SEQ ID NO: 57 - DNA, 858 bp, Homo sapiens
ctccgcaacctggtggtgtccatctgcatcatgttcatcaacaaaaggatccctaacatgaacctgaccctggggcatcttgtggtcacctggctgcgcttgcacatctgtcagaaattggttatatttgcctcaacatgtctgccaccccaagatcctccttctggcctttagcttctgtgattacaaggtcttcaccaacttctctctgcagggcaactccacaggcgtccatcagctgatcaaggtcatcattacactggtgattatggccatgcagaccctctgctaccagaaggccttcttcaccagaatataacacaacactgattcctgtaactttaggtgtaatcctaaattcttattacaatgtgaaatgtaatgtccttggaaggatgttttctgctctcagtgttttagttatacccccttatccagtgtgggcagaaaccaagcagaatgagtttcaagtaaactcaatgctgctgcagcactatcaagcaccaataccttctgctgttattggttgcttctctgagtcagtgcatggagagcaagaaatatctagtctctggtcagcttctgctttgcctatggtgcagctatctgaaataatggttgtcatggtgaacttatcaattcactgggtcactaggtacacttcatcagtcacctatgacatgtttgggcacttcaagttctgacttgctttatttggaggacatgtgttatttaaagatccactgttaattaaccagagtcttggcattttatgtagttatttggtgtaagaataagagcttatattcattctgtactctataaacaggaaggaagaaaatgtaaattgctacaaag

SEQ ID NO: 58 - DNA, 3360 bp, Homo sapiens
tgatactgaagagtagggcattgctataaagatacctgaaaatgtgaaatcagctttggaactgggtaacaggcagaggtttgaacaatttggtgggctcagaagaagacaggaagatgagggaaaatttggaaattctcagagacttgttaaactgttatgaccaaaatgctgttaatgatatggacaatgaggtccagggtaatgagatctcagatgaaagtgaggaacttattgggaactggagcaaaggttacttttgttatgtgttagcaaagaacctggtggcattgtacccctgccctaggaatctatggaactttgaacttgagagtgatgatttggggtatctggcagaagaaatttctaagcaccaatgtgttgaagatgtggcctggctgcttctaacaacctatgctaataatgtatgagcaaagaaaggacataaaactagaacttacgtttaaaggggaagcaaaacataaacgtttgaaaaatttgcaaactagtcatgtggtagagaagaaaagcccattttccggggagcagttcagactggctgcagaaatttgtatagctaaaaggaaggcacatgctgatagccatgacaatgggggaaatgcctccaaggcatttcagagatctttgtggcagcccctcccatcacaggcctggaggcctgggaggacagaatggttttgtgggcctcacttagagcctgactaccctgtgcaggcttgggacactgctccctgcatcccagccattctcgctccagctgtggctcaaaggggcccaggtacagcttgggccactgcttcagaaggtgcaaaccataagccttggtggtttccacatgctgttaagcctgtgggtatgcagagtgcaagagttgaggcttgggaacctccacctggatttcagaggatgtgtggaaaagcctggatgtccagacagtagcctgctgaaggggcagagccctcatggagaacccctaccagggcattgcagaggggaaacgtgggactgtagctcccacacagagtctccactggagtgttgcctagtgaagctgtgagaagagggccaccttcctcaagactctggaatggtagatacactaacagcttgcacctgttgcctggaagagctacaagcactcaacatcagcctttgagagcagctctgggagctgaaccctgcaaagctgtaggggtggaactgcccaagatcttgggagcccatccgttgaatcagtgtgccctggatgtgagacatggagtcaaaggagattgttttggatctttaagatttcaggactgccctactgagtttcagacttgcatggggcctctagcccaattgttttggccaatttctcccttttggaatgggagtatttacccaatgcctatacctccattgtatcttggaagtaactaacttgttttttattttataggctcatagatggaaggggctagctttgtctcagatgagactttggactttagactttcgagttaacgttggaatgagttaagactttggggggctgttgggaaggcatgattggattttgcagtgtgagaaggacatgagatttgggaggggccaagagtggaatgataggattcggatctgtgtccccacccaaatcttatgtcaaaatgtagcactaatgtgggaggtggggcatgggaggtgattggatcatggaggcagtttttcataaatgatttagcactgtccccatgcagtggttctcatgatagtgagtgagttctcatgagatggggttgttttaaagtgtgtagcacctcccccctttctctcttcctcctgctccagccatgagaagatgcctgctctgactttgccttccactgtgaataaaagcttcctgaggcctcctcagaagcagatgctgccatgcttcctgtacagcctgtggaactgtgagccaattaaacttttctttataaattatccagtctctagccaggtgtggtggtgtgtgcctgtagtcccagctacttgggaggctgaggcaggaggattgcttgagctcaggagttcgaggctgcagtgagttataattgcaccactgtacttcagccagggcaacagagcaagaccctgtctcaaaaataaataaataaataataaattacccaatcacaggtatttctttgtagcagtgagagaatggactaatacaccctccataccacaccctactacttcacctccctttccaactactgtagaagatactcactgttatcatttactatcttataagtgcaaaaactaaagtttaaagaggttaagtaattggctcaaggtatcacagctggtaaacagaggcactgagatttgttctcttttggtttgaccctagaaccctctcctaacattttttttttattttgactcttgtttggcagaataagtagcaaggacaccatcatctttgctgaggaaagatgactattattagtagtaggcaagtggagagtcgtcagtgttccatcagcttttcccctgtgtctctcatcccatgaatgaagagcagatgtgaaaattgctgccagccactcacttgtcagatgagaactgacttggctgtgctcattacaaaattaatttttaggcttattacaaaattaataaggcatgtgaaatatagatgtcctcaagatttataaactttaatttagaagtgtctttgattctaatacaaatctatttttacttacagtaagatagcaaagaaaaaagtctctggaaagattctggatatgtctaaggaaaatttgattagatgggccagtgtttcagtaacacacacaagaagcttctgaataacttgtaaaagtgagatgatgtgccccactttgatttaaattccattacatgtatcctcaggaattagcaaaaaaatttttttttcataataaaactcattagatgattttgacttataaagaataacttgtttgagaataaaatttgtctggacacaagtattggttctgtaaaatgaaaggaaatatctaaacttctgtgcaactctccgttaaagataatcctaaggctacttcagatatatttttgttattcaggatatggaatgagcatgaacgtttgcattttaatggtcaaaagaaccattaaggagagaagctcccaaaatataataagacatgactagtttcaactctatgttgcctctgtatgtttggaattccttgtaattccatatgtatttggatgatgtttacctttgctgtatctttgatgaaatgatgtgttaaactaacttcctgcagtaaataaaggaggaaattgtaaagc

SEQ ID NO: 59 - DNA, 1124 bp, Homo sapiens
ggcccaaatctccagtactttttctgctcataaaaatctgattatttgctaatcctttagaatgtatggtttctattgacagttggaaaaggatcacttcattcacgctgcctagtcaagtgaccctagcctctttaggtaagtgattcaatatattattaataaaagttacctttggttcaagctttgaaaataaattatattgtttatgtaggtaaaacacaaagatcagaaatcaatgacatttgaaacagcaagacgaaagggagtttaacatccagcatatatgaataactacaaccctacagaaaaaaaatccagttcaaaactcggcaaaggatttaagtagacattttttccaagaagatatacaaatgtccaaggagtacgtgaaaagcttctcagcatcattaatcattaggaaaatgcaaatcagaatcacaatgagccattacctcatacccattaggatggctatttttttaaagcaaaaaaaaaaaaaaggtgtagctgctatggaaaataatatgctggttcctcaacaaaataaatatagaattaccatatgatccagtaattccacatttaggtgtatacacaaaaaagctaaaagcagaacctcaaagaggtcttgtataccaatgttcataaaatcattatttacagtagcaaaacggtagaaaaatctctaatgactatcagtggatgaatggataaacaaagtatggtctatctacacaatgaaacatacccagttttaaaaaggagtgaaattctgatggatgctacaacatagatgaaccttgaggccttatgctagatgaaatatgccagacacaaaaggacaattattgtatgattccacctatctgaaatacctggaattctcatattcatagagacagacagtagaatagtggtttccaggatggggaaaagaggagaacaggaagtgattgttcaatagatatggagtttcgcttgggatgatgaaaaagttctggagatgatggtggtgatgactgcacaacaatgtgaatgtacttaatgacatgtaaaaatggttaaaatggtaaatattatcttatgtatattttaccaataataaaaatactttaacactg

SEQ ID NO: 60 - DNA, 5328 bp, Homo sapiens
atccggagccgggcggctcgcccaggatacggagcccggcggtcacgggggagaaggtagctgtcgggcattcccctggcgctgaagggcagattgctggtctcactccattgcccaggcttcagtacagtggattacagctcactgcagccccaacctcctggactcaagcgatcctcccagcctcctgaatagctgggactataggtgctcaccagcatgcctggctaatttttgtatttttttgtagagacagggtttcaccatgttgcccagactggtctcaaactcctgggctcaaaaaatccacccaccttggcttctccaaagtgctgggattacaggtgtgagccaccatgcatggccaagcacatgaaattgcatgcaaagctgccatgcttccgtatttgcaagagttcctaacctggaacaagattaagaatcagcagcaaaccaagtgagagtttccagggagatggtgcagctttcccgtgaatacctatgaattcaccacctaaatggtactcagagctcttaaggggacagcacaaggacgagcctgggaatctaagcacagtgggctgaacatctgctgggacaaggatggggccagagacagatcactctgactcaccaccctgccaccaaactaatgtttgaaagctctaaatttattcagcttatactgaaaggaaatgaagtctatgtccaaataggaaacaatgtggagtactgctgtgctgtgccttcattacctgagactacagcagcctgcattctccaccgggctcggaggagtgcagatgcctgagctatgcagtgtgattcaacaattccagttggacggaaaatacagctgtcttttttacggagttgaagtcaaatctacgtgcagctttttttacctacaaataatggacaagctcctgaatccaacatattctagctgaaacggatcccaggacggaatgctggagagatgcgtattccagctacaggccctcagagctcagtgtttacctgttctggtctttcctcacatatctgacaatcgttagctctctttgtatttcaaagaaaagctctggaatgtgtctgggacctgtgtatatatgggcaaaactcatcaacgaatgggctccctggtgattatttggcagattcctggcaatttcatcagaggatccaaaaattggagaaactccaagatgaaccccaaagatctccatctccagctgttcacactcctatgtaatctctagcccttgggtgtggaaaggacttgtgacttactttaaccaacaacagaatatagcaaagatgcctaagaactgcaaatgagaaataattttctcacctggtcacagcatctaccaagaatggcgctgggggagagatcagtgagattccatctttattaccatgtccctccttccctgtcaaaagcatttcacatcccgcaagtccattagacatggcaccactctgctgtgggagatacacacacaactaaatacagggtaacaatacctgcctggtcagcacttcagctccaaatcaagcttcactaatgactatgagattaacgaagatggttttgataattatgactgtttgttttgtttttcttaactattcttcatctgagacttttacttttgtttctgccagcatcctgacaaacatttacaaccagaaagggtaagccactagcttgaagccattaagttaagttcagttaacaaggctttgataacaaccctcatgtttttaaggaaaaacaaagaacctagtaatcctttaggccttaccctgaaagggtagccagaagaaaaatcacaaataacatgaacttaccggaacaatccaccggggtgtgatcatggatgtggaagacacctgaaataattttatatgtatgtatttactttttggaaagactgacttattttcatacttataatacttacttacatctattatgaaatccattctaggagggcaattcttaattcttaatggtgttccttgagctgacatggacttctaaatccaagacccttttctgttatacaacacagatgctatccctcaccacttaagaaagtgtcataattttgagaatctcttatctaaaaatttaccattcaagaatctattactactttcagttcacttaataggactgcccctacctcacacccagtattcagtttaacattttattttctgaaatttcagttaattaattacaaataatgatagccttcttggtagcagcctgaacaatggattgtgactaatccaaataaagagcaacaagaaagtacacagaaaaataatctgtttagatacagatcattctctaattatcatgtatgcatgaagaaagcgcaataaaaacacccatattgctcctggttcacagggcctttgatacattatttttatatgtttaactttctattataggtcatctatgtgtagaattataaactaaggaaacccacccattttactagtaatttagactagtccttgcattggtggccttacatactcataagaaaaaactaatgtaagtccaggtattagtaaattagataaccaccaaaagaataaaaacacaggctgggcgcagtggcgcacgcctgtaaccccagcattttgagagggcgaggtgggcagatcatgaggtcaagagatcaagaccatcctggccaacatggtgaaaccctgcctctactaaaaatacaaaaattagctgggcatggtggcatgcgcctgtactcccagctactcgggaggccaaggcaggagaatcgcttggaggcggaggttgcagtgagctgagatcacgctactcctggcaaaaaagcaagactccatctcaaaaaaaaaaaacccacaaaatctgactttcctaccaatactttttagatgcatgttaacagcaggaaataagagagaaaaaatatcataaataatagtaaacaaaaaatagtttgacagacttttccacacttgcagttaattcttatccttggtaaagtctttgtttattaatctaagctggtcattcccaacgggtggttcccagaccacatctgcaccacctgggaacatgttagaaacacaacttttcagaccccacccaagatataccaaaattagaaacttggaggtggggcccagcaatcttgtgtgttaacgtcccctccaagggattctgatatacacaaaaatttgagaattaatgatctatgcaaacattcagtatcatgtgtatttccaagccttcaggatggcatctagcccctacagcaattctcgtcatatcactcataaggtacaaagttagtcatttctgtttttttttttttttttttttttttttgagacggagtctcactgtgtcgcccagactggagtgcaatggtgctatctcggctcactgcacgctccatctcccaggttccagcaattgtcttgcctcagcctcccgagtagctggcgctacaggtgtgcaccaccacccccggctaatttttgtattttcagtagagacagggtttcaccatgttggccaggctggtcttgaactcctgacctcaagtgatctgcccacctcggcctcccaaagtgctgggattacaggcgtgagccaccgtgtccagcaaagttagtcatttctatctctctcatccctggagggaaggaactgtttcagttggccctccatatccatgagttgtgcatctgtggattcaacaactgtaaatcgaaaatatttggagggaaaaaaaggatggttgtgtctgtactgaacatgtgcaggcttttattcttgtcattatttcctaaacaatacaatataacaactgtttaccagcatttacactgcattagatattagaggtaagctagattatttaaaatatactagaggatatgtgtaggttatatgcaaacactacaccattttatatgagatttaagcatgcatggattttggtatccaaggggagtcctggaaccaatcccccacagatactgagggacaactatacttaatacagtatcttccagactgtaataatgattgatatgttcaatgccattcttacgctctcatctttctataaaactttttaaaaaattaaatatatccttattgtctcaagaaactgctttatccccatgttttctctcatttaatatgatgttgaattataaaaggcttatagagacatgtgatttgtagacagtgatacacaaattcaaagtggtaaaattttaggacagagaggcaatgctaagtggttattaaaacataaactcttatcaaatgaaaagtttaactgaattattaaaaaggaaaaaactggaatctagcaggaacatttttcaaaacagaaatttctttccatcatactattttaaagcatatttacctgaggtgcaactgtgtgatcaattagattctcagttagagatgcaagcaaggcatccaattcatctgtagcttcctatggaagacaggaatctagaattgttaaatgacccctttatcatcagatgttaagttttttccatatcctctcaatttataattctgacacaggcctgattagtgttaatcctttaaatacacagggacactcataaatcatggttgttaatgattccacttctgcatggagggaaacctatactacaatcaggatgtgaaaaagctgaagtgctatgtaaattttcaaatagctattctcctttggtaagacaaaacttgggtagggttatgactattctggctcttaactttttctttttaattacaaaaaaattattttggctggatgcagtggctcacacctgtaatcctagcgctctgagaggccaaggcgggaggatcccttgagcccaggagtttgagaccagcctgggcaatatagtgagacctcatctttacaaaaactgagctaagctgggcacagtagcactcagctgtagtcccagctactcaggaggctgaggtgggaagatcacttgagcccaggagacagaggctgcagtgagccaagattacaccaccgtactccagcctggatgacagagtgagattctgcctcaaaacaaattttaaaaaagtaaatacagccgggcactcctggctaacacggtgaaactccgtctctactaaaaatacacaaaattagctgggcgtggttgcgggcacctatagtcccagctactcgagaggctgaggcaggagaatggcatgaacccgggaggtggaggttgcagtgagccgagatcgcgccactg

SEQ ID NO: 61 - DNA, 1990 bp, Homo sapiens
atcattatctgcagagaatttcagtatatcttcgagttccttgttagtatttatgctctcttatttgtgttgggatagaaagattaaggaaaggagagatgagaaggtggctcaacagttgagacagttttattgggagtaaacctgagaagggcttccagcggcagggtcaggtgcaaacttctcttacagcctgaggcttttttaaagggcccagtggagaagtgtgctttgaaacaaaattctgttagggaggggttggggaagtcctggctgttctgttacagttagggccgttattctctgttgaagttatgggcggggctgacattttcagttttggccaggtggccaaatagaaacttaaagcttaggatggtggagtgttataaagatggcggtgctcttgtcctgtcaatgtgttcctcaataaagtcttcaagcatgtcatagattgttttccccaccaacctcccttgcagcatttgagatattcctgatacttcatcaatagtggagaagctcctgaaatcattgacttcctcactccataatggtttccaacacccaatgaagtagtaggaggaaaacatgggtttcttctcctggaagcctccagaagaaggtatttcaatatggggagagtggtcagctgtgtcacaggtcactgagaatttgaataagacaaggaaaaagggttgactgtagattttggcaagtatttggtcactgggggccttgataagagctgtttcattgaagtattcatgagaataacttgtagtgaaatatatctcaaatagacctccacgatgttgcctagagggcagtgttaccctttgaactaccaacattaaccactggaactgctcatctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagcatactttgtttatccatttttatgttgataaacatgggttgtttccacagtaataatttgactgctatcaataaggctgctgtggatgtggtatgtctatgtctgtgtgagtccctgctttcaattcttttggatatatgtatccctaggagtgtaattgctggttcacagaataattggtgtaaacctttttcaggaacaggtatattgctttacaaagtggctacaatgttttacattctctccagcaatgcataagggtttctattttccacattgtcacatatactggttgtcgtatttttttcataatagccaattaatggttctgtactgctttttcattgtggttttgatttgcatttccctaatgaccaataataatgcacattggtttttgtttttgttggttgtttatatattttttgaaccagtttgttttaaaatcctttgctcattaaaattgagtcatttgtgttttgttgttgagttataggaattcttatttaaaatttttagtttttaatatttagaaaatttctttcttttttcagctcccaagtgcttggaagagagttgtaggaattctttatacactgtgggtattaagcccttatttgatatgtgatatgcagatgtgttctccctttctgtaggttttcttttcatcttgagattgtcctttggtgcgcaaaagtttttaatttcgatgtagtccagtttatcttttattggttgtctgtgccttaaatgtcgtatccaataaatcactgccaaatttaa

SEQ ID NO: 62 - DNA, 3628 bp, Homo sapiens
cttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagct

SEQ ID NO: 63 - DNA, 2586 bp, Homo sapiens
cacccatggtcagggaagcgccatcgccctggctttgaggctggggcctccggggaggttccggtaggggctttgaagaggccgctgtttttgcaaggccgagacggcgggccctgcgcaggccgccctattccgcgccctcagggcgtcagtatccgcctgaggccggataccccctctgggcccggatgcccccgctggccccggagcatcctcggcgctgccctcccagagccccgcagaggctgaggtggcgcgggggcggccccggctccgcgagaagcggcggcagcgagggctggaggacccgggctacggggctccggggcgtctggcctggttgggactgagcccatccagggactgggactctgggattctggtgtaggtggatccggggcaggctcaggaccaagtccctctccttccaccaaggagcgcccagaggccggcgggagctccaggttcacctcctcctcctccaggaaatctcacttccaactggatgtctggatgaactactgaaagctgctgagtgtcctgcagcaggtgagctgtggccagagcccaaggatgaagggggctccctcactctgtgactgtgaagaggaagcctgaggtgtagcaggcccaggccccagaagtatggaaaaaatgaggccatttccaatccagcggaagaccttctagaagaggtgatgggtgggagagtgctggcatactacgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaatgaatccactcaaatgttggcaagtggagcagagtcccaggacagtctgcaatctctacaggtacagaaacacccccagttcaaggatcttcacacctggatttaggcctactcctgcaactaccccaggccagttatccaggcagtgactttcagtgcagctacagtcacctctggaaacctgcggagactttaaaaatttccagaaggtcaggaatttttggagacctttctcatggctacattgcctgcaaaggtgaatcaataagcttctgaactgacttagaaaatgttgcagagactcttgtgaacagatagaccctctcctgccactcagatagacgtatcagggtcacacacacctgatttaacaacatgtcattatctcaggcaccaatttgatcttctactatgttgcagacatctgttctgcaaacaccaaacaaattgagacaatgaccttccgcaggacccaaaccacctcttactgaaggaaagaagatccagtgagatagttagtccacaaatggaatgtaaatccataaacactcttaagtaacagaataaatttagtatgaacgtttttatgtgggagctcttgacatggttgctgctcatatgtcagagacacatgcagtttaagaaaggtagcagttccaatcctggtttggcccaacagtcactgcatttttggtggggaaaagggatgtgggaggagatggtacctcttcatctttttctctgggttttctgtcagaaagggatgttgcttactccagtggcaaaaaatgccagtgtcttctgccagagtgggttactgagggccctggtgcttccaccttgtggctgatacagatagtccctttctgcttttgtttctagccaaaaaagatgtttctggcatctcaggtatgctgatttcagcagctgttttttctatatggctattttttttttctttcactctctctctctctctctctttttttttttttttgttggcttcactgtgttgccatagtttcttaaatggtcccttgaaccctcccagtgctattttggtttgtacataactatctatatattttttttctttgggggagtgtgtagagctaaaggctggtatatgctgctcctgctccccgaaagtgacattattcccctaagctaatatttcaggctttcaatttattcgtggtttcacctgtttaaacataagtagaaattactttttctctccatatttagatttgatctatctactttaattgctaatagtgtcttagtcatagaatagattagttagaaaaaagtgtttttgacattataaatgattctttcaatttgtgtctaaaagtggaaaatactagaaagcttaacatttattattgtattcagaccagtatttcctccagatgacctttattacaacaaagataatttaatgaagatctctctaatggtaaagctgatggctttgtgctattacaatatccttcgaataaagtgacagtctggtggaaagaacaactaaagcaaggattaggaagaaaatagttaataccttcattttggtctcactctgcattaagagttgtcatcgtgttaagggtttattatacattaagtaatttaatgtttatttaataataaatggatcctattaaatatgatttttaaaattataatcaca

SEQ ID NO: 64 - DNA, 7458 bp, Homo sapiens
gagggatggcgccggcgcaggcctgcgcgccacgcgctttaggtggatgagggatggcgcaggtgcaggcctgcgcgcctcacgctttatgtacatgagggatgaggcagcacaggaattggcacaacctgaagtcagctctgcagctttccaagcttcgttctgcgtgtcctgtactcaacagtcatctcatgctgcagggtggctgcgtgtgctccgtacatcacacccatatttcaggtagggacggttcccggagggtgctcagcaccatgccgactactgctggctggcacgttcgcacgtggccatgtcagctccaaggaggatgctgacatcctgctggctggcacgttcgcacgtgtccatgttagctgcgagggccatgccgacatcctgctggctggcacttccacaggtagccatgttagctgagagggcgatgccaacatcttgctggctggcacgtttgcacgcggccatgttagctgcgaggacaatgcttctgcaacttttggtttcttccctttcatcctcccacccctgaccgtttttgcctgggagcaagtgcctaataaattacctgcactcaaatctttggctcagagactttccgagagaacccaagctgaggcagacaatgaaatcaacactaccagccacttagctgccagctgggtggagagtgggctgctcttccaagacgcttttcagcctctgaaggctcatttccagaaggtcctgtctatctgggctacttgcttccagagcagttgcatctggctggatagctaatgagcgataaggcctgcaaacctcaagccacatctttaaagatgagggccctgatgttccacagtgtgcgacgttactggggtccagccagttatgttctgggagctgcctgaatgaaaatcaatttgttattttagttggttggcttgtttaaaaaaaaattaaataacaagaaataagaaaaaacgtgcaatggctttgaggtagaacagaaaatccagtgagccctctctgtgcctctggcagaagaaactgtgaagatttgcatttagaaaaacgcctcctcaactttggcggcacctgatggttcatggttcctaaaattagaaaatgctagagccttggttcttttttttttttttttgacggagtctcactctgtcaccaggctggagtgcagtggtgtgatcttggctcactgcaacctccacctcctggattcaagtgattctcctgcctcagcctcccgagtagctgggactacaggcgcccgccaccatgcctggctgatttttgcatttttagtagagatggggtttcaccatgttggccaggatggtctcgatctcttgacctcgtgatccacccgccttggcctcccaaagtgctgggattacaggcgtgagccactgcgggagccttgcttctatgcgagtatttcggagacaattagacaaacatcccacagccccattttgaagcctggcattgtgttggctgcagtgaattctgggggtggaggtggctggagggaaagagttgggagtcttgttttgttttgtgtttcctggagagttttgggttctgcgggataatatgtgcttgcaggtgcagcaggagtagcattctcatttctcacggcagttcagtccctgagcagacgggagaggtgaaatagaaacacacattacagaagggacatgctttcttaagggcacggggaccgtgacacattgctttgatgaacggtgatggagtcacacatggggaaattcaacatggacacaccagtctcgctatggagacatctgtgttgtatgggagctaatggctttgaatgagcccatattcatttttctagcagttttgatactaacataaagagagaatgtgtgtggacagaggaggctgtcctgcacggactctgggtgtactttgtgccagtgacattttgttccagagtgattttgcttgttccagtttttctgaaaggaaagcttccccacagttttggggactgctgtttgtctcatgccacatgtgaggatttgtggggtccacagtctgcgactgtgctgtccagcatcgattccattcacactggttcttactttcaaagtctattctgttacagggagaagactgcacatataacacagctctgcatggaaaaccttccgcctggaggggtggcttcctagaggtgtggcgttgccctctgtcttgaacaggctgcactttccagggcacatcacgtgggtgtgcggtctggctgctgggtccacgcgggttctcaatcatgacctggcttgcaagctctttccacagttggataaatgaagccgttggggaagtatccgcaaactcttacagtgagtatgtgataatgacacacgcgtggcccttctaagacctccgctaggcattatcagtgactgtgctcgtgagcgctgacctccgctaggcgttatcagggactgtgctcgtgagcgccgacctccgctaggcgttatcagggactgtgctcgtgagcgcggacctccgctaggcgatatcagggactgtgctcatgagggcggactttcaccagccacgcttccgaggagtggagtctttctcagctctgcctctccaagatgaccatcttgtgaagacgatgcgttctttatacacaagttctgtgtgtgtgtgtgtgtgttccacacacaggaccaaagttgagataggcgcacattttcttggtcccacttgtggccccagtcggctgtcagaagtgggtgtgctccacatgtacccaccatgtcagggcacagtgctcacatttcacacctcagcaggtgccttgatgttgaccagaggccccaaaatcatctctttctatgacttctagatcttagattcccaggaactgggaaatgcagtcagtatcttttgggtccaagaaactttgtcagagcccttgtgggagaaccatagattctcaccagataaacagaagagcttcgtgttagagaaacccgcctgtctccccacattctcagttttctggagagcagctgaaagccatctgggtggagattaagagctccaaccgtgtagctttgatgtatcgggcaagttgcttaagctctttaatgctgtttcctcatttattgtgtgaggccaaaaatacccattccttaaagttgtgaggattaaaaacagtaatgaaaagtgagtggcaagtgccgagtacacagtcaagtacctgatactttttagtgtaaggtaagtagcaagaaagcatgaaatttattttcatttactcttactacatgtggtaaaccatctatgcacagagcactgcattgggtgccatgaatgacagaataagagtaccaggtgcatgaaaagcttaaaagacaaatgagacagagctaggctgcagaagacttaaaaagttgatgtatttaacttttaatggacacactgtacatgtttatggggtacgatttgttgtttccatgcatatctgtgttgtgtaatgatccaatcagggtagtgtgtgtgcccatttcctcaagggtggatcattatgtgtatcatcgtgcatcatcatgtatcatgcatgtaccatcatcatgcatcattgtgcatcatcatgcctgtatcattatgtatcacctcatgcatatattataatgtatcacctcatgcgtgtattatcatgtatcaccatgcatgtattgtgcatgtgccatcatcatgcatcattgtgcatcatcatgcctgtatcattaatcacctcatgcatatattataatgtgtcacctcatgcgtgttttatcatgtatcaccatgcatgtattgtgcatgtaccatcatcatgcatcattgtgcatcatcatgtctgtatcattaatcacctcatgcatatattataatgtgtcacctcatgcgtgtattatcatgtatcaccatgcatgtattgtgcatgtaccatcatcatgcatcattaggcatcattgtgcatgtatcatcacctcatgcatgtattatgtatcacctcatgcatgtatcatgcatgtaccatcatcatgtatcattatgcatcattgtgcatgtatcactgtgtatcatgcatgtgtcatcatgcatcgccccatgcgtgtatcatttctttgtggtgagaacactcagaagcctctcatctcgctatcttgtcatatatgctattttattgttaaccaaagtcagcctattgtgcagtagaacaatctctcctcatcccctgtcctcatcctcccctcccaagcttccataaccactgtttactctctgctcctaggagatcaacttaaaattttgtgttatttttggatttcacatacaagaaatccatacaagagctccatatgagatcgctcagtacctgtttctctgtacctggcttatttcgcttaacatgatgtccaagctcatccatattgtcacagatgctgggatatcatttttttcatgggagaatggtattccattgtgtatctacaccacattttctttattcattctccgttgttgggcaccaagggcgattccataccttggtgattatgaacagtgctgcgataagtgtgggggtgccgatgtctcctcaacccatggatttcctgtcacctgggtctttacccagcaatgggttgctgagtcccatggtagttctatttgtgtttttttgaggaacctctctgctgttttcctgagtggctgtagagagctatagaactttaggtctgtgagagataagtcctccagtacacatgccattttcagaagggcaaactgtagcccaggaaggtcaggtgccttgaccaaggcaggcacagtgagaaagaggcagtgttaggaccgcaactgattttcctctccagtctcttttgtgaagattggatgctaaggtcatataggaagcactatggaatatgtaggaggtgctcagtctgttttgtgaagattgtatgccaaggtcatatgggaagcactatgcattatgtagtaggtgctgtgtgccatacattaagattacattgtaaatagcaggcactatgtattgtatattagcatgatgcactgggtcctgttgtctgggagcctggcacctggcagcttcaaagaacttacaaggtccacaggaaggaacctgggacagcccagggagcatcactgaaagaattggcctggaacagaagccccacagctcacctggggggagcagggggaggataggggtgaggagggagaggaccaggggagcagcgggaggaccaggggtgcaggacgagcactgggggtgcacgggagagcagggtgcaaggaccttgctggctgagaagacagcgggaatggcgggtcctgggagaggggaggaggggaggcaggccaccagccaccctgacttcagccaggagacccatttcagaggctcaaagggtggagatggtgcagccatagtgggaagctgagccccatgctggatgctcagattgagggggctcctgaggggctgcgttcctctctccaggggccgtgggacggtggctgctcatctcacaggtatttattgggtttttcaccacctgccaggactttgctgcccacgtcacacatttcatgtaacctgtaggtgtagaggcctcattttcagacaaagatgaactaagaaagtgtcttctcggaggtcacggctggagccagatggtcaggctcaggctggggctggcttccctcgatgtgatgcacggctcccatgtcacgtttccctgactatcaggagctcccagaggccaaggatggggtggccgcctggacaattcagacctaaggaagggctcctggcctcttccctgagagcctctaagctgactgctctcttcctgctcagcagctcatgatccccggtggcttccttgagctgggacttgactgaaacccctgggactggccctccagccaccctgacttcagggggtcgaggtgctcactgggccagtgctcaggaggctccgtgccagctggaacaccgggaaaccctctatctgaatctttgacccagggaggagcctggagaggtgacgtcccggcaggcctctcccgcaaaacccagaatcagaagtggccacaccaggtccggcacccacggcagcagcaggagccatttctgggacaactttggggatatacttgtccttccaagtgaaaggagcttaaaaagacccctgagcaggagagaaaaagtatcttcaaagagaactcccttcatcttgaagaaagtgtctgcgctagcctcttggccattgcgccgcagtagaatcttaggctccgtcactcctgtgacttaattcaattggcatcggtattttgaaaataatgatttttcctaattgtaaatgtgaaatgtattatagaaacgtcgtccacaagcctctcactcagagagagacaccgataactgtttctttccatggagtacattccaccgtcccgttttcccaccacaccgcgtggcctgacgctttcctctgtcatgaacggctctgatacaacgtgagatgaaattccatctcagacatgcactgtgatcactcacccctcactcctcaatgcctgtgtgtcattgagcacctcacctgtgctatatatttctctttagggtcacaaaagaattgctctgtaatctctgtgggcaaggagatttctcccgagtttgattggtttttctgttttcttaggatagaaatttttctagcagtcattggtctattgaaaacacaaataagcttcacttcatacactagaaaacttcataatataaggtttatatttgccatgagaggaaacaaaatgttgtcttaaatgcattcacgtaccctaagaaaaatggtatgaaacggtcaaggaaaagttccttctgatagtaaaaaattcacccccttattaaaccaacaatgaagttgcactagattagagtttagttccgaaactctgtgcttttagatatttggtccgttaggatttcctggtggggggcacacgcgcgtaagtctcttgatggtggggctctggttctctggccgagaccacagatgtgtctccaggcaggtacttcctctgcaagtgtctgatgaccacagtgaggtgggtgtgttgataataatctactgtcatagacaccttaccttattaatactgctaaaccaggaagggcacaattgatattctcaggttttttaatcctttaagaagaaaagataattaaaaaaatcttttcactcaagaagcatacgatagaatatggtgatacagacaaagggtaggcccactgattcgaaaattacagattgaatccctgagacaaatatctcccctgctttcaggtagattactgtctacaggtgggataaccat

SEQ ID NO: 65 - DNA, 2542 bp, Homo sapiens
ccctgtggtcaggttttctactctacacacagtgatatgctacccccggctctatccattgttgctgtataggaatgctggctcggtgtcacaagattttctgatttttcaagagaagatataaggcagatgctgcaaggacctggtaagtggggcacaaagccatgcaaatccatctgaagtcagttcatttcagagataccaccagcttctgatggtgttacaccctggaaatggcagtccagctctagcttctggaaggcaactggcaagaggtaaggaagagatggtgggaaggtagcccctctccttgttggggaggagctttcatcttattccagttctcagcagtagaagctatgcctggagacttccaggtgtctcctgtcctggttcctgccttgttctttctcttttccctcatcctcatttatgttttcactcctccttctccaatattccagaatattcattcatccattcaatgaataggcatttattgaccacctcctttgtgccaattgctgttcttgatgctgtggtaacagcaagaacaggactgaacccatcccaatttccatctgagctacttctagtagaggctggcaaataacaaacaagtaaataaaatgaaaagcataatttgggagagtgagaagtgctcccaagggcagacagaatggagaggggagcaaagaaagggaaggagggtggaggagaaagggcccagcctcttagtgcctgactagccctttgctgtgaaggctcacctttcacgcttggcttctccctgaagctgggagctacttcaggcaggagccatatttgattcagctgtgtccaaggtcagacgcaaagcttccccaaacgctgttgggcagcagattataccacagtgtcttgaaatacctgcatggtgtctatgtgagcaagacctgctgcctccaagtgtcctgtcggttgtgttaatcacgtgcatgggaggtgaggggtggtatgtacttggagggggagcccatagcgaagggcaggggagagagatattgaagggatatatgcacttcccttgataggccccttgcaattgagtaggggcaaatattaatacattctgagtgctcactgtgtgcctggctgagagccaaatgcattccttgcatcttcttatcatctcatagcaaccctatattgaagatgatgttcttattcctgtcttttaatgaggttactggatgataaatatattaattgaccacttagcagatggaaactattgaaagcctaacccaaactgccagggttaaaatcctggctgtttctcttatgagttgggtaaccttaggcaagatgcccttcttctctttggtgcttctattttctcctctgtaaaatggagacattgctatgaaggtgaaataagttaatagatagaaaatgctcagaactgtattttacagtatcccagcagtccagttcatttttttaatttattttattatttatttatttatttattttgagagtgtctcgctctgtcacccatgctggagtacagtggcccaatctcggctcactgtaacctctgcctcccgggttcaagcgattctcgtgtgcataaattgggactctctgaaatatgtgggtttgagatttaaaagcacatgactatgtttttaaatgttcaaagcatcataattgtagcgcttacaaaccattgagtctatttctctcattttaagcataagaaaacagccgaagattagattttgataatgagagagcccaacgatcctggacccctggccgggaggacaataggggaaacaggtgaaacactgtgtgagctggaccacccaggctctccaacaccaggacaccagagcatccttcctccttcttctcttctgctgcgacttcctggaggcatagcagagttacaactgctggccatgtggaacttctcttctcctataagtttgctctgagatggagagattgtgcctgtggttcattaggaagagctcttgggatcaatgcctgtaataaggaagggaaggaatcaggattggccagaaggagaagttgagctgtgttgaagcctcaatggagacctcagccaattctgagtcatgttggaggtaagccctggtgggaggtgttcgggtcgtgggagcagatccctcatgaatggcttgggccatcctcttggtgatgagggaacactcactctgagtgttcacaagatctggtggtttaaacgtgtatggcacctctccccacccccactctttcttgttcctgcttttgccatgggactcgcatgatccctttgccttctgccaggactaaaagctccctggagcctcctcagaagctgagcgatgttggcgccatgcttctggtacagcctgcagaaccatgagccaattcaacctcctttctttataaattacccagtctcaggtatttctttatggcaatacaagaacaccaggggtttgcaggtaacccgggcccctgtccttgaggacacagcagcaag

SEQ ID NO: 66 - DNA, 1947 bp, Homo sapiens
cagagagacaacagatttacatcccagacacattcacactgggccaagagcagctgccattgcagattcgagtcacgtccttttttccttccttctccttcttggagttacaacagaagctggggaggtgagagtgcagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagagaccccaggctccagaagcagatgaggagacaaacagaagagcagaagaatggcagaatggcacagcagagagaagaaaaggaacatctgaatgttgagaggaatttggctgggggcggttggagaggagattagccactggacagccaaactccaggggaagatcatcttcccactccatcccccttccagctccccatccatcctgctgagagccacctccaccactcagtgaaaccgctgcattcatccttcaagtttatgtgtgacctgattcttcctggacattggacaaagacctaggtccagtgaactgtctaacacttaagtcatccacggacagcaaggctaacagaacgctgtaacatgtgcccacttggactctgggagttgcagacacccacccataggtgctgccatgggtccggagcccaaaaagtgcttgccctggctcctgcacctgcccgtctgcatgctccccctccggtaaggggtttgaggatgtggcggctgaacataagagctatgcccctgtcacacatcatgggacaggggtcagggaactctcccatttcactttcaaatattccaggtcccctttttgttcgggagccagagtctaatggagacagagatagaaaccctgaaataggatccaggcaatataaacctacacgctgtaagccaagtcagagtgaggctgatgtgataacaaaagtctgaatacaaggtgggagacaattattctgactgaaagggaggcaagagttctgccataggcttgatgctgtgtgcccctggcttcctaactcatttgcaaatggaaaatactattccattgtaggaaccttctttttccatgtgtctggggaaggagaaagaatggctgggctgaatgaatttatcccttggtcctcttccaacaaagctcagctatgaaagataaatccagctctccccaccccctctcagtggagctggggagaaatcaaaagcccctctgccaataatgagaccaaagtttgcaagggcaggacgagcccgtgctaacagagaaagtgttgtttcctcaatttggttttagactgtcttgtcctatgggggagaaaagatctgcccttgggagaggtgccaactttatagatctattaataaaagaactggcaggcttacagttcttgccaatgaggaaacttgaatgagagaagccaggctcaaccttggccaacagactggagcccatcaccctaacttcaccccgcttctccttacccaaccgtcaaaggctaggcagcacccacccagcagcttccacctggctgaagcctgcacctgcttcagaccaagggttagatggaaatttggcatgggaagagagggctcacctgtgggcaggatagactctatccaagaaggagaactgaaaaatgaaaacctatgagacaaggggtgatcctgaaggcaggcaggagaaagggctggagggagaggcactggggaatttttcctggtgaatactgaagttactagatgttttgtcttgcaaaactcaagggaaaactctcaaactctaatgtttgtctattctgtgtccaaactgtccttttgaaacggacccacctttcagtaaagaaacttgcattggcctgccc

SEQ ID NO: 67 - DNA, 1096 bp, Homo sapiens
ataaatatttgttgaaagaacatttgttcaagaatgcatcattagaatgcattcattttcagccaggcgccatggctcacgcctgtaatcccagcactttgggaggccagggctggtggatcacctgaggtcaggagctcaagaccagcctggccaacatggcaaaaccctgtctcttctaaaaatacaaaaattagccaagtgtggtggtgcacacccgtaatctcagctactcaggaagcagagggtgcagtgagccgagatcacaccactgcactccagactgggcaacagagtgagactccaactcaaaaaaaaaaaaaaaaagtcttcattttgaaaacacatgacatgactttaaaagtgaaagctaccgaaattctgactgggaaacaatgatatcaagctaaaggtggtcaaagaagagctgggacgagcccattgaaaaatactcctatttaaacaagaaagaaaggtacattttggacaggagaacagtatgacactgtaatgaaaagtaaaaataaagtatgcctaaaaaaactataattatatcagactggagacatgggctcagagaaatgtgcacagcggtaaacctgttacgttgaagccgtattaccaagatttccagagaacatgtcaagatgcaactgaaatatatcagactgagacagaagtgacatgacttccaatctgaagttgtgaattaggtaataaaatgatctaatttttccttttaaaagatcaccataggcggctctgtaaagcacagacaatgcagagcaagaatggaagctagatgactagttagaaggcaagaacagaaaacaaacagtggcttgatctatggtaactattctggaggtaagtggttagattgggatatattaacaaggcagagatttgctgaaatgaaggggaagaagcaaagataaatctcatttggccttgccaagtgaataaatggtcgtgtcaccactaaaaggaggatgggaacgcaagtagaaatgaaaagttccattcataacatccactgcacaactggctatacccttcatgtggaaacaataatgaacattttttcctgacttat

SEQ ID NO: 68 - DNA, 1984 bp, Homo sapiens
actgccaccttgacgagttccacttaggaacagccagagcagcccctgtcagcatcaggaaaagcccagtgggggtatgtgccccccttttcctggagtgtctccaaagggaccccagctgaagtggaagggaggagggctggcttttctcgtggccttggcgagcagggcgtggtgcagtgtcgtgagaacactttcaggacctgccgcccagcttgggtctctccagctgtgatgcaaggaccctggagccctcagcccacatattcacagcttctccatgacctcaggcctcagttttcccgacccaccaggctcctgtgagggtggaagagccggaaggaggtgggatggccgctccacaaatctgagttggcctggggttgtcgtgagaacagggtatatggcccctactgacaccacccccagtaggtcaggcctggcactctcgacaccccagtggcccgggcctttcaccacactcttctgggggggattggggaggactctgctaccagtgactcacaccctgtggggcatggggtaattatgaccctgagaagcacccacactctttctggctaggccagagcctacagattctgtgggtacaccccagcaaggccagagcctggtagagaggagcaagggtggcaggaggaggggaacctgctcacccctctgcttcatgctctcagggctgcctgcaggcctggctgccttcctcatcctcgccgctgtcacgccctcccacctgccttctcccatcccctgcttctggccttctactgacccgcactggggtgggcaggacaccgcctgcatgtgtcctcatttatccacatccatcaaccgtagatgggggtgccttttacagatgaggacagggaggctgtgagaggggacttaactgtgcagggtcaccttcagcatgacagcgagtggagcagaggttcagactaccactgtccgcccagctcctgatgccaccctgtcctctgaaggcctggcctcttcctgccttttcgtcctctctccagctctccgacctccacactgactgtccctgtgactttggacaagccccatccccgctctgtgcctcagtttccttatttgcaaaatggagaagtgggaccaggaccagactggggatgtccacactgtttctgtagctgtggagagattcagtgtccaacagatcccagagccaaggcccctcctcagccctgacagctgctgggttcagtgtcctttgcattagtgcctggtcctgagaaggagagacagccggcaggtggaggcagcctggggccaggctcacctcagctgtctccagccctgtcgtcttgatgaggccctgggcttccacctcccaggatccttgggtcacggccaccctcatacttagtgcatgtgtggcctccagttacctgccattgttagaatgtttttagcaggataataaagcactgggaaaaagcccactgcaccatctaaacgaggacctgtctctgcatagtaatggcagcagcaatggtggccgggatgttgaggttgatggaggtggagggagctggtgatgatgacagtttctaacaactgtgcagggcaaatgttcacaaagtcatgccgagcctctcctcatttccattctcctgccaccattgatggaagcagcgggtgtgctgttcccattttgcagatgaggaaacagacagactgagttccattcaacaaagagttcccagctctggctcagtcccaggcccactctgggtggtgatgcagctcattaaaatttatctttttgtggatcctgaggatatttggaagtcagcagagagggagacaaggccacacacagccacagagtcacagaggacgggctgagatcggggcagaagggctcattctgggagcactgagatccgagtgcatccactggctttggggctggcaactgggcaaggcgaccgctcag

SEQ ID NO: 69 - DNA, 939 bp, Homo sapiens
aacttggtccagttcaatcaagccatcaacagccaggtggctttagtggccactatgcatattaccccatgcctaaaggttctggtacaagagcttctctataagttgcacattgccatagtggaagacggcatgggagatttggtggcaaacacttacggtgcaataatagctgtttttcctatatcatgacaatatgtggcacacttctagactcatttcatgccaaagaagttcctcagaagggtaaggaaatggagaatcttacatggtccaatgcagtccccaagaagtaattttgaatggacagttacactggttactacaatgctgtctctgaccttctcaggatcgaagataatcatgagtatcaaggtggagatgggtctaggcgagagaaaaggaagtagtggttcttgagaagaattgtatggccaagataagcttgaactatctctcctcttccagttcctgcaacttcttattgcctgattgaggtcattaccctatggtggtaatgacatcagcaatgtaataaattctctcgtggctttgtatctggtttataacatgggaaatgtttcctcaagagtggtgatgccagtatggcttctgctctctggtggtgttggaatctgcattagtctgtgggtttggaggagagtgattcaggccatggggaagaatctgacactgtaacaccctctcgtgccttcggtactggactggctcctgccccctcactatggtgattgcatcaaatatcggcctccccatcagtacaacacgttgtaacatgggctcctttgtacctggctttaatccaagaaagttgttgacttgactctttcgtgatattgtatagcctggtttgtcacagtctttatttctggaattgtcagtgctgccatcttggctgtcttcaagtatgtcatcctc

SEQ ID NO: 70 - DNA, 1850 bp, Homo sapiens
aaaccaaacaccacatgttctcactcataagtgggagttgaacaatgagaacacatggaaaagggaggggaacatcacataccggggcctgtccgggggtgggggctaggggagggataacattacatgtatacctatgtaacaaacccgcatgttctgcacatgtaccccagaacttaaagtataatttaaaaaaagaagtatttccagaatctcatataaaaaaagaaaattaaaaatgcagtttatttatgtaaaagatcagtggaacttaaagataatcactgagtgacttacagtaaaaattaaaaaatgaaaaagactagtgtactacaaaagagactatctgaaaaaaaagaaatatcacagaatatcaaaaacttgaatgggaacaagaactctgcagtttgagatttctgatagtcatgaaaaagaagaagacctgttgcataaaaaccatttgatgcaagatgaaattgccaggctcaggctggaaatacacacaataaaaaatcaaatcctggaaaagaaatacttaaaagacattgaaattataaaaagaaagcatgaagaccttcaaaaggctctaaaacagaatggggaaaaatcaacaaaaacgatagcccattatagtggacagcttactgctctgacagatgagaacacaatgctccgttctaaactggagaaggaaaaacaaagcaggcaaagactgacgaaatggaatcataccatcgtagactgaatgttgctctacatgatcatgatcaaagtcactcaacagaaagagaccaagagcttgatttccagggcacagtagataaattgcgtcatttacaggaaaatttgaattctcatgttctgattctttctcagcaactttctaaagctgagagtaagtccaggtgcctcaaaactgagctccataacacaagagaggctctgaaagaaaacgctttggtttttgaacacatacaaagagagctaaaccaaacggtgtcaaatgaaggacattgaaaaaatgtacacaagtggccaagataaagtagaaaaatgcacagaaaagcaagtaagattatgtcaactacgaagacaaaatatgttgcttcaacagcaactggatgatgttcacaacaaagctgacaatcaagaaaaaacagtaattgatagtcaagccaaatgtgatgctacagcacaaaatcttcaagctgagtgcataaagcaccgtcttttgctagaagaacaagaggatgatcaataaagttaatcatttgaaagaaaaacaatgtcaatatgaaagagagaaagcagaaagagaagtagttgtgagacaacttcaacaaaaacagggtgacgtcctaaacaatcaacaacaaaagctttgctggatgcttcattgcgtcactgcgtccattgagaaagtgagatgtaggattcaaggaagaaattaggtcagatgagaattcaatttcaagaaaaatggaatcaacttacagcgactataaaatgtactaaggagacgcaaggccacgtacaaaaacttgaaatagaaaattctagtgttaagaaatacaattaaaaagcaagatggccaaattgagcagcttcagaaaatcctgcgaagttcaagtttgatgcagcagttattgcaagaaaatgaaactacagaaatagatgaagcttcttctgaatttaaatctggatcctctgtagcagaggttcccaacctacaggccatggacaggtccatgacctgttaggaaccagctgcacagcaggagagttactgtggatcttctagatcatctgcatgccatgtgaatcttaaaaccagtttttaatttctacaa

SEQ ID NO: 71 - DNA, 5489 bp, Homo sapiens
agaagcggactcaaaggccggagtctaagggcctacctaagggtaggggagtgggaagaagaccagggccgtcgttattaggccacacaggcctggcactgagggaaaaaggggaatttcccgaggggagtcctgtggggatggggaaatctttggaggaatccagttattcgagaaggacttccccaccccacctgcctccttcagccatcccaagcagcagctagaacttctgtagttcttcctctgagtgccccgagcctgctgtctgccagaaagactcctagactagaggattggacagtagggtcaaaaccctaacccttggttgaccaccggccttccctatcaggacgccccattacctcccttttcctcctgcttcccctgaaagaggagtctcagcagttatttacaaagatttattacagcacgggaggggttcaggcctggagtcagggaagaaggggaaaggggcagagcagctgggggacaaggaaaacctggcgccccccgctgtgtgccccaccggggacataaactaggcggcattcctggcatcaaagcacaaaacgcaacaaagaggtctctgccagtccatcttccaggcacccaggaggagcaagggtgattaagggaagattcccaaaatgttgaggctatggagaaaaacgccttagtcctggaccctggtagaagccggtgagagaagtggtgacttggaatcctccataggaaagtgggtagaaaaggatctaagggtacctcaaggttctcaggacctcctttccccagatcttagggtcctgccctgtgggtctcctgtgtccaggggagaggatctggggagtagaattgtgaagggcaaatccctgttcccggttttctggattttccaatgtgggctgtctcacatcccacctcccgctgggtgaatggaggaatgactggcaggggtgggcatcaggcagcaagtgcccaggttctctgggtatcagccaaaggtgggcaaacaagcaaacacagaccagccttagtcttctagaagtcagaagccgcagccctagcaggcgaggggaagagcacaaaacagggtgaggatagagtgggtttctggggaacagcgatgtcccctccacttcctcctgggagatgcaggctgggtgcctatgtgccaggctcagagggggaagggcgctgaggttcctccccaggctctgaaaggcaagcagagagggactcagggcctggccccacccaccaagatcccagcccctcctccccatttcacactcccaagccttaccacttagtgctgggtcttccacttggtcctcagagcctccatctctctcggactcatccagagggggtgggcgctcccagggcccttccagaccctggccacaggttgtcttttgcccagctggggatgggaaagaagagataagaacacaggctctgcgtatccatccggctgtcctggagtgtgagctaagtgtctgatggctgaggttaagctttccaggggcatcatggaagcatggagagagaactgggctagaacagctctcccagcaactagccatatggcttacgtaagtcagttagtacctttctgaaggaaatagaaagggggaaattgtgtagattaccttaaacaagatgtaatagtgaataccctgcccagcccagcgccagcacccaggagccactaggagtcgtggtggtttatattgctccatcataggactatcatttgacccggtgcccttctgcattttttgtttgtttgtttttttttgttgttttgttttggttttttgtttttgtttttgagatggagtctcactctgttgcccaggctggagtgcagtggtgcgatctcagctcactgcaacttccacctcccaggttcaggggattcttctgcctcagcctcccaagcagctgggattacaggtgtgtgccactgtgcctggctaatttttgtatttttattacagatggggtttcaccatgttggctggactggtcttgaactccagacctcaagtgatccgctagccttggcatcccaaagtgctggaattacaggcatgagccaccgcacccagccacctgctgcttttcctgagggaacagtctcctctcacccctcttccactgttttggaggggtctcagtgaggactgattcaggtcttccagctgtctcttgcccacaaagggactgaagcccagcaacagcttttgcccccatggccaatctcttcactgccagatatgcaggcaggaggcccaaggccttttgtttgtgtggaagagctgacagcttctagtaggggtggttgactcttcagtattcccataaataatgagactaaaaaggttaatgggccgggctggttcttgaattttaaattctacatctaaacactagagggcaccctcccactccatcctaggaaggaaaaagaggagaaacagacaacagtcctggagagggcaagtaaatgaggcagccctctgcaccccagcagagaccacatcctaggttcaaaaatgtaggtgaaatgcaggtgacaggggtgttggactctcctggtcctccatccctgaatgtcctcacgcccccttactgccataggtgggaagtcctcttttggctctagcctcaaaccccaaacggccttggccttaattctcagggaagagaggaattattagggaaaacctgattgggagagggactgagccaaggatggaggaaacccatgtctcaggtagggctgagttcggggcaccccatggagcgagaagacagggaggcccctgtggtgtcactacagtttgcgtgtatgagacactgaactagaaggggacgtcctcgtatactcaaggaggacccacagctaatccacatgtcacaggcccctcagcttaccagactgcctgatgaccttcaggacttcagcctggctgtcctcttcttcttcctcttcttcatcatcctcctcttcctcctcatcttcctctcttggataacccagctcccgaagctcccccagctcatcctcctcctctgaggcctggttctcattcaaattgctgatagactgcaggtgagactcagcaatgcgctgcacagctggcacagaggagaccgaggaaagcaagggtcagctagacacagcccatggatctggagatagcctgtggcctagcccccagcctccttcccgtaggcctggggcagagaataccccctcaggggcccaagttcaaaggccaaagttgacaggtcagcctgatgggtgtcagaccagggcagaggcagccaggggtagatttgatcatgtttggctcttaagctgtcctaagatgctagcccccaggcagctcccccacaccatagggcactaggctgggcaagaccaggcgggcacagcagcagcttaacattccctggctggagagcttgattttccaagtacccagtacgggagacagtgtctcccagcttcaagcccaggcagaaggcacagggcgtaggaaccagggcctggggatttgccactttccatttcttgggggtgcccagcctgctgagggctcactgcttaccctgatcctacctcccatgcgatgcatagtccccactccctggcactgcccagtcatagatgccaatccacatactcctgccccgggctccaagggacagaacaattccgaggctgaggacataatagtctgcagccagtgcagtctgtgccgggggatgcggcatgctcagatgcggcccccacaatcttgacccacatccccaggttcccagctccctctgcggtgacctagaaagcaacccccccagcctccaaagacctgctcagatagggctgggaagggaacagtgtgggcagctggagacaagtttccaaaagatggaaaggagcaaggggttagagaaaggggccaaggccaggggttctgggggatggcagaggttgaggggccactgaggagaggctgcaggagctggcaggatcttagaacatatgcgacacaaagttcacaggccacagacaagatgctgaggaggggctgggggtggggaatggggagttgctgcagttccttcttggtctgccagtggcccctcccctcagaaggcccagaggggtagggccaggctggaaacctccggcacagtgagcagggtgctatgctcctgccaactcggggacaggcacagagggtgctttgtatgtgcccgctgccccacccagcccccagctcccagcccagtacctcctgctggctctgggcaagctatccaggcaataaaagcacaataaatcaccctaccctgaccttggggacgcggcagagcttcatcttgagccaagtgtgagagctccagccttggagcacaacccctcaagctaagacttagtgctgtgcccctctctctagggccctcgattcttccctgacaagccccaaccctgccgggcaccttcccttgcccacaaaaggactgaagcctacaaaacagtgccctcctggtagagaaggatccatgagggctgtggggggaggtaaggcaggagagcaggtggcagcccaggcagcttccttctcccccagcgggggaggagagttcacttcgtgagccacagtgacaacagaaggtgtgtgcggtgcttgcgctggtgccccgtgagcctccctcgcttcccccacctccctcatgcctcctgggctctctggggtctccccatcactccttccaggctgtctccttctctgccccactctgtggggccccaaactccccccaccacaagtcttccttcttcagttggaaggtccccagccttgccccagactggccacccctctcctgatccctttcctcttccctgcctctactcacctggactctcctaagatgtggcctaaaggggcagttgagggggtgcacaattttgaccactgcacggtgcatggtagcaccctggccctaacatcttcatcctggcctgttcgcccatgcttgcagtcaagagccaggtcttcccctcacatccacccagcctctccctacccagcccaaggtgggagggagagggatttcttaaattctctcctgagaagatgacactctgtccctcatgcctgctttggggcccttccacacacccctctaggtggggaggtccttccaggtgctgagccacactgcccacttgctgcagctctgacccttcattttcctgtcctggggaaagcaaaataaccccttcccttctctcctcccttcccagcctctcctctctgttcccaaccctggcaagtgggctgacaggtatacctgttgaccttggctggtgctgggaacttattaaaccctcccccgaaccacttcccagcatactcttccggtagctctccctcccaacctccgcaggagcggagggggct

SEQ ID NO: 72 - DNA, 15399 bp, Homo sapiens
gtaggttctttaagcattgacgagctaaagaccattttaaattctaagcctagggaagcttacaatggaactaatcagatgtttttatgtcggtttgttccgagacagtggaagactggaggtcatgtgcttgtgtctaatgtttagcaaaatcttagtgaaacgagggcgataggaatgggggctggggaagacttagatgggataaaaagaggtgcggctggaagaactaaatcactttaaaacttctgaaaataaatgttgaccattgtagtcagaggagtaaaatgttcagagaaatggggatgattaaacaagaacggcaagccagattgagtcagaaaattatcttcctgccagaaattctgtctcccacaacggcatcagggggtggttacttgcccagggtgtagtcagtttttaaaaagcttaagggttaccaacatattcctaaatttcctgaatttgctgtgattccaggattcatttaaactcttgagactgttttactttcggcacgaaatcagctcatgggctttataaatgtagaacctactgcattatagttcttctttttgtttattctaaaactgttagtagcagccagcgtattatatgatttggattgggccatgaacaaccgtaacgagtgataaagcaccctttcctgttccaatgcaaagaacaactatgaaaagaaagtactggcaaatttatcatcttgtagttagttcctggccaaagaaaatggtaaggccattcttttaagcagttaaaaaaaaatggggatgggctcttaaactttggcatgctaaggccattcttttaagcagtttaaaaaaatggggatgggctcctaaactttgacatactaaagcagtcgtcatttaggtaaaatctaagtcttaatggaaatcgtgatttcatatctactgcagcgttagcaatcacataatgataacttaaatcagtaaatcgttgaactcggttctctaatctttgaagaatagaaatactttttatcccaaaagatgttttgagaattaaatttgcagagaattttttaggtctttagttgtaatttatagagctaggtcttttaactttagtggaaaccatgccctccaaacccaagtgactggagtcagaatgtgaaataagacgacataaaatccctatttcttaaggggctgggcgaaagtaatggaacaaaatgtaacgttatgctattgtggcagagatagctaatggaatgtttcatttctaagtctgtaatttcagtaattgttagaggcagttttccatcaataagttagatcaaatggttaaacccaatatgaatttataaaagcttaatttaattttggattgatttaccagatgtttaaggtggttataatgggtagtgttgatggtggtgcttttggaaaaatgagtattatatgcctgctcatccctttacattatcttatcatataaacttcttgattactcgttatgatactcttaaatcgtacatttagaggaaaaatcttaaagtaatctgtaagaccatttctccttaaaatgatatattatgagatgaaaggaaagataaagataatttagaagagatccagaagtggactaaatttctggtaaggagggggctaaagatgttaaaagacatcttaggaaaagcatatgatttataacttttaaaagtgtcatttagatggttaaggatttgtgtttaatagttctcttgaaaatattgttttccaaaagtttaaaagccctagctacttttatacatttgcccttaaaaaatgtacagaatttattacatcaaactgctacaaagaaataagaattctgatttttgcaagtaagttggaaatcaacgtagaggacaaaaagtggcatagctatatctaaacaaaaaagtatgtaattcaaaagttggtccacaaagaattgaaagcctttcaataactaatttaaatgatagaaagcagtatgtatatgcaagtacatatgctccctgtatagagagtggttagtaagtaagatggtagcctaactcactggaataaagagatccttggagtcccaaacctcaagactaggagtcttaatgcagttaccaggctgcatgcctgtacccagagaccatactagaggctgtgggaatcctcgattactgctcttagagcccccaacttgactgtttcttctgtacctggtacttttttcaaatatttcaaattgcagtgatgcatgggagatacatttagaaaacataatgcaggggaataaaagcagttaaaaactaaggacagtttctactgatgaaaataaaaaactgctacagcaacatcttttcatcatctgtaaacatcatacccccaaattttcctaagttattatctaacctcatcagtagcagatggtgaattatttcatagaaaatcctggaatgtaaactctagatactcaagaaaacctcttttttttcaatgaaggtatattatatttaaaataataatgatgcattaaacattatgggataaagaaaatactttccatagaaattaagcaatggcctaggcaaagagaagtaaccctttagcattaatactatcagttagacagtgacatttattgaacattccctgtgttgtgtattaagaattggactacctatatcccagtcaacaattttttctggagtttagaaatagtttatgcttattttctgtgttttttattaccaaattgttattagtttggtgcaaaagtaattgtggtttttgtcacttacatgatggcaaaaactgcaattacttttgcaccaacctaatagaaaaatacaaaatggagaatagttttcaggttccacaaagcatttgctggaaataaatatcagttgtctaaataagtagtacttgatttattactatgattttcgtagggttccatttctggaacaatatcatattaataaaccctttcagtgagaccattgtgtggtattgcccaaaaaggaaaaaaaaatgtaatgagaaaggactaaggctaataaaattccataaatactattataaagaaaagtataatttgactgagatgcacaaatgcttacttgataatgaggtgtttttaaggaaacttctattaaatactctttttgagtttaatatactatgaaacaatgttgtcttttttttttttttaatgaagatttccttgacttccaaagacctttgatgttcaagcaaaatgtagcaatttggtaaaagtaaagggtgcatttcgaactgaaataaacataatgtcctattaagacctgtattatattttatggaatttaacttagaatgtaagatattagctctgcggttttacaagcttgtttaaattctgcaatgtagggcaacagaaaatccaaacaaaatccattaatgactatattacttctttatttttctttttaaatattatatgtggccagtcaggatgaagttttttttaaactacatttcctagttggacagatcaagagtaagctccagttttgctataatctcgttttgtgattgctgacaagtctattactccctcagttcccctatcactaaaaagaaataacattgtggtaaagaggtgttaaactaccaaatccactgaaaaagtatggaaaaaggtcacagatgtggcagctttggcatcttcagaagaaaagatagcaactcaatgtgatactattggcaataccatttgttaattgaaaaaagaagaagaaagcagttactagacatccatgattttatggagaagccatattctgtcatagatgagctatttacagacattcaatggcacattctttgacaaagtgaatcatcactgtctagtctttcttgtatatgaatttgaagtattgattaaagttgtagcatacctgtaattttaaactgtaaaactctaacactcacaaaagaacattgaaagactgcaaatttctagacttggaggttataattccttctgtatgttactactatcagcttataaaattttaaaaaatgtgagtgtagaaacttatataaactgtattcacacatgaaggatagcctaaatgctccggactgataatctgaaggtcattctcacctggctgattgaactacttttattcatagaagccaaagttttgaaaggtacagatagaatcttgactaccttgcattcgcagttacgttttaattgcaaaataacaagctctttagtcactggaaacaaaacacttttagcatttaactttataatacttgaaatcctaccttgaaagcattcatactcattaaaagctcaacacatgatccatgtttacataaggatttgggtgttgcttaaaatgatcatgtaatgagctgcttctctgcaaattaatattcactcccttccctcatccttaatgtgggatctttgaaggaaaaggaagtgaccaaactaaagacatagggaaatgcaaaatcaaggtgaaaagttacccagagggttgttttaattttggccatcaaccccctagtgaataatggtaacagtattgttttgagacccattttgtggcatttacctattgttaaactaaattgactagatgtaaatatattttcatcttcagatatttagaatttctatccttccccattgtttctggattttgatactaatcttttttctttgcatattgtatatatttactcaacaactaatctaattttagatttttagcttatccacatttcatttttgtttatttcattggtatttcatcaatacaatggctctacccttcaaggaaaaaaaacatcagcccgtcccacaaaaacacatatattcaagaaagataaattacattgtgatgattcaatcatagtaagtattcaccactgaatttctttaagaataactactgtgttcaaaataatttttgtactaatatttcatttgagatattttatttctgtggaataaaaagatttatcatagtaacatcaagcttgtatcttgaacaaacagctccaaatataataatacaagctctacttcatgcattcaacatgtatttagaaacctggctgggcacagtggcttacacctgtaatcccagcactttgggaggccgaggtgggcagatcacttgaggtcaggagtttgaaaccaccctggtcaacatggtgaaaccctgtctctactaaaaatacaaaaattagctgggcatgttggcaggcgcctgtaatctcagctacttgggggactgaggcacgaaaatcacttgaacctgggaggcagagattgcagtgagccaagatcacaccactgcactccagtctgggtgacagaacaagactctgtaagaaacctactgtgttgacctctttgttggacttggggaaaatagttgtgaaccagaaaagaaaagcaaagtccttgttcaaataggtcttatattttagtaggggaaacaaccaccaaagaaataagcaaaaaaatataatttcaaatattcataagtgttaagaaaaaaatgaaacaataatgcaaggtgggaaaggagacagtgtaccttactcagatgtactgtaggtaggcctgaggaaatgttctttgagctaaggacaagctcatcaggggagcatttgattaagggagacagatgaggcaatggctttgtgctggaaaccagtatgtggttggaagggagcagggggcatctgagtagtaggcaagggctagatcatatggacattgttggccacgtaaaggcacagatattttattttaaatgcattgagaagccacaggcaggttataagcagaggattaacatgatctgatttacatttacaaggaaacctttttaaaaaatcttaacctctaatagtttataatatattgtgtattatgtttagagagatttaaaaataacttatatgatcaaagacaagtttctttttgtagggctgtactatttgtgtgatatcaaaatggaagaaatatttaacaatctatatggcatttcttacagagacttaataactttgttgcaaaatgactaaatctttgtaagagagaaatctttttctccatgaaaccttaactttaatttaagggcagtgattttgatatttaagagaagcttgaaatgccccacttaaaaaaaaaacaactctggacaacagtgaaaaagaagtctttttgtttaaatgtaattattaaataagtgtgacaaaaatagagctaattttagggatgctcagggctgagactgcttttcttcagtggataaaaatatccataggcaaatctagggacactttaaataattcaagtagtcataaaagggtctcagaggaggggacctcttctggaagaggtaggtggaaaggccatgcattttgatattggtggattgcttttcatttagaaactactttgttttccttatccagtacaattgaacagtagatgatttctactctgtttcacgggctatttctttattagcaaggttacactcttgagcacctgtggggacaactggcctgggcactttcttcgtatctgcctttatcttctctcaactcaggcctgtatgtacaaaggttaaatttgttcctactcagttaaaatctaaaggaaggccaccataggccattactttctctagagcacgcaaaggtaatctgttttcctagttgaacatgggagaagaaacacctagatgttttataccataggctccaatgtaaatgtgaataggtgatataaattccaagcaaaaagaagaaagtttgcttatcttatccaatacttttgaaatatattactatttgatggcatttggcattttataagatatgataaaaacttaagactaaaaaaagaaggccagatgcggtggctcatgcctgtaatcccagcactttgggaggctgaggtaggcggatcacctgaggtcaggagttcgagaccagcctggccaacatggtgaaaccctgtctctgctaaaaataccaaaacttagctgggcatggtggcgggcacctgtaatctcaggtacatggcaggctgaggcagaagaatcgcttgaacttgggaggcagaggttgcagtgagacaagattgtgccattgcactccagcctgggcaacaagagagaaactccatctcaataaaaaaaaaaggatagcatgccaaagttattgcgtaaattctttaaaaggggtacacatgtgctcgtgttgcatttttgttaaatatcatcctaaaacttagattattttacaacttaattataaagcttacgaatcctgatcatattgctttaaaatagcaccttgttatgggtagaaaaatattacccaaactttatagcccaccttattaatgaactttgcttctagttgacttattttatttatttatttatttatttattttggtgacagagttttgctctgtctcccaggccggagtgcagtggcgcgatctcagctcactgcaacctctgccttctgggttcaagggattctcttgcctcagcctcccgagtagctgggattacaggcacatgccaccatacctgactaattttttgtatttttagtagagacagggtttcaccatttcggctagtctggtctcaaactcctgaccttctagttgacttctgttttcaaaagtcaaaatcattttgaagatgaacatttgtcatttgttgaaaatttttaaaaatgttaaatatgttagaatatcaagtaaaaaaaattaaaattatatcatgccttttaaaaattacatgtatgcatagtaaaagaatttgggagaaatacattggaactttaataatggctatctctaagggatgaggtaataggcttttttttttgctttatatatttttttcaaaatttctgcaatgatcacaaatcatttttatttaaatatattacttttatatatttaaaaaatgtacccacagactccagactaagccaaaaataactttgtaagggtgtattaacaacagccaagattatagttttagctgttgtgatagatgatagttcataaatgctatccaaagataaattgtcccttgggaatagtatatatttgaatgccctcaaagataatattagaaataattggtgccttttcagttgaatcaaactaatgcagagcaacttttaagagtcaatttatgaaatacaagaggattttagaacagaattacaaggacagaaaggacagaaaaataattaaaatattagaagcaaagttgaaagagagtgggacgtcaggaacttttgttctgttacagtctctgcagcattgtgtctagttgtgtgtccctgaacaggtcataatttcgatgggcctcagtttctttaactgtaaaataagagttgactgaacagatgactattttcagtgccaagactttatgaatctaaattccccaaacaaatttggattcttggttttacgtgcagcagtcaatatataaatgggtccagaagatgtctttgcttcagctttggtaacactcaagtgtgctggttattgcctgatttcctcttctctatcattttcctgctcttctctgcactcttgcattccaggaatgggatgttctggctctcattaccagggatccccttgtcttccctgggtttagccaatgagaactgctggcaggaggtcagagggtagtagaaaaaagaatttgggttatttctttccccctccctttgagctagcctgagattctggtggtgatggcattcctctacaactgcgtaccctgtcagatacccgcccatggctctaactttcactgggctgcttcagatccagctgtggtgatggcatcccaatgtactagcccctgaatgcctcagcattccttgtttggcctcttaactctgcccacatttctgtaattgttctttacattagtttgtactcaaaatctccttggaactgtgccttcagtttcctgctaggacaaggtgaatacatccaagtcatttctatttttctgattcctacaactttgctcaaattcattgtttcctgtcatactcagaataagagtcaagtcttaacaataacctacaagatttgtgctgtgctcaccctactccagccacaatgatctccttgctattcttatagcctaccaatgtaccctcctgcctcaggacttttgcacttactatagtttctccttattccctaagctgtttgcatggctaattcccttatcttcaggtcttggcccaaatgtcaccttttcagtgaggacttccctgactacactatttaaaacagcaagcctccacctcccatccctctttttgcttgatttttctctagcacacttataaccttctaatatactacattatttacttattttgtttgttgtctctcttcccatactgaagtggattattccaagagggagagggttttcatctgtcttgttcattcttatattctcagagtgaataatacagcctggcacatactggattctaagtaaatattatgtaaataaatgttccatttttacaacatgctacaacaattttattcaatatttatgaaagtaaagtaataaacatgctgaaaaacatggaacattggtaaagtgggaaattccctgcaatgacagatacttttggaacatgtcttttttttattgtttttgagatggagtttcgctcttgttgcccaggctggagtgcaatggtgtgatctcggctcaccacaacctccacctcccaggttcaagcgattctcctacctcagcctcccgagcagctgggattacaggcatgcaccaccacacctggctaatttttgtacttctggtagagatggggtttctccatgttggtcaggctggtctcgaactcccgacttcaggtgatctgcccacctccacctcccaaagtgctgggatcacaggtgtgagccaccgcgcctggccaaaacatgtcttttataaaggggataaaagagagatactattttacttacaagataaaagtttctttacctttttattgatgcattttatttgttgcaaaattttcagaaaatatgcaaggtatgtattggatcatatgttgaagtccttgagaaaataccttatttagtatttagaaagtataagattaaaatcttgatcaagagtacgcattactttgacactagctattcttaatcgtatttaattcaaggcacattgacatattttaaatatttggtataatggctaaaataacatttcctttgcatagaaaaatctaaaaaatatagacactgtaagggtaaaaacttcttatttagttttttaaatgtaggtctatagatatgtcactgtagtaacaaagtattaggaaaagctctattttgaattcatagagtctaaatgctattgattaataatgaatacttagattttttaaatgtcttttatagactcattgggctttgttttcttcatctgtttggtttggctgctctcatttacatacttgctctcattagggtttgaatttcagagctggcctcactctgcgatgagaacaaatgtcttgccatgtgatactaactttccattacatgctgaagcatttgcagtcccagaggcaaagaatttatggttggtacatgagagatagaaccatcacataaaagaagccaaatttgcaatcatatttttccttagtgctaatatagtttcgggataatgagaactcagaataatcagctaatgaccagaaatgaatcattattaaaacactgtttttctggcataaaatagctaatgtttctagttggttgataattttcttagcaaccatggtatttggcacgtcctaaaccacttttcactagaagccttcagaccccactgaagcagttcattatactctgaaacagttctgagaatcagggagaataatatacaagttttgctgatattctatagctgtatagccagtatcctgtagcaaatacttaaaatttcctacaagatttctcagtaattctccagccaagtaggaaattaagtagatgcagcagaagagattaaaaagtattggaagtcgatccccaagttagagtttggtcagaatttcaagcttgttttattgttttttaaaaagtaaataaacaagttgttttatactttaataatagggtcaccattaatataacatttacatggcatcatatttccaagggattctgtatatgtcccagcttcttgttattactgactatgctctgtgagattttttggcggcatgtattactttggttttggccagaaagtcaaaggaaaagagtattgagaatagcagccaataactatgaaaactcatcacagatttattcatatatctggtcataccctgcacacatatagcactgtatggttgtcaaactcttggcatgcatgatatcatttgatctttataaccctatatctgtgtgaccttgagcaaatcactcagcccatggctgtgactcctgtttggaagctgggtttaatagataccctctcctaagtctataggaatgcttcagaattaataatagagtagttcaatgcattgtgaactttgtaaaagaaaggtattattataaatgcaaaattattttattcacctagcttgggacactaaaatttagggagactaagtgagttggctctaagtgtttaaccacattggtcccaggaaacacacagaaccatggattaaaaggttgatgttttctagtttagataagaagcatgagattttatcataaagggcaaaatactgctcataagtagagaatattgttttctaaagaatataaccaaatattcattctgaaccatgaactcactaatttaatttaaatgtgtcaaacagtatgattttattagttattgatcaatattcaggctacatgtaacaatggatgacaaccagttttcttgaaaagatatccaatttggaggcaattaatcccagaattattatgaattacataaactgagaagataaattggtaatatttctgatcaaaataatattttccaaatacatatattttctgagtaatattgtataaacaataaagtggtcaaccttgtcactaatgtttcatatagctcacatattagaataaaacctacttaagaacatcagatatttgataagatgtgtcagtttcaattaagctaggttttgcaccagcctaataaataaagaacaataattcagaagctaggaaatgtaatttcattgaaagatggaaaggaataagtatctagcatgagccaggcagtgtggtaaatacattttaaatgtgactttatttaatctctacaacagctctgtaggataaacattattatctctaatttagagataaagaaatcgaaccttcaagagattgagggcttcctcaagagtttgtaaatcagagccatagttgacctggatctgagtgatacccaggtatatgttctctccattactccattttataatttaggaaccaccagatcagatgttcccaaatttgtgaagaggaactacattctggttttttgttttgttttgaaacctcatattggtggagggaggggccaggagaaagaggttgaacctgatgtggatgaatgtgaggataagggcccctgatagtgaggggctacaggcatgcgccagcagggccggctaattattttttttaaagctcttgtagagatgcagttcctcactttgttgtcccaggttggtctcaaactcctgggttcaagcaatcctcctgccttggctgcccaaaatgctgggattacaggtgtgaggttcttcacaggggaatgaagtgagcagaaagtagctgcttgccaagtgaaagaagcaatggaccaatataggctttgaggtgcacttgtaagctggtgtgttgggaactgccgacgtggttagatgatgctctctgatggtctttctgttatattaaggagtagagatttttaaatattagataattttatgtttctattgctaaattggggttgagggggatgttggtctgtcattctatttcacttcaaatgaagatgcatttttatctggaacgtatgtggaactgtcttggaatttgactctgccgggtcagattatgtccacacagcatacaagcaaattcccaggataccaggttgctgtttgaggttggctgctgctaattcctctcctagagaagaggacactctagttctagccccagctctgcaactggcagatcacctcagctctctgggcctctgttcttcctcctctgaaaaataaggaggctgaactagacaattcctaggcctcactttcagtccttctgttctgcagttccatgagaaacagaaagcacagcttatcctttaagccctctaaaaggcaaaaaaaaaaaaaaactaaaacaattatcttccatggtaaaactgtctgctatatacattttaatgttccaaaggattaaagtccatcaatcttgtagacttgttgggaaacaagtcggttggcattttcatagactttttatttcaccgtgttttagcattattagaaaatttttctgtagaggaaaattttgctaggagttaattcaatttttttttacatctgattttgaaatttaaagtaaatcacttgttttgagtatcttatgtagacgctttttaagccacaaataattttgtcaaacttcgcaaaagtacactctgccctcagaagttattttaggtacaaattacttgttatgttaaattgaatagatgaaaatttaaatgctgtaatatttaagttattccaacatatacactttgatgatgaatacatgctaactggaaacattttactgtagtcttactttatgcttttctactaataatgttcataaattcatgaatgggtggataatcttggcaagaaaatgaaaaggcttttaattgtgtaaaaatatggatttgtcttcttctggagttgttgcttgctcagcagacacgtgttgagtcctgctaacttgacaagcactgcaccacttgctgagattacaaagataagtaagatatgctctgtggctctggaaaatcaaaagctagtagaagatgcctgtagttcatctggaaaaagagagcttataaagttttttctacaatatgacctcatttgaacatatggggtgcagttattattttccttattttacacaggaaactgagtctcatggaggttaagttataatgctcaacttgttattacttgcccagtatctgttgtcccttaaacaaggactgggaccatgtctatctttttcattctgtagttccagtacctagcacagtacctggcacataataggtgttccatttgagcacctatttgatggattaataaatccatcaaacatatttgatggataatatctccaacaaatattggatcataggaaagcattactagcattagtcttcttactcttgaagtaagtactctttcactatgccttgctgcctctgtaattataaacctgtttagtattaacaggatgaatgcttgtggtatggaaaaagagctatatatgctgcctaattttttaaataaggaaagagattgcctttgaaaggtagaggctgaacacccttggaaaaacaataggataaatcccccagaactcagacatcttgatactcaaccacaaaacattcttttctttatgaagaaataatttggtcatatgtgtcaagctttctcattatttagtggtttggaatcattttaaattggccattagaagtaatggcagcaggtttgagggtctagaagtattatatattgtgtactttatcagtaatttttatgatatttatgaagctcagtatggctgatgttaagagacagggttattagcacttcagaacataagaatggaatttaaaatgaccttagaaaaattgagaggtgttgatcctaaataggaacacatgtggggagaaaagacaaatgcactgtaactgcagtatgcaactgtgtcagggaggaatttagaagaccaaattcagaatcacaaagtattaataattcttgtattacattcttcagactattactggaatactatggtcagtctcagtcccaccagtttaagagatttgtaacaaattgtatgagatttagagaatatagaaaataattaaaggttagaaatttaggaatgtgaaaacatagaaaataagttgaattttagtcatgtaaggtctcaaaatat

SEQ ID NO: 73 - DNA, 2027 bp, Homo sapiens
atgtgcccaaaggctaggctgctttgtagctggagtagtgcccctgtggccagggcgggtaggcaggggcagcctcagagttgatacccatgtggaagggtcagcatctgctggtccctggtgggctccgccttcaatgtcagggctaccacttggacctgtttagtgagcactggggtctttttggatgtcctgagctcagcgctccagaaaaatttaatattgcccaataaaaagccttgagaaagacagaattgcttgtggaacatgcatgttccaccccacctggaccccagattgtgcgcatcttcgatgagctctcagattccttgttcagagtggctgacttggatgaacacaaatgtggaattatgtcaaagtttgcaaaaattactagctgattaaaaacaaaacaaaaactaggcaagtggcctaactgtttatgtttgattttgaaattagtggaatccatctagacaaagaaaagtgtaaaagagcagtggacctcaatgttaaaatcttggatttgagtagtacatgtcttacggcaaacaactttcccaacaagattgagaagcatctcttactagaacacattcaccataacttttatctgatggggatcgtatcataattgatggtctccatgcagaagcaccaggcgacttggtgtgagaagctgcttacaaaatttttcttcatccctatactggtcagttaaaatgtttagaagaattgctcagcaacagagatcctctgcaaaagttggtagggtattctgtgttttccagcagggctctccaaggaacaatagttaaaaattcagagactgtcatccagttccctgagaaactctctgacaaactttctgaaagaacttgaaaagattttgagatgatacgacagatgaaaagtgaaaaatgaaacagaattctcaaagttccaaagtaatgccttgggacccccactaccagagtggtgtgattcatgcacaaaggtataatattgaccctggcttatattgcctgtttttctcccttggagcatgcatggaaggcctgaatatttggcttaacaaactgttggagatttccttatatgcagagtagcctgcaaaaggagaggtatggtgtgaagatgtccgaaaactggccatcattcatgaatctgaaggactgttggggtgcatttactttgatttttttcagcaagcagacaaaccacatcaggattgccattttcgaatccacagaggcagattaaaggaagacagagactatcaactcccagtcatagttcttatgctgaatcttccccattcctcaaggagttcacaaactttgctaactcctggaatgatggaaaatcttgaccatgaaatgggacatgctatgcattcaatgctaggacgtacttcttaccaacacatcaccggaaccaggtgccccattgattttgcaggggttccttctattctaatagagtactttgcaaatgattattgagtaaccagtttgccagacaaaattagaatgggcagccactgccaaaaaaatatggtgtctcagctttctgaatctaaaaaagtttgtgctgcagctgatatgaaacttcaggtcttttatgcccctctggatcaaatctaccataggaagcatcccctgaggaattcaaccacagacattctcaaggaaacacaagagacattctgtggcttaccatatgttccaaatactgcctagaagctgcggatcacctacctcatgggctatagggccaaatattactcttacctcatgtctagggcagtcacttccatggtttggaaggaatgttttctacaaaatccttttaacagggccaccatggagtgctattgcagggagatgctggcccacagtggaggcaagaagcccatgctcatggttgaaggtgtgcttcaaaagtgcccttctattgattactttgtaagtgcccttgtttctgacttggatctggactttgaaacttttgtcatggattatgaa

SEQ ID NO: 74 - DNA, 1773 bp, Homo sapiens
gaataaaggaaattatttgcaatatatttatcatataaagaacttgtattaatcaataaagacagacaatcccgtagcaaatgaacaagacacttcacgaaaatgatattccaatgtccaataaatgtatataaaagtactttatttccttatcagagaaatgcataccatttcaatgttattacaattacaatctcaccagaatggctagaattaaaaggattggcaacacaaatgcagaagatgccagcaactggaacttttttttttccccagatggagtcttgctctgttacccagactagagtgcagtggtgctatctcagctcactgcaacctccacctctcaggttcaagcaattctcctgcctcagcctcccaagtagctgagattacaggcactcgccaccacgcccggctaatttttgtatttttagtagagatggggtttcatcatgttggccaggctggtctcgaactgctgacctcatgatctgcccacctcagcctcccaaagtgctgggattacaggcatgagccacagctcccggcagcaactgtaacttttgatgcaggatttttcttctcggtcactttgcaaaccgggacctccggccagcgatgccccacccgcgccctgctcagccacgctggcatgccccagctcgcctgtgttatagcttctatccgcgttcggcggttcccaagctcttgtacccacgttcggcggttcccaagctcttgtacccgcgttcggcagttcccaagctcttgtaccacgcctgagaagaatgaggatacgttggacattgaagggtgaagagggcggagaagaattttattgagcaagggaacagcaattagcggagaagggactctggggggtggtcgcccacccccttagtcggatggttttttcctcccctcgtggctgggtcacgagctttttataggcttagaataggggaggggcaggtcataggtagtattggaaaaggcaacgcttgatcggttaaaacgcattatttagaaataattaatcaggaaagagcgggggcaaaaaggaacagaaatactcagcctgtgtcgcgggtttcatctgggaccagcagttcagtgtttttggctggaaggtggggtttcaccccatcctcctgggcatttagcagcctccagccgctctcactttcgtgtgccatggacgagatgataaactgagattgtagaggagttgcagttcttggcagtgaccaggtctagagaacgaccactgaggggttgcttgctctgatggaaacgttattcctaggcttcatttctgaatatggatgtcccactgccagctttgggaagccttcaccatctctgcctatacagatggacacactccctgcctgtgctgctgctagactgtgcttacacttccatcacagaatttatttgattgggttatcatggcttctctgctggaatggaagctacttgggagcctggggaaatgcttggctcaaagcacttctgcacttctgatggttggatgactccactgagacccaagacttaagactcacctggtcctatagcccccacccagaagtggactcagcacataagaaccattttctacatctctatgattgcacccctgaccaatcagcagcacccattccctagcccccagcccacctaactatcttgaaaaaactctagcctccaaattttcagggaatctgatttgagtaataaaatcaacccatctgttattattagtct

SEQ ID NO: 75 - DNA, 1093 bp, Homo sapiens
acagagtctcactctgtctcccacactagagtacaggggcacaatctcggctcactgcaacttctgcctcctgggttccattgattctcccgcctcagcctcccggatagctgggattacaggcgtgcgccaccacacctggccctacagtttcaagatgatgggatgacagcatttctaccttactctctgcctgaaccaaaatgaggtggcaaagtcacaggaacagaagtcctgcttttggtgagactacaagacacctggaacctgaatcacagtgtagaagaacgtcagcagacagtggacgcaaacatgaccccacagagcggacagtctggagcagccagtggatccctccacatgacctgtgtgaaaggaaaggaaaatctcgagaccaaactcaccatgccaaagggaactgagtcatgcaatgcctgcctgccttctgtttccagacagctgtgatccccatgcctgcgttatcgcatgtcaaatgtagacctactgagcgtgagacagatgcatgactggctttcccctaactctgttctttttttttttttttttttgagatggagtctcactctgtcatctaggctggagtgcagtggggcgatcttggctcattgcaacctccgcctcctgggttcaaacgagcctcctgcctcagcctcccgagtagctgggattaccggcgcatgccaccatgcctggctaatttttttggtatttttagtagagatggggtttcggcatattggccaggctggtctcaaactcctggcctcaagtgatgtgcccatctcagcctcccaaagtgttgggattacaggcatgagccaccatgcccggccggctccattctttacacaggtgaaatgtagattctctgagtgctaatcagagcctcatgagaatgtggcctctcacctgtttgcctaccctctttgtttcccttttctcctttctcttgaaacactgaagtccttaaaaccctctttggtaaaagcacaggacacagattctattgtgccttgagtttctttttcccgggcacatgctcaacctcagcaaaataaatctctcagccgat

SEQ ID NO: 76 - DNA, 21562 bp, Homo sapiens
gccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 77 - DNA, 1473 bp, Homo sapiens
cattaatttataatatatatttatttataatatatgtgtgtatatatacgcatatatacatatgtatgtatgtctatatctctatctttcgggttgttttgagaattaaatgacctaacccatgtaaagccctgtgtaccgtgcctggcatgtaggatacttcatcactgtcacctgtttttgttgttatgacctgagcatctccctgttcaccagcccttgttctttagccacaggttgaagatgacagtagatcctaaggaacctcagttctatcccgaaatgcgaaggcctttttactcaaccacaaagaagtggtcagcagaaaactggtcatcccggcctctggggccatgcacagcactcaggaggagctactattttccctgcctgtttacatgcggcctggggccttgtgggctatttgaaaattaggacacgagaagtccaagcagcacctggtaattaaactgagtcctctatcagagagaggcgtgaccttgaagggcatccatacaggagccaggggcaaagcagaaggtgggagggattctccaggcttgaccctctcagcacatctcagtcaggggtgcctggcagcctagattccagccctgcccagtgccacccagagacctgagggaggtggacagctgctcagctgggtgatgggagcctctagaaatagttgtcaacctcatcaaaccagagatgagcccttaggacagccagggtgttgatttccagccaggcagggcattggttctccagtgggatgtggacaaggttcactgcagcctctcagcagatgaactaggggagagacactaccccaaccatgctcccccgacccttcggtgttaagtgaaagtatcttccttttttctctctgctctctccgctttacaacaaaatattatctttagtctgcaaaaccagggccaggaagaatcttcacagctagacagggccatggaaagatgatgaggcatatcaggaactatgtaatcttgtaatacttctgctgcaaaacctcctgacgttctgaatgaacagtcacatgcagcctcttcagtgcaaaactgagctcataagaaagtaaagcaaatctgtaggggccaaatgaagagtgaactggaagtcagagcttcaagtacatgactgatgtggtgtatcccttggggatgggggtgtacacgctggttttgggaagcagggcacttgggtttgaaagttcatccaggacatttgtgtgactctcagtttttgaatattggtgaatagtgctgcttagaacattctggtatgtgagtttttgttgcacataaggtatttatgttgaacaaatatttaagagaaaaattattgaatttaggtatgtataacctcagatttggagaatactgctaaacagtttttcaaagttgctgttcattttaaataacagcatatgggccaggcactattgctcat

SEQ ID NO: 78 - DNA, 3267 bp, Homo sapiens
agattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccttgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagccactgctctgtggaacgatgatcatttaaatgccacgtcgatttgaaacgtacaacaaagggactaacagttgagaaccatgtggattgcagtggagacgctggcgttagagaatgcggggagggaaacgttcattacaagatttacggccagcccaagggggagcgaggctgggggaccgggtcgcggagacccggcttcgcacaccttttggaagactcagggagaagcgggggccgccttcggggggaaaggcgggactggggagcccacaggccatggctcctcccacaggatccccaggccggaggcgggatccccccatgatcctcccgtggcccccgcacaatctggggagatgcggagctgcccagagagggctctggggcgacagtcactgcgcagggacaggacaggactcccggagtcccagctgccggcccagccccaccctgcggccgagaggaccgagggccgagctgctccaggggaactcgggtcccagaccccggagtcgcagcggacaggcccgggtcccgccacagccagatccggctggttccaccagctcctcctccggtctcgggacgtccggccccgcacactcagcatttccggcttccgggtgtcccggcgtcctcccctgggcctgctcacgtcgcagaggggcggcgacggggattagaggggaggagggcctgcgcgagcagcaaagaccccaaaccccaaaaaacaaagaaaccgccagaaactgaagcttccacagcccgccacgtcccccggctacggctacgctcctgattggatagttagtacggcccctagtgcccctgattggataccgcttcaggtcccgccccctggggttagaaagacaggagacccgagaagacacttggctgcgtggagcccaaatgggcggttcctggcaactgggcttgttgtcttcctcgtgtcaggatgtaaaaagaaaagtagaggttcttcttcaaagacttccttcttcatctaattaagaataaatagtgtttgaaatgcttggtttttggtgccataaagaaatagcactttaacattaatttatttagcaaggccatttttactccctgcagaaagggtacactcgccagcagttttgccacgagcgtacaccgagcaaaggagacagggtcatttataacctgaggtgtccaccctactgctgtgtccagtttccattggctggaacgggacctcacattctgtgtttgtcctgattggctagcaacttagaacgttttaaaagaggcaaaggtggaggagaacaaaggaagaaggaagtaacttgtggaatgctgagaaaggtaaaaacaccttcaaataaggaagaggaagaggctatgacttaatgcttgcttggaccagtataagcataccagggcaaatatttgggctaaattgtggg

SEQ ID NO: 79 - DNA, 918 bp, Homo sapiens
tctccttaaaatatggtcttgacttggtttccagggcaccagggtcttggttctctctcgctcacttttctgtatctctgatctctagtgctggagggcctcaggattcagtccttgtacatcacctccactctagttacagtcagattccaggtgatgtccccgcaattctcagctgaaattccttctacatactgatgactctgtatttccagcctgggcctctcccttgcatagccagctgcctactcaacactgctattgaggtatctgatagattgctcaacctcactatgcttaaaaaccaaatctctgatcaccctacccaaatgtgctttactcgtaaccgtctccatttcagaaaaaggcaattccatttttccagctcctcaggccaacatttcagattcattttttactccgccctcttttgcgtcatccaatcttgatcaaattctaccagcttcaccttcagaacacacacacactacaatcttccctctcctcactacctcccctacacccatcctgttgaagcatatgtcatcttttgcctggataatttcaataggctccaaactggtctccctgcttttgcctgtccttctgcagtcttgttcatacagtagtctgtagcagtccttttaacacaacagtcagtttgtttcattcctcttctcagaactctccggagtctttctcttccattcagaatataagaccccatgtcctgcaaccactgctgctctgtgccctccacttccccatggctcctaaaccctccacactcactccactcaaccacacttgcttcctggacacaccaaatactctcctgcgccaagccttgtcacttgctgctccctgtgtctggaatgcttttccatcaagtctctgttccttcatttcttcaagctt

SEQ ID NO: 80 - DNA, 4003 bp, Homo sapiens
acttttcactcatgagattggcagaaacctaaaaagacgatgatattgttagagacagtgtagtgctgtggttcacatccctcctgctctggacttaccagctgtgggaacgtggacaaagtgtgtaatcctctgtgcctcagtttcctcacctaaaaaatgagtgtcaaacccagtactaccccacagagtcattgtgagggatcagtgtttagaacagtgccccatgcagagcacacataagtgtctgccgtgactattactatttagctgacgtacctgaggtgggtgcgcaggtgtagaggaaagacgttcacgcctggccaggagtgtgaaacgtagacagccatttcagagggctcttgatgtttcaaaactttcaaactacatacaagactccccccaaggtgccccctctaaccctgaaattccacctctaggaccctgaatcccttggggtcaaacatgtttcagattttcggaaggtaacttggcgcatatgccccatcctgtgttactcttccccggggtctggggctgccccatgctgtagaccctctggggtgttcagcccacctcaagtgcaactggggaattctggggagtgaaggcccttcgggtaaccctcagctggtagagcccaggggcaggtgggtaagcgcccagcagcctctagtccttcagagaagcaccccacattgctcaggaggtcctagagaagttgaccgccccctcctgcagtgccctctgcagtgacctccgtaacgacccttgtattatcttctcccaacccccgtctcactctccccggttgctccctcctggattctggtgtcaccttccaaaaaaacacctgcactcaagtcctgtctcaggctttgcttttggggaactcagcccaagacaaccccctgatgaaacacattatttcttcagcaagctgcacacatatcacagcaagtgggagaaacaaaagacgctgaacactctcacgtcaatttgggtcaggtttgctggcaaataggtagaagaaaagacgtatggttctgggagcatttgggtttcatggctgtggatatgggactggactgcactctgcggagcacaaaggcaacctctcttgctgagttcactcggtgtgagtggagaggctcccccggccacggactgcactcagaaggcctgagaccacagcagtcaccaggagttgggccctccaggagctgatacttgagtgtagaagatgtctgctggggctcctggcaacacttgggaagggagccctttgggtggggagacaaggccacaatcgatgggtgctcagggatggccccgctgcagaggtgaggtctgagaagggacttgacaatgagaggaagcctaggacgccagcaccacctccacctcgccaccacggcaggtgctcctgatgggtctcagggcgagcgcaccctctgccagtgacaggtcaggtgtgggctgtgaccagtctcagccaatgagacatcagggagggcccgcaggtggcctcgggcccggccagcctggatgctgaggccgacctatgaggctgactcgaggtggggaagagcagaacaggcaaacggccagtgctcaccctgctccctgccaggcagcactgtggatgggcttgtggcccacgtgagactgagcagggatttctgtcacttgcggcagaaaacctcccactggctagcaagcacctggtccatcccaagggacagactgacaggctatggcttgtccccatcatggaacacagcagagcgccgaaaagaaagagggggtatcctcccgtcctgaaaaggaaccagcgacgagagatgtcatctgttctcaaccaggggtaattttgctccctaggtaggttgccaggttaaggaaataaaaatgcagggcagccagttcaagctgaatttcagaccgtgcatgttaactagatgtcctgtatttactgtggcaaccttacccccaggggacatttggcaatgtctggaggcagttttggttgtcactggggatggttaggtgctaccagcatctggtgggaaggcaccgggggtgcttttaaacatttcacaatgcataggacagctgaggccaaaaaaaaaaaaaaaaattatccagcctaaaatgtcagttgtaacaagggtgagaacccctgtattaaatgaaagatagcaaaaaccccataagaaccccataagatatggtaggatctcatttgtacgtcctgtatttactctggcaaccctacccccaggggacatttggcaatgtctggggttgttactgcggatggggttgtgtgtgtgtgtgtttctttttttctttttacacacccaactaagccatagaatcgcatagaaaaaggtatggaaggtcacatacctaagtcatgtggggtagggagtggtcattccttttactctaaataccttctgcagtgttttattatttgtgaagttaattataactgaagtgaatatatacgtgtatacacacacacacagaaagcatgcctatcaaaacaatagatatttcacaaagtgaacacacccatggcatggcctcctgatgaagatgaagaacatggccactgctccatgaggccctttgcagtcctgccagcctctccctcgagggctgcgaggggaactgctgtcctgacttccaacctgctttgggctccacatgaaccgaattctgcccgacgtcctcgcttgagactggcgtctttccctcagcaacgtgtcatgattcattcatgtggatcggagcagcggttggatcattttcattgctgtgaaatacaccacaatggatttatgcattcaaccgttgatggacatttgggtcgtttcccgtttggcaagatgatgaagaaagctggtatgagcattctttcacacgtcttttcttgggcatatgtactcactcctgttgagtgtaaacctaggaatgaatcgctcagtcatagggcaaatgtgtgttcctctttcctagataccattcgagttcccaaagtgcttgcacgggtttacgctgccatccaccagagatgaaagttccgcctgggctgctgcctcctggccaagcctggctgggttgtagcttttgcgctttagtccctctggtgggtgtgtaaattgctaatcactgtgattttaattcgcatttccctgatgatgaagctgagcactttttcataactttatgggccatttgattgtcctcttttgtgaaatgcctattcgggccattggtccatttttccatgaggttatctccgtttctctcattgatttgtaattaagagtcctgttgcaaatctcttttcccgctgtgcggcttcttgccttttccttcgcttacaacgctccatgctgtcctggaccctagcatcacccaggcctaggtaatagaagggtggcttttgtaaagcgactcaaggctgagaagggaacagacactcttagcacaataagctacaggctgaaaaacagccggaggtgaatctttgcagcgtgaatggtctggctgtcttttataaaagtaactcgattggactagaccccatgagggactctgctcctccgctcccctttccctgaggacctaattccccactgggtcagccgcagaaccagatagagctggggactcacgacccgtgctgacgactggatgcaagaggaggaaggactttggtggagagaaggaatcaaaaggaaccaagaatgtgagacaagaggacttgctggtggggtcccctgctgtgtccccagagtcccagcatgtgcctgacacacagcaggtgcctgattgatagtgacggttccccaaaggctgctggagtcacctctgggattctgcacaggctccaccctctggggaggtgtgcttggtagaggacacgaaggctgcttgttggggttaccttagtacctgggtgaagagtaaaaagtaattaataataacg

SEQ ID NO: 81 - DNA, 987 bp, Homo sapiens
ggcaacctactcgggttcccttccatggtgtggaagcttagttcttttgctattcacagtaaatcttgctgttcctcgctctttgggtccgcactacctttctgagctgtaacactcactgcgaaggtctgaggcttcactcctgaagttagcaagaccgcaaacccaccaggaggaacaaacgattctggacgtgccacctttaagagctgtaacactcactgccaaggtctgcggcttcactcctgaagtcaagtgagaccacgaacccaccggaaggaagaaactccagacacatctgaacatctgaaggaaaaaactctggacaaaccatctttaagaactgtaacactcactgcgaaggtctgaggcttcactcctgaagtcagcaagaccacgaacccaccaggagcaacaaatgactctggacgcaccaccttttaagagctgtaacactcactgccaaggtccctggcttcattcttgaagtcagtgagaccaagaacccactggaaggaactaattctagacatgctagttcccagatcctgtttctctggagaggcctaactaatacatagacaaagccaaatgactttttcccctctctgaactttgatattctttaaacatttccagctagttcttttaatatttcttgaggatttcctgggattttttttttggtaaatactgtatttcaccagctactccttcaagaacatagtcgtcatatgctttattatccatgaagattattagtgaacccacagttcgtttgtcaaaatgactctaaattcgtgatattcagatgatcacactccataatactgccaccagagccaagttattggagttactactttttatgatcagcacaattatttttctatgaaagaattgttggtattaaaagggccacagtagactatttgctattgaatgattgttggttagtacttaattaaaacaaaaatgttttttata

SEQ ID NO: 82 - DNA, 1916 bp, Homo sapiens
aacactagccgccaggagcgttgcttctcaacctaggattcccgagggtctgtgccactctcatctggccaggagcgccctagcttgagatccacgagccgagagtagggcccacttccacccctacccctttttcccggggaaagggaaaagggaccataggcccgggtggggtagaagctgggggtcatcacctgtttaaagacgctgccatgtcttaccttgatgtaagacgacgtgtcggggactgtctgaaacatcgtgggtagctaagggtcgggaacgcccaagaaccagcctgggagggagaagcctcggttacccgcgagtggagcgagggagagacggtgggatggtgatgaagtggggatgcagatggagagactgtaggggtttgggaagctcagatccgcctagtccggcgagggagggtccgagtggttgggtgttgagcactctccctacgcctcagtcccgtccccgggcttcaggccaggggacggtgagaactgagagccacctcacaccattgggtctcctccctacagtccttttactctcccctgcccgaaatcagactgccgcctcccccagggcctgggcagtttcgaactggggatgcccgcagcttgttctggaaaccaggatgttctagttcttggtgcgtgttgaggagagaacgcgaccaggacagaggaggatatggccaactccctttgtcacctggagccttcaattcaccggaagaaaattgctgaaattggcaacagctgccatgaaacaggagcaagagagaggcagctgggggcagggaggactcattaaagccaacttacccctcaaaagggagaatggggtggggagggggttcttgccccacagttatgctccctcgccagcctataccaagctgcttccctgggccatagatttgcaatgcagagcctgggtagaaagagactctcgtgtggaggttacagcagcaagagattggaatccaagaagggcactccagtaggagagcaggagaagatatctgggcagtgcccctctgaatcatccatgcactccatcattctgagcaagacaattaggacttagcttccttctttggcaaatgagagggctacattatatcatcatgaaatactttcaaatttgaacatgctatacttctgtaagattatttagcccggggaaaggatatgaacataaggcaaattaatgttctaggattaggaactttgggttccagtcttggttgtgctcctgatgacgggcactatgggctgaattttatcacttccaaattcacaagttgaagccctaagctccaatacttcagaatgtgacgctgatgggatacagggccttagaaagggtgaacaaggtaaaatgagatcatagggtgggccattatccactatgactggtgtccttataagaagaggagattaggtcacagacatgtgcgattacagaggaaagcccgtgtgagcacacagtgcaaaagcagccaccgactagccaagaagggagacctcagaagacatcaacttgctgataacttgatcatggactttcagcctccagaacttcgaggaaatcaatttctgatgctccagccacgaaatctatggtactctgtatggcagctctagtaaaccaatacaactgtggaataatattttgccatgatttggtttctccaagtaagtaaaagggaataaacaatggtgactcgtttcactcaacccttctagaacctactctgatgatcagtatctattatgaacccacaatgtgttttgttttgtttgttttgctttgccatgtgtggctttgtgtataaagcaaagcagtgctcctgtctttatggttcttttcactccacataaaatccaaaaccaccctga

SEQ ID NO: 83 - DNA, 2165 bp, Homo sapiens
agatggccacctcctccctgtgtctacacgtggtcttcactcctcctttgtcatcttaatctcttcttctgataaggacacccaccagtctgaccatattggagccccgccacgtgagctcagttaactgtacctctctagagaccctatttccgaacacagtcacgttctgaggtatgggtgagtaggacttcaacctatggttttaagggggacagaattcatccagtcatagtcaccaagcttccctgaagctctactagtctggcatagagaaatcagagtgaaccaagatcaaaatctgagggcaaccttggctttccccttctacacagaattggatgacagctaggagatggatctatgaattttctcccctgagaaaccagacgggaccacctagagtcggtctccttcccccaaacgccctggacctaccatgggcacaagctggggctcagggaatacctctgtgctccaccactcagcagctgcttttcaagagaaggaaaacactactacacgccatccacagccaccgcacaatactgtatccctttgtcagggataataaaacagacgggaagtcactctggaacttactatggccttgggtcaaaggcaggctgaccggggctggcagaagaaagctaaaacttacttctctgggattctaggaatttcaacaaatgagaccaacagcagatagtttcagattaaagaaaggcaatgtgttcccaaactttgacccctgtgcacaggctctgcagaaaagctgtcactttgcactcagtttccttataggtaaaatggggataataatattgtctgtctgcctaatttgtacaaggctcttacaagagggtatagcacaaagtaagtgcttaataaatgtgagcttttctttgtattcctgtttcatagtatttgtaactatttcacaagattcagaaaccttgtccctggactgtgatcatcgccttttcttcagtcttccattcacagacccagcctctggtgggcagtcacaacacagctggccatgtccagagaggtccaaaaacctgccccaggtgtcaaagcagctaagaaacagggccgggtgagactctgcctgactctttcattctgccaaatctaagctaagcagtgattcctatgcccacctgggaggggagaaacctgaggcccaccttgtaaatccctacaggctcagtgtgcctggcattgggatgggcagaggagacagagggaatgccaaaaaaagagcagttacaaaggacagaccacaggtccaggatgaggggactttcaacggcttgttcgtggttccgtttttgcccaaactctctcgatccacctttgagcaacagtaattatctctttgcctccatcaactccatttaccatccctgtccaattctttcccaataagccagagaataagagtgcagacattaaaggtcagattttcatggtgctgaacccatttaacccagctgtgtggctttgagtaagctacctaagctctctgagcctccatttcctcgtgtgcaaaccaaggaaaatactcacctacttattagaaggaaagaaaagactgagtacctgccatgtgacaggctttcaacaagggaccacctcttgtcataaacaagaggcacatgaacaagtgaccacgggtttaacttgtacacaggtattatgaaaacaacaagtctgcatttcaataaatatttgttatataaatgaacgggactgttcccagagcctgctgcttggaggaagctagggaataaggaactcaaaaacaaggtaagaatgtcagagcagggaagggaagggaggagggagggagtcgtgaccttgggtcaaaggtaggctgaccgatgctggcagaagaaaacttaaacttacttttctgggattctaggaattccaacaagtgacaccaacaacagatactttcaaattaaagaaaggcattgttcccaaactttggcccctgtgcacaagctctgcagaaaagctatcactttgtactcagtttccttgtagatcaaatggggataataatattgcctgtctgcctaatttgtatgaagctcttacaagagggtccagcacatatagtaggtgctcaataaatgtgagctcttctttgt

SEQ ID NO: 84 - DNA, 1357 bp, Homo sapiens
catatgtataacaaggcttttgggctgatttccttttgtggtgactcagaacgtctcctcaatcattatattgagaataaaagtaaaaccttctaagattttgctcctcaagaacatttaggtcttagtataatgttcttgtagattgcaggccccccactggttaatgcttaccaacatgttcacacttagcttcactattttgcatttttctttcttccttccttcctttcattctttttacttgttctatgaagaggcctaacttgaaaatgtgacatatggcaaatagagaaaattattcttgcaaataaaaatcatccttttaaggaatccctgcatgtgagtatagggcagaagtggcaaacaaggagcccataaaccaaagtaagcttaaaggcagctgttatttgactattgccagaaaataaaaaataaaactatttaagttagttattgacagttaaaaattcaagagattttatatgaacatcagtatttctggcctcttttggaagattctgaatatctggcagccctaggtctgcgttcacgcatgtcaacacctgttggagctctgtagtggctgctgctgttagggcaagcttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacacctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgaatatatactttatattgttatcattacattgtttaagccatgaacattatatcacaagcttttccatgttgcta

SEQ ID NO: 85 - DNA, 3054 bp, Homo sapiens
caccatgtcattaagctaattgaacaggccaacttttctcaggaaggcggtgatggcaggggagcaggtaataataactttggatttggcaattgtcattcacatcctgaccgacctctgccaccgttcttttctggaactactagatccaccagcccctgccaagggcagggatgataaatgctatgcatggggaagaattattcttgctaatgatctccgccttagaaaacctcagcccctgatgagaccctcagttcatctttctacatttgttgaggcttcaaccaacagaggcaacaagaaagccatttccagcaacaagggcctgcctgtgtcgacagcaatcatgtagaaaccaaggctcagatgggataaccgacttttccaagtccaacagacagtaaggaaaggaatggcgagatcaactcagatcttctcttagccatgctgagggtaatcgccttgcaattacctcttcaatggatattccttgcaagaattaaaactctattaggctttttccaagatagctccttccagaactcagttcatccaggtcaaaaaagcactggaaggtaaattggcaaccactcatcatatcacatgatgttttccaaaatgtaagactgtcccaatcaaaggagctggtagcaaacataatgaacgtcagctgagactctataaaccaaaaaagccctgggttgactgtgttcatgtgacttcaaaagagggtaatctgcagggggtgttcctgcagggcctactttgcaccctttgctaccctttagataccatttgacctcattttcctctctgtgtgatggccaaaccacaggctccctcttctatctggccccatgagcattaatcaacttcaaccttccccaagacctggcaggagagatgcagtacctacttcttaataaactcaaactgtcattgaagatgaaagatgagactgcaaaacttcgagcatcccaactccccagcttgccaagtgctgggaatccggaggggagtgccctcgaggacaggtctctgtggatggtgcagaaaagtcagctagctgccttctcttttttcccttctctttcttcccctaaatgctccctcagtgataccactgtgtctgcagtaaagagagactgtctagctgtttctttttcagcaagacaatttggtgtgtggtctgtggtgcccacacattcttctttgcaatgagtggtgggtgaacagtgttttccaagttggatgttacagtaccataagtagaaacagatctcccggagctccgaacactttttctgcctgagttgggaggatcagcaggctcctgtgtagatggcccagcagattccttgggagcagctttgcagcatttccccactcactggccctcaccaatcataatgaaagctcaattaggtggtggacttccacttttgtaactgccaggttagttatagcattacacgttcatgcaagatgaagctgagatatttggaatcggtacatgtaactatttaaatgaccgggatgctaactgctctctacacattcccacccccaaacccctttcaccaagcagctggtactaagtactgtttacagagagttttcaaaaggcaagtcactgtgctaagcattttacagatattatttcatttcaccttcacaacaatcctatttgatagatttttttttatcaagaaggagaaatttgaagcctagagagactgaatgatttgcataaagtcatgcagttaatgagtggcaacgtcaaacttgaattcaggtctgcagattctgaatatcactcttcccacaactacaaccttaccttttaggcaaattaataaataagcaagcatttcctgagcacctactatacaagaggttctgtgctaggaactttcacatccacctaacaacaatcttgatttttaggggaggaaactgaaggcctagcttgttagcactgtcagggccaacccaggatttgatgtctatttaactgtaagatcattccctcccttccttccttccttcttccttccttccttccttccttcctccttccttccttccttccttcctccttcctccctccctcattctgtctctctctgtttcttttcaattaatcatgtatcaattcagctaaggttagaatcttatctttgcattcataagagataatttatacattatgcctacctcagtatttggcacactgtatttggaggcagttgaatcatgttaatctctgcccccaaatcacctagataagttttttattgctacttccctccctggtaaatagaaaagagatgctctttccagctacctggtgagaagaaagtctgtccaacttggctcgtgtttcctctacttggggagctgtgccctgcaaatggtatagcccagccccttcagggacacttggaagaactgatggcatcatgtcaggactgaggtctcctttcttgtagtttctgaagaattaatgaaaaggtaaactttgcaggatctcaacacacaggctttgtttttcccttacttcttgttttgcaaagaaaggcccctgctggccttttaagcccaaggaaaacttaacaaacacttgctgcaaaacaccttgctttttaccctgcatcaaataacctcccccactccagagatttgcgttccaatctctgcaaaggagcagcgagaggaagcaggatattgagtctcattaagtttctttgctgtgtcagtcatctttcccagagggggatgtaatattctcttcataatattcagcccctctcacaagttggcagctcctttctctcaacttatattcttagctaagaatgtgttcacagggattttttaaaagcctccccaaatacctgtttactgactttctcagagcgtttctgagatggcacaaggatgtgtggtctctgaagtcagcttcttcttgctaatgaggctcagctcagcacctctccccagcactccaggcaggggttgggggagcccgctctgcccctcttcctgtcc

SEQ ID NO: 86 - DNA, 2918 bp, Homo sapiens
aggaaacacatttctactgtttaagccacttggctgggagtacttggttatggcagcctgagcagactaaaccagcacctcaaagagttgttatagggtatgcttagtggtaactggttcctaaaggccttgctttctaaggctgactcctcaccctgcaaggatgcattctccccactggcagatatgcaaccaggaacaggcattaacacgctttattcccagagttttaatattttccattgcataaaatatttgttcatgaaaatgacaaaattgctattagattctatcaccacatctctgttgattttactttctgcaaacacatacaagtaatgtaggcatacagttaaaaatgaaaccttatcctgtagttccagctactagggaggctgaagcaagagaatggcatgaacctgggaggcggagcttgtcgtgagcccagatcaggccactacactccagccggggcaacagagcgcaactccgtctcaaaacaaacaaacaaaacaaaacaaaaaaaacttatagacaagtacaaaatgagaagaaaaagtccctttcccttcatgcctctacttcctgctgtattctcaaaggtaagcactgattacagtttacttatggatctttccaggaaaatattttatgcatttatcagaaaatgtaagtatatgcatcctttaaaattctgcataaatcaaactctgcagggtactatcttcccatcctcatttgatattttgtagatcttttcctattggctgtacagatcacctcattctgtctcctgggtcatacaatatagctcacataattctaagtctgaaggttggtccaaatggttccaagaatgcaggtaccaaaaagtagtctcttgaagaggccatcagagacctggctgtttgtatcttcctcctctgccatccacagtgtcatcttcacccaaggtggctggagaagctgttaggaatatgtggttttttaaaaattacattcataggaaaaggggagggaagagaagaagaaaacctctccccctaagctcatggctctttttagtcaggctgagccaactaaagtcatgtacttcccttagataggtaactgttgccaggaaaatgccctgtgtggattggcctggactaagcaggatcctcctctaaagagagagatgagatgaatgcctgacccaagtctgggatcttgggtgggaagcgtgtggatagtaggtcagaggtcagcagtgtctgtggtgtaggatgtaatcccatctccacagagctgcatacaagtgtgtttaagtgtgtgcaagtgattaactttgattagtagtttcaactctttacaatgaacatatttatcttttttaaaaaataaagccattttaaaagatcttgccataaaacaatcattccttaagtcaccacttaggatagacctagaatatttgtcctttctcaagagcaccagagagttttctggtaatccacgcaataaacagttataaaaggtaattgttgagatcaggggaagatggcagataggaggcagtgctaatgtgtagctcccacatggatggacaaaacaccatgtggagactcacactgtgaccctgttgtgctccaagaactatcataggaacatactgggaaaaccaaaagaattcacggatcctttgaaagaagacgcacaccactgtaaattctgtggaacaggagaaaaactgtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggaccttctcctggcagctgcctatgttttggatgcccagtacaacagaaatgttccatttgaaactcacctcaggccatcagacgttactatttttataaccactagacaacgcaggttgccgcatacttctttatttgtgtagacctcgctcttgccctgtttgaagagcctgagttgcttcccctgcctttcttggccacctcaatagcagaagtactctgcctgactgcatactttggcagactggtacattttgcaaaagtcactcctcaaatggttttctggaaggatacaaaagacatctgcaccatggtaaccacagtggcgagtgttcattgtagtacctgtaagagtttatgaccgaaggcaggagccatgaagaaaaaagactcaatagatttgcttttgatgaaacaacaacacttccatacagtgaacgccataagcacaactgcaagcaaaccgcaaactgaagaacaaatagggcaaaatgtggcagtgcagacatttcagcatatcaagagcacttccaaattacaggaaaaaaaagatatctcaatagataattttgctgaagataagtgaaggcaactcataaggaaaaaatatgtaaaatggccgataggaaagatgtttaacgtcactaattaaaaattatagaataaaacgacaataaaataccatgtgtttgcctataaaacaa

SEQ ID NO: 87 - DNA, 1398 bp, Homo sapiens
ctatggtctgaatgtctgtgttcccttaaattcatacactgacgcctaatgcccattgtgacagtattagaaagtagggcctttgggaggcaattgggaggacctcctttgggaggtcatgaaggccctaccctcataactggtattacgaagagacatctgaagagctagttagctccttccaccatgtaagaacacagcaagaaggcaccatgtatgaaccagagagcaaaagctctcaccacacaccgaaactgccggtgacttgatcgtgaacttcccagcctccagaactctacagagcagcatctgaagagccacggggcccccaccttcatccctgagaattttaggagccagcctgcctttccaggtgacactggacactttcatctgagaaccctgtcacatgacagttgtttcctttcttcctcctctcctgggaatgctgctgcttcgatgacccaagagcctaagaagggtagctgtttctcaatacactgagagagagttctttctccgtcctgaccatcttgggacccgatggcaagactggaaggatttatatctccttttgtacagaaaactgcctccccatgttggtttgtgaagtgaaatgcatataaaacagaggattccagactctcagaagtcaatacataaataaataaaaataaaactgagaagatacctcaaaatggtcagactcattagcatcatccaggtgtattttctcttcaaacagtgtcagtgggtctctaataaagagatgagcaacatgctgggccaggagatgatcaatgcctgcaaaaagagatcacatgggaactcactgcaaagcgagagataccacttcctcttagtccagaaagacgacaggatagctcaggaagtttgaagaaagggtgtctagaagcttgaaatagctggtttgattagtatcctcacctcacccagtattttatcctgcggacactgcgggagtgtcagcgttttattcactacttacacaatgcctgctggggcactggtgtggacctagacacagacctccaaagtaagctccttttgctaaaaatcaagaaaatctcacaagtatttggaacctgaaactttaggaacaagtagcctcatgagagaagttaaagactttgcactaaaaatagaaaccagaccaggagtcagcaaaaaagtgtaaaagagctttgaagaactaaaggcgtacattcaaacccagaaagatggagtagaaacccaccttcctgcaacagctgttcgtagatctctttatctatcgtcaagtcgatgtcattatatttctcaccacacttagataaatagctgtctattgagtcatatcgggatttactgatcctatagttattgttcttcaatggc

SEQ ID NO: 88 - DNA, 4422 bp, Homo sapiens
gttttcaggcggcctcctgagaaatgtttgcaattgtaaggcgtctctctcatccaggtttacccagattcgcaaactatggcgacaaacaaccatagcagaagcatgtccggattatttcacatatatcacaaaatcctgcaaagggtctgtccccattggatcacctcccatcacgccacacacgacgtgaatgacttcgtgcttctccatacctgcattgatctctgggtccattgccagttataaacctccaagggcaatagccatgaggtgatgtacagtcaagcatcacttaataaccaggatacattctgagaaatttgtcgttaggcaattttttcattgcacgaacctcacagagtgtacttacactaacctagatagtagcatccagtaaacacctgggctatatggtctagcctattgctcctaggctacaaacctgtatagcatgttactgtactgaatatgtaggcacttgtaacacaatggtaagtgtttttgtatctaaacatatctaaacataggagaggtaatgcattgtgctacagcattacaatggctatgacagacactaggcaataggaattttccagctccattataatcttaagggaccaccatggcacatgcagcccattgttgaccaaaagttgttatgtggtgaatgactataattggcttttcagagcaaccactcacaagggggtgtagtatagcttactagacaaaactgcagccgctgctctgttttttgctcttagaaaactgagtacctgatttggacaaaatcataataaaatttagatagagccaacatttgtcctctggaagtttctgacaagatacaagtcaccgttataatagtcaaatgtcaaagtggtatatctaacaaaattaaaacagacagctaggagtgagaagatttaagaaaattcaggtggcccaaaggaaagccaagacaagacattctctcccggcctttgggcctggattttcatttcagcaggtaacgaggagaccaaaggcctagttatttatggagatctggggccacagcagagctcctcatggcaggataaggcagtggaaagcagactcaacggttaacccacagtcctcctcagcaagctgggagaagcaactgatgccacttagatgcttagaccgggccttctgggagagatctggcccaaggagcagccggcagcttgacacagtgaccaattggaagcacagcagccacacgccatgaaacaaggtgatcatcttcactcatttcctgaggccagagccttccttacgcaggacatggataccccagtcccagctgtgctgaagcgtcaggaagcctcccccgaccccaccctgaacaacagtgaggggggttaggtgtcctcaaaagatctactctgtcaactggagttgttgagaaactcaggaaagggaactaaaaaggataagaaagtggtgcattccagtgtcttcctgttctctgttgcagagagccagctggtggaccgcagagacagacttccagccagggccaagcccttcaggaagggagtcatgcaccaaactcagctaacagaccaccagggcaccactgggtctcctgctggggaacagcacacctatgggtgggctctaggggtggggtggcctggttgctggttctgctctgccacttcttagctggacttgagcaatttgtaacatttcttggctcagtttctccacctgcacaatcaaaatatcactaccttcctccaagattgcattaagtgtgacaatttatgtaaagcacttagtccagtgcctggcacctagtaagtactgaatagtgaaaacaatttaagtctaacaaatccacacaccatgacgtcagacaaattaggcatctttcattgctgttgtgaaaattgcgctaactctaaactctaacgtacatctggctcactgtctttctgtaagaccagtcagagcagcagctccttccttggtaaaatactttaaaaaactcccattcctggctgggcaccggggctcacgcctgtaatcccagtagattgggaggctgaggcgggtgaatcacttgaggtcaggagttcgagactagcctggccaacatggtgaaaccccatctctactaaaaatacaaaattagctgagggtggtggcagacacctgtaatcccagctactctggaggctgaggcagaagaatcgcctggaggcggaggatgccatgagccgagatcgtgccactgcactccagcctgtgcaacagagtgagactctgtctcaaaaagcaaacaaacaagaaaccccaaaaactcccattcctgggcacccattctgattttcttcctcatttacttccctgcccaatcgttgtctctatgttgcaatttgtgggggtcagtcagaactgcttttcttcagaagccactcttacccgttcagtgacctcattcagctcatgctagggcagaatccacagctctttctctgacgtttccacagtgtgaagactcacacatctaactgcctgcagaacatctccacttggatcttgttagattgtgtgggtttcccagaaacagacaccaagacagagtttggggcacaagataatctattagggattaacacctgtgaaaggaaggggctggaggcctatttggcagggggaagaggtgaactgtgatataggcctgtgggaaccttagacaatccagcagggagcagggggaagggagcagggagctctgcagcgaatactgcccaggacatagttcctgggctatatggcctagcctattgctcctaggctacaaacctgtatagcatgttactgtactgaatatgcaggcacttgtaacacaatgttaagtatttcatcagaggtgccccgcatcaggccaaagtggcccagcctttgtgccccgacttgctcagtcatggatgcaagctgccttaagaagggtgtgacctcagacaaagtggctttctgcaggccagttgtggccaggtggaagccatctaccaacttcactccccacagctgagcaagtccctccttgaaggggatctgggtggggtgtctccaagtttgctagattatctcccagccatttcaaattcaacaagtccataaccaaacccttgattttacctggctccccagtgtccccttcccactctttcttctcttaccactttgctcaggccaaaaccaaagtcccagcctctcttccacaaatgccccttggtcaatctatctacacatatccttccatcgctcccttcagaatacgtccagaacccaaccacttctcatctcctccatggttcgacccatactcagccacaccccagcaccaaccccacggataatcgcagtagctccatagcttcctacctaagcgttacccctgcccacttttcttgctctattttctgcacatgcattggcgtgaaatattttttattttattttattaaatagagacagggtgttgctatgttgggcctgattatatttttaaaaaataaaaaagggccaggtgcagtggctcacacctgtagtcccagcactttgggaggccaaggcagtaggatcacttgaggccaggaatttgagaccagtctgggcaacataatgagatgctgtgtctctgtttaaaagatacatataagtttaaaaaatattttcatttatatacaatcagatcgcctcatatgtctgctcaaagccatttggtggctcccattcatactcagaattaaacccagattccttactgtggcctatcagccctgcatcattctgtccctctcctcaacatgatcaactattgctcttccccacatgacatcctactccctcatcactctctaaaccagagctgcccaatacaggagccaccagtctcatatggctactgagcaggtgaaacctgtggctagtccaaattgagatgctgcctgtatcaaatacattgtttcagacttagttcagaaaagagaatgtaaaatttcttttctgtttttttgagacaatcttcctctgttgcccaggctggattgcagtggcacgatcttggctcactgcaacctccgcctcctaggttcaagtgattcttatgcctcagcctcctgagtaactgggattataggcatgtgccaccacacctggctaatttttgtatttttagtagaaatggggtttctccatgttggtcaggctgctctcgaactccttacctcaagtgatccactcaccttggcctctcaaagtgctgggattacaggcatgagccactgtgcccagtccaagaatctaaaatttcccattaataatttttaaatattgtttgtaaattgaaataatatatttaatatattgggttaaatg

SEQ ID NO: 89 - DNA, 1875 bp, Homo sapiens
atctcttcagaatggcactggggaaacaaaaagattggttggccgggaccttcaacagtatcagagtcaggctaagtaactctttcgaaagttgaatgaacagtcccctaccagatgtaccttggaagcaggagccatgacttttcagtacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgaagttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatgttttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacactatattaccaccaagaggtcaaataaataccaaagaatgtattttcgaatttaacaatgaggaacttaatcatacaggcagaagtaattccagagcaccggagacagaagccagattgccatatgggttaaagagtgtgtaaaccactaggaagtaaagacatagaactactctcacaagtgcttttctggttattgtgacgctgaa

SEQ ID NO: 90 - DNA, 1477 bp, Homo sapiens
gagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctg

SEQ ID NO: 91 - DNA, 5834 bp, Homo sapiens
actccgcactcttaggctgcgtgtgaggcctgcgagtgctcgggagctgccgcggtcacaagagaaagcctagctgtcaatgacagccccagagcatctgggcgccttgcgatacccgggtgtctgtaggcagccaggagacacttccaagctgatctggaatctttcctcgcccagctctgtccctcgcagggatggcaaaggacattacgacctacatcccttcccggatctgatggcttcagattggcagattgtgttaaagtggaaggctcgtggtgcccctttgctgagtttttatggacttagttttcccaagtagttctaattatcgctgggggggtggggtggggcgggaacgtaatttctgcgtctgcccttaaatacctttaaaccttggctgcattgccgcttttatggaatttcacccatagtctgtcttttttagtttccctgatacgcatctttcttaataataataataataaataaataaatagcactttgggaggccgaggcgggcggattacctgaggtcgggagttcaagagcagccaggctaacatggtgaaacctacctctctactaaaaatacaaaaattagcggggtgcagtggcgcgcgcctgcaatcccagctactccggaggctgaggaagaattgcttgaacctgggaggcagaggttgtggtgagcctagatcacgccaccgcactcgcactccagcctgggctacagagcgagacttcgtcttaaaaaaaaaaaaaaaaaaaaaaaaaaaaaaaaaaaacaaggcatgtggccagtattccctgcctatacttgttttctttagaaaaatgtaacttttaaacataatttgacttgaaacggtttctttccaggatttatcattttttataggtgattccagttcaaactatttattacattaatatgttgacaaattgtcgttgctgaacaaattttttatgtgcaatcatacggaacattttatatttaaggatgtttatatatcaagtatataatcattggcagaaactgggcagggcgcggtggctcacgcctgtaattccagcactttgagaggctgaggcaggtggatcatctgaggtcaagacttcaagaccagcctggccaacatagtgaatccctgtctctactaaaaatacaaaaaatagcgagcgtggtagcacgcacctgtaatctcagctactcgggagaatgaggtgggagaatcgcttgaaccccaggcggcggaggttgcagtaagccaagattgcgccactgcactccagcctgggtgacagatccagattctgtctccagaaaaaaaaaaagagaaagaaacctaagaaagctatattgtttatactctaacatttctaacatttaactacatttatccattctcaaaggaagttggtcatcacaagattggaaaatctgtacttccctggcttatatgacttaatcataaatgtctaaatttgacagatgtcccaggaaagaaaacttataaaactactctgttgcattctatgtgtttatgtgacatttgagatctgcatattatacatagcaatctggtttttaatataatgtagagagactgaaaaagttttagcagtttagctgccactttagctgcttaaagtaatatatgcatcatctgccccctttggtggtagggatgtcagattccattctctgtagggtatttcatacaaatctgttagtcgctggaggaatcagaaactagacacacaactggtccacctggctgtctggtggcagcagaggaactgggatttccagggcaactgacggggcgataggacagggcagcagggaggaaatctggggacgtacataagatttaggtccaatacaagcactgtgctttaaataccattctgattctcatttatgtttaaccacctttatatttaagatctatccacattgccttcttccattttattccttcagatttctacattgtattacataatatatgctgtcttttactaactgattcattttgtgataagcatagtttgcctacaaccttttactaacttaatgcattgtctctcaccccaactccattccttaaccaagtctgactggtcaagaaatatccaacacctggtatcaacctgcatcaacctgcatgctagcaaattagcaaataataaatgcttttggaactaactggtttatggaggtcctcaaaaactgggtggtgtgtttatttaatgctaggtcaatttggcaaaaataaatgtacagaaagccatttccagaacaaaaaatgtcagaatacaatttgccaaacaaattttctaaattactaatttgatgaattgttgaggcttgttaaaaaagtttaagccctactaatgcctcagccttgtctgaggcaagcccaggagcaggggcagagcgtgagtatacaaaaagtggggaactgcaaactccacttcagaaaaacttcacctatttgtgtatcaaaaggctggggtaaatgcaaaactaaagctctgaaaaactctatttgacaaactagctttcaactgctagtaaaaagcctagatattggccaggcacggtggcttatgcctgtaatccaagcacattgggaagccgaggtgggaggatcacctgaggtcaggagttcaagaccagcctggccaaaatggtgacaccctgtctctactaaaaaacacaaaaattagccaggcatggtggcgggcgcctgtaatctcagctacttgggaggctgaggcaggagaatcgcttgaacttgggaggcggaggttgcagtgagcggaggttgcaccattgcactctagcccgggcgacagagcaagactccgtctatttaaaaaaaaagcctagaaattaaacaaaactggttttatttcataagatgtttagagacaggcaatggctggtgttgggtcagcagctcaacaatgtggcaactggcatcttcgtggttctcttggcccttcgtcgtggttcaaataactcctccagctccagtcatcactttggtgtttatggcagtaagggggggaggaggtggcctagctgcatatgtatctttaatcaggaagtaaaagttttcccagaattcccaaggccaaagctgtgtcctgaggccactgagagttgttagttgcaacagaggctgaaaggggagcaattagcttttctgggttctttagtgaaggcaggtaagggagaagggggttgggaatggctggcaaattggagcaccaacattacctttatggataatttctttttcaaaatgggcagctgatatgtgaagaaatatctaacaacaattttaaggttgtaatttgaaactcagttctgctttcaatcatgacatttttaacagatgcatttcagctatactattttttcttgtgccccactccccaacattctagaatggaactaaaataaaattacttaatctttcaagaaaaagtgggaaaaaaaaatcaaaaggccaacagtggcaagatactttcaactactcttgatgtcattgtccttctacaccaaagaacatctggaaaacatccccacatcctttggtgtttaagaactgatagagctgaccaaagtccatgtggtttcccctggctccattaacactgaacactttttcttcaaaaatggaaaatttcctttgtctttccgtttcatcatttgtaccatcaaaaggaatgtcttctcgatggcgaattaaaattctcttccagtttaattttctgagtctgaaaagaaatttccaaagtaaacattttcaaaatgtatattctagagcatttaaaacagaagttataaaacagatttatcaatgccttttcctagaagtagtctactttttaaaatgtttataacttttacttattgatttagtagaggcaggtcttgctatgttgctcatgctggtttcaaactcctggctgcaagtgatactctggcctcagcctcccaaagtgctgggattacaggtgtgagtcatacacaccccgtccaagaagtctacttttatctcacagggatttattttaatcaaatatgattctggtcataatctcatctctgaactcatttgttgcccttactacagccatgtatcagtagtttagaaatgtaggaattactgaatcccaaactactatggaccttctcagaaattcatttagtatatcagtagagaaatgagactagtggcaattctaatgcttctagaaagctccttacttcacagggtatacagtttgcagcatcactaaaatgagggaaggaccagatccatggaagtggatggggtcatagtgtctggggcaggagctcaattcattcagtgcatatttacagaatgtctcctacatgcacttgtcaggtgacggggaaaatgctgactacatgtgatttctgccatatccatcaacttgagattgaatccccataaagacacaacccctgggacatacttatctccacatctctaatagtcatgtgttgcttaacaacggggatacattctgagaaatgtatctttaggctattttgttgttgtaccaccacgacagagtgtacttacacaaacctagatggtactttttttgcatttatattttttcatatagaaaaccaaatgtcccagcaccattactgaatatcattctgatattcaatagtgggaagatcaagtgccatatatcaggtttctatatgtgctccattataatcttatggcatcactgttttatgtgttgtccactgttgaccaaaacgtcactaggcagcacatgactgtatcttgtttagtattaacattattgacatgacttcatatacatatgtaaaagcaaaccttgaccagaattcttcacaggcactttgtgggccttccacacaaacaacaccaggttttccaggcatgctaaacccagacagggaaagctcctttgcccactctagaatattctttcttttgcatttgttatagatatgatggctgtagatccagagtctcgtgaagatgaggtcaactgactggactgtgcttcctgtggtgggtgaagatgaagtatctctgctgacatagccagaggcgtgttctctaacccactctgtggcattcagtatacaaacatctccatgacaatgtttttgcaggaatgcagtcagatctgtgttcagctgagtctgctgggatctactcaataatactgatctaatagaaaagatacaagaaaaatattgtcttggaacagaaaacaaattcgagaattgcttttattctcagattaattttgacctccaaagttggccagagcttctgtaacgtacctgacagtaatttcaggcagaactgccgggtatttaaagggaagaatacaggccagagaaaacatcgcctgattaaagagaagaagaaaaagtgcactaaccaatgttttaagtctcaacatgtttcaatccctctaaaagcaaaactgaattaccattttttcgtcagatacatccaggttcatattgatagtaaagtagacttttgaagatcgcccctccattgtcttcttttcaatacaatctttcagttctgctacagccagctggtcattcactatgagctcattctcaccagggaacatactggctagcaggtctaactcagcaagctgggcctccgcctgctccatctcaatcatttttggacatgtgtaagtttctaaggaggtaaagataagagagacaatttacatatgcaatcttggaagaaatgaatacatcaaca

SEQ ID NO: 92 - DNA, 1077 bp, Homo sapiens
aggaaacattagttaaaatttaagcagaacattcagaatcaggtcagctcgtgggtgtggacctgaacacaggtgagcccgtggtagcagcagaagcaggcattatgggataacgattgtgtaaagaaacagcttcttcattcctgcactgattgccaccaacattctcttggttgatgagatcatgcgagctggaatgtcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaa

SEQ ID NO: 93 - DNA, 5177 bp, Homo sapiens
gtctgtttcctcagaacaccggtcttcaccaaaggcgtgggaaagggcagagagcacaggacatattctggaattcaggtcaccttttacatctgcctggagttgggtgagcgcctcacgaatgactcggcaggactgactgccactgctaaccaggcggatgcaagcaatgaggaggacctgcccaggccgggtgggtgtctgctccctccctctggtccctggcacatctctggaccccctgccctgctgtcggagagagatgacgggcaacggcgtattctcagagacagggcctgcctgcaaatcctttaaagtcaatgggatgaaatgtatacccattgttagaaaaaaataggacttagcaagttgagtgcaaataactgatgcaagactgggatggagatgggaggggtttggggcaaaagcagaagtctttctgggtccgcaccagctgtgaaatacctggcttgttgttctgtgcctgtctccagcacccaggcagggctacctgaccactctgctctctcagccccgccctggctctggagcgagcctgtggaaagggggacacttagccaaggccccagccacatagcagcagcagctgcgccctctgtcagctccttgcacctcctcactgggcctcctgcaaggcacctgctccactccaccactatcacctgggtcctcctggccttggcctggcttgcttaccttgttatcaagtcctgaatgggggaagcaatattccttctccactacaaatcaccacagtattcacaaagaattccagagaaataagaacagagacatcagaccacactgagcactcaataaagagaaaattcttcaaaggtagctgattgatgagagtttccacatgcagatgggacaggcactgatttgtgcacaagaagatcaacttgattgaatccaaaataaaggaatgtgtgtgtgctgcatgcacgcacacacatatccccatggcaaactcttgctatcccaggagcgcagaccgcatgtgaggatcctggctccttatctcccctccccgtatctcccttccctgattacctttgcgatctgcacacaccagttgagcaggtactgggagccaatattgtctttgtgttcccggacatagtccaggaggcagccgaagggcatgagctgcgtgatgagctgcacggtggaggtgaggcagatgcccagcaggcggcacacgtgggggttgtccacgctggccatcacgtaggcttcctggagggagggagaggcacgtcagtgtggcttcgcatggtggccagaaggaggggcacatggaccccttccaggtgaagacgcatgaatgcgatcttgagtttcaaaatacgtactcatggaggaaaagctgtgcctgcaaaagacctagcacagggacgtttacgcagggctgtgaagtgacagatgcagtgggagagggcccctcctgggtgcatctggggattccccatgacagagaggcccaggcaacagtggccatgaggagcacattggataaaggaggagtcggagtcacctgatctctgagtttgggaactgatagtatctttgttatgaagacctccgcctcaaggttgaggatgctgtgttttaaaatatcatgagggcctgtaggaatctgtgtggggtccggaacaccctgggtaatgactgaccctgcacatcaggaacgctggctgtgggtgctgcagaggacaagcgatggagaaggcatccggggagcaccgagccagcagggagaaaggcctcccttccccacaggccaggcttggccctgactgtgctctgggaaatgggtgggcatttgggctggggaccctgcccacagcacctctgcaaagagtagctggataagctctttcaatagaccagtcccaggttttgaaatggacagagcattcaatctacagtgactaaaggctgcctggctgcccgggacccatttctaaagagaagtggtctctctgtgctgtgcccccaggctccctatgggaaatccatgctgcactgagtcaggcatctgctgccctgctaattccggctggctgccaaggcaggggccttcctttgacagagccataaatacagactttattttaacccttctgctattcttgggctgaggaagctaaatttatttgcaatcaggcacacaatggggccctcttttctgtctgactgagaatgagggaatccccaatttccacccataaattctctttctctttaaaatacaaatggtggtgaccttttattcagatatggaaaagaacacacagactgtagcagaaagcatccacagctgcttttcacatctcagcaatgcctatgttttgagtgtggacttgggcaagttagtttctctgcagaagtgaacacactgagccaggctctgagatagggtgctgctccagggtgcccgggcaggtcaggagcaacaggctggcgggaggcagggtggagataggagacaggagacaaaggcaaggtggggcgaggggacacagacagtggaccctcagtatctggggaattggttccaggacctcccttaaatatcaaaatgtgaggatgctcaagcccctgatataaagtggcacagcatttgtgtgtaacctacagacatcctcccatctacagcatctcctgattacctatagtacctaatacagtgcaaatgctatgtgaataattgttatgctgtattgtttagggaataatgacaagaaaaaaagtccgtatatgttcagtaccgatgcaatttttttccccaacgtttttcattgtggttgattgaatccatggatatgaaactgcagacatggagggcaaactgtaaatatttactaaaatacaaatatgctcacacgctttccttgccctaaaccctgccctggccgtccctgttcctgggaagccccgaggctgactgccctcctccctccagcctctggtcctcctgcccaccttctccccaggagagcttccctccacccttacccacgggagaacctctgtccccagaacccacctcctccttccttagcagactctttctcagaggagccttcctcgactcttcaatctaaatgaaactctcctggtatcttgcagtttttccttcagaaagcagcctcagcattgcctgggaaccttttagagccacacattcttgggtcccgcccccaggccaagagggtgaaatgcaggagacaggcctagccttccatatgaacaaaccctctggactctgaagcttgatgaagctgaagagccactgctttgaggcagtcatcataatctgtacttaaatatttgtgtgattttaaaaataccctccccaccaagtttttgaggaaagaacggcttggtcagcccctagcacacgcttagggtctagctggcgctctgcagtgtcggatcacccggcacacacttgctcttacgttgactcaagtctccgccccgtatctgttggcaagtacgtggcaagtgctctgagggcctggacctttgcttcttcaacattccagcagggactagggcagatctaggcacatacctacttcaaaactgtcagggttgaactgtactgaagtcatgaaggtcaaagactcaaagcaagtcaaagtccaggccacttgcattcaagacaaacaaacaaaaactatagctttaaatatttcctgcagagtgtttaggctctctattttcaaggagagtgtgtgttattttccttttatattctaaagataatgccacaattttaaagaagagaggagatatttaatatctgtggactcagtagatattgaaaatatccctttaacttggataagtgcttgtttataaaaagtcagaactggacagggccaggaagcgtattttgtctgaggtcactgtagtcagagggtaagctgaggctgacgaggtgaacggcccacctgaggccaccctgagcagggtcaggtcaggcccacaaccaggtctcctgaccctggctccctccatggcccactgctcaccccaatgggtcggaggcgccccaggtcctctgtgtgaaggcagcctgtggggcctgttgggtgctccagttaacagactttagacgtgggagacacacacacagtacacctagaaatctgttttgcgttcccttccattgcctaccctaaatttaaactggaaagcctatgaaaatttaatacgccatgggattgccagaaagcacaaatcacatctctcccccggagtctgggaagctgtacaaccataacaccaaagaaaccctctggctcttcctattttctcaagatctggttgagacttgaaaacatattgtattcatttgagagggaagaaaaatctgcaaaccagagcagtttgagcagcccatctgctgcagggcctcgcagggctgacctggggctgggaatggggagcagagcggggggcgtgggtgtcggccacacagagcctggagccccgccaggccccatcctactaacatctgatagacccactgggccatcacttcctccccacccagcaggcacaatgggaacgctgttcagtcgtgtgtcccgttcggtgtacgcagaagctaaagcgagctttgttctcggctgtttgtcttggaagtagtaaacgtgcaccgtgacctacagcaagcatgcttggtattccacaacaatcttcgtggagccccagcacccacaggctggcaggcagagcgcacagttggagcccccatggctcctagcccagtcccaccgcaggagtgtccctgaggctttgtgaccttgaaagcctgttattttgtcctaactgctgacatgacttttggttccttccttctggcttgtctctctcatctgtgaatggctctaccgtatgaattgggattccactagctcttgaactccttaaggagaggtgtacgtccagccttatgaatgaagggcaggtgtcccctgcattttaagaactttactcattcactaagccactgctagcaacatggaactggggctgcagtgtgtgtgccggctgtgggggcctggtgtctgcaggggaacggctttgctctggcaaactggccagagctgatgttgaaggaagcccttttgcct

SEQ ID NO: 94 - DNA, 21719 bp, Homo sapiens
acacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgagtggaagtgactctgaccgttcccttaagaatctttaatgctcttacatgagatgagcctcagaacaagctaagaaccatcgaaagaacatcaagcctggaaggtgacagaaggagcaatgtgttcttgaagatgtcacctcagcccacctgctccaaggacagtgcttcttgcgacactctgatagctctgcattcttttctgtaccaggaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 95 - DNA, 2430 bp, Homo sapiens
aaaaatgtaaataccacgagccctatctgagaagggtgagggaagcccgaatgagataatgtgtgcgaatggctaccatgttggagggcttgggttcttcgcactcggtcctatctccacttccaggcagtcgactttcctgagacctgggtgccttggccgcccaggctaggagacttgaagctcttctctcctcaaacctgggccgatttgcttgttatcttctcaaagggtagagtgagggctgctgacgcgctcctggaacagtcaccgtgatgactcggggctccgctggcaccctgggcacacaggccgtgctgttgcctcccctcccacaccctccggagattgccattttctatttccaaaccaaacaagacaccctgaaggacgctcctcctgcggccccatcatctgcttcaggccagatttggaaagtcagcgtgattgaggaaatgctggaagagcaccagcctgcacgctgcagaggcctctttagaaacttctgctggaagggacgtccccatgctttaggtcgcaggacagagcttgcagatgccttggaaaccggtaggagccaagctgcgtcctgggagacccccgagctctgcacaccttccctccgccctcccggctgtggcaacgctcgggggtcgtttaggggtccgcgtgccttttgctccgcggcccccggcctcggatcccctctcccatcatgattctgaggcctccccagccatgtggaactgtaagtctaattaaacctcttttttcccccagtcttgggcatgtctttatcagcagtgtgaaaatggactaatacagtaatatataaaaagtttgctgctatattgctccatttactctcctctcctttgtcctgttattgttatacaaatgacatctttgtatgttgtatgcccatcagcacagatttatggctattgctttatggagtgcatttaaaattaagtaggcaaaaaaagagagttgcaaacaaaatatgcaattatactctcttttataatttcctatgtattgagctttactagtacttttattttttcttgtggatttgagttactatctagtgtccttttattttagcccaaagggcttcttgtaatttttattgtagggcaggtctgctagctatagattcttgcagtttttgtttatcttaatgcctgcttcgtgtttgaataatagttttgctggatgtagaattcttggttgacagtcttttccattcagcatttcaaatgtgtcattccattaccttatggcctccattatttttgatgagaaatcagctgttaatgttatttatgagttcatgtatatgatgagttgcttctttcttgctgtttttaagatgctgtcttggtctttgtcttttgacagtttgtttgcaatgtatcttggtctcagtttctttgtgttgatcctccttggagttcgctgagttttcttggatgtgtagattaatgttttgcatcaaatttttagctatttggtcattatttcatcaaatatgctttttatatttttctctactctacattttggactcccattatgcatgtagtttatatgcctcattatgtcctagaagtttctgagaatctgttcatttttttgtcattctttttcttttctgttcctcatactggatcacctctattaatgtatattttagaatcttgatttttaatttggcctgctcaaatctgctgttgagttcctccagtgaatcttcatttcagtttttataatttttgtattctagaactgctatttgctgtttttttaaaaaaaatttctatctttttattgatattctgtatttggtaagaaatcattttcagactttactttttaagatatggttgcctttagttttctggagatatttaaaattgctgatttaagtgtttctctggtaaatataaagtctaggcttcctcaagtatagtttcttttgattgcttttttccttgtgtttaggccataacttattgtttctttacatgtattatagttttttcttaagaactggacattttaaattatgtaatgtggcagctctataaatcaacttttctctccctcttcacccagggtttgttgttgtttgtttgtttgtttagtggcttttcagaattaattgtgtcaagtccagattctttgtcatgtgtggctgctgaaatctctgctcagttagtttggagatcagctaatgattgggtagcaaatcccttaactatctggaaccaataagttttctagtttctgccaaggggctctgtgtgttttggggcatgcctttattagtcagttgtgtggttttcgtgtccaccttagccatcacttgctgcttgcacagagcctcaaggtcagccagagacaagaatttgggaacttctcagg

SEQ ID NO: 96 - DNA, 6857 bp, Homo sapiens
tagacttctggcaagtttatacttttgtgaaaattagaaagatttttttccattacattttttacctggttattgctggattggaagagtcacaaaattccacgcacacaacttggatgtaaacaaaaaatacagcacacataatctggtctttttctgaattccacgtccaaaatttggcagaaaaaaaaaagtgttcaatctcctgtgaatctactctgatctgctatactaaaaaatacttagtctttttgtgctgcatttttccccccttccccattatctcctcctaagccttgcctgggaattgcaagcccaccagagatcctattctgtcactaagcaaaatctgatttacaattttggctgaggagagggaacatattaaaacatatcaacaattttagaatcaatattattaaatttcatgtaggttttagaaatgttttacttgtatactttagacttcattttataaaattacatttttaaaactttttacatttttaggaaatacatgttagctaaaaaactgtgttttgctccctgctacgtttgcttatcctatccttcattactccttggattttagtctaactggtcttgggacatgcctcttccccacaaacacccccaccaccataccacattgctgtgacacatttagcttgttaatgtggtaagagtggagctcacttacagaatttttgcagactagaccttaggctacaggtctttaccatggagcagaaaagtggtatctcaaacctcatccacaaaggttgatctagtccaagcccctctccaggttcatgtccatgtacagctttgttcttattgtaacaacctacattttagaataggcaacgaagaccattaccaagagcagtaggaggggcaaccttcggctgtttgtttttcaggatctcaacttgtgaacttactcttctcttcacagaatgggataactgcctggcactcaccaagctacacttgaagaggatcaatccatgtcatcatgtccccaatttcatagcaccaagtattttgtttattcacaaatgccctattatggacatctagcaaacaatgatacatcagaaaaggagatgtgcataaattttcatggaataaggtataaagcccaactctcaatacatactaatcataacaggagtctaagaaatattctgaaataaatgggaatgcagaatgtgtcaggcctctgagcccaagctaagccatcatatcccctgtgaccagcacgtacacatccagatggccggttcctgcctggatgcgcatgaaagaatgtgccacagaaaatgagacacatcaatgaggcctagacaggcaacttatgccattgtgagatacaaaatagttcatataacatagcaaggggatatcattctagaattaaactcatgttacagaaatttcatcacgaagacagtgtaccaacagtatacccccctgccccctgctgacatagtgaagacttgtgggaagtatcagaaagagaactggaattaaggaggaaaatcaagatttatgtttcttatcgccaatttttaattttcatttgtaggttgtggaaaatgcactagaatcaacaaacatggggactaattcaactcggatatcatgtcttcagagaagtttctcctgccctcctctccctgtagaattaagtattcttccactgtgccaccctctaacttgtgctcatatcttcctctattgtagttatgtgttcacatccctgttgtttttgtaccggcttctcccaaagggagacatttagtcttattcttcttggtaactttagcacagacctggcagattgttgacactcaacaaatgtttattgactcaaatgcattcagttgaacattgacctttgatcaactctgggaaaagtctgcaaagctagttaggacattcagaaattcatttcatttcaatcctaactaaataaattattgaagtctcagaacttctcagtacttgatttagacacatagaaacttgggtaaataacacctatattgttatattcctcaagaaaaagtttatcttttcatgaaatgaatctactgaggatatttatagaaactgaatgtaagtgagcagaataaagtggtgtgtgtgtgtgtgtgtgtgtgtgtgtatgtaatttgaagagtaggtgggagaaggttgtgataggatagcagatcttgtttatgatagtcaccagctataacagacactgcctgatgcctttccaatatccacttcccttttcttttttttctttttggaacagagtctcactctgtcccccaggctggagtgcaacagcacgatctcggcttactgcatcctctgcctcctgggttcaagcaattctcatgcctcagcctccctagtagctgggattacaggctctcgccaccacgcccagctaatttttgtgtttttagtagagacggggtttcgccatgttggccaggctagtcttgaactcctgacctcaggtgatccacctgcctcagcctctctaagtgctgggattacaggcgtgagccaccgtgcctggctctcttttcttacttaatgtctgtgtcaattaaatagaaatgtatcaagttaaaaaccttgcctcggtagcttccagtgcaaataaaggtacccatgccaccccattctggccagcagtaaaattgatggaagcctctggttggggcttcaaggaaagctttatcaaaagataaactcactggctttgtcccttagttcagtggtccccaacctttttggcaccaagagaccagttttgtggaagacaattttttccatggaccaggagggttccgggggatggttttgggatgaaaatgtttcaccttagatatcatcgggcattcaattctcataaggagcctgcaacctagacctctcacatgtgcagttcacaatagggttcatgctcctatgagaatctaatgccactgctgatctgacaggaggcagagctcaggcagtaatgctcactagttccgttgctcgcctcctgctgtgcagcccagttcctaacaggacacagaccagtactggttcgcaacccagggtttgggggcccctgtcttagttcctttgccttccttccagatggatgcctggaggaacaatcatcccgcaattgtgaaaattgaagccatattttaaagttggtttcaattgtaatacagaagaaatctggaccttgatgacatttgagctagagtactaatcttgatcttcctattcatgagcttgttgcaagagacaagacttttactgatttaactcattgttgggatttcttggaactaaacacagtcataatacattttttccttcccaggaaaatggtagagcatgacttttcaaatctaataaaactcatgtgtagctaaaaccactctactgaaacaattccatctcagcccatggtacaagggattttcctgaatgaaaaatggtgtctgatcattttgttggtttctttgttggtttttcctgaaacttagggttaaagaatccaggaaagttgtcttagatagagttataatttccgtggacatcaactgataaatgcaattacagtttgtatgcctaggtttggcaaaaatcatataagcaacatccctcacataatattgttttaattaaattttatttctttcttggtatgaaacatactgcagaagcacaatcaatgaacattggatagtttccttaaatcttgctctttgtcctatttatataatttattgtgtcagtggttctcaagtggtatgctcctgcaactcatcatctgaaaatccttcccagatgtgctgaaaaattttcattaatttgtatattctattttatttttataactaagtacacatgcttgtgactggaagagaagacacccctcatttaatcccagaggaatatttggccttgattcatgccctgctcactccaccccattattaagatagagatcgctgaagaaatccctgctctataaatgtagctgatccaaaaacaaaatggaaattcattattttaaatatttctacaagatctttgtacaactctatttttttttcctattaagaattacatgattctagaataagttccaaccctaagtatcaacactggaacacaattttaaaacaggaggcgattatctctatagtgagatttaactacagaggtgatagctctggttagtgaatttcaggactagaaatcaggcctgctgtctcttagcttagaggaggtataataagaagaggattagaactactgtgtatattaacaagaagaactctattatgttcagctatcattatatatgatattatgtttctttttatgaactatagttcactgtctttaagcataatgtttgcccaaggtgggggtgttggtgtgtgtctgtgtgtatatgcatgtgtgcacatgtgtgtatgtatagttgattcattcattctgacctactgaatttactgaaggaataagaagaaataccttgaactgagggacctggcttagctcaacatctgtaccatctacctttgagtatccattcctttactatgaagcatggatgctaaaactaaaattgcatttgctaaactactttgtagctagattcctgggtgagattagatttggtcaattagatgttcttgtgtaacatttagaaggtgatagtaaggcaaaggtcatgtgactggctgattttatttatgttcaatgatctttattggggtacactttatatataataataaataatgcacacattttaagtgtacaatttgatgagttctgacaaatttatatgcatgtataaccagcatcaatatcaagatatataatgatcccctcattccagaatagtctcttgtgttctttccagccaatgccccacccctggattctggcaacaattgatctgctttttattaccatggattatatttgtctttcctagagatacaaataaatgaaataatgtagtgtgtcctctttaactttggcttatttctctcggcacactatttctgaaatttgtccatactgttgatatggcagacagaattttaagatggttcctaaaattcttgcctcctggtatgtataattttctctcggttttccgctgaacactaacctaggtgctattgtaaagggatttctcaagtgtaattaaagtccctaataagtttattttaagttagaaaaattttcccaggtgagcttgagctaagtgagtgacctaagcaggtgagttgttagaaaaaaattaagagatatttgaagcgtagacaaaattctgttggcttttaaaagaaaacttccatgtgatagagaaagccagatgatagggaacacaaggttacctctaaattgacaaccagcaaaaaagctgagacttcagtcttatcatcataaggaattgaattctgtcaacagccacgtgaccttagaggaggcccctgagccgcagatgagatcatggccctggccaataccttaaattcatcctggtgagatatgagcagagaactcagctatgccatgctcagatttctcacctgtagagcagtaaattaataagtgagcattatttgaagctgctaagtttgtggtgatttgttacacatcaagagaaaacatatgctgtatatattattagatttttcctttatattggtgggtgtatttgttatctattacttcctaacaaatcgacaataattaagtgtcttaagacaacacatatttattacctcatagtttctgtgggtcagaaatctgggcatggtttatgtgagttctttgatttaaagttgttggcaaatctgtaaacaaggaagcagtcaggaccgaggtctcatctgaaagtcaacttgggatgggtctgcttccagcctcacttaacataacagctggcaggattcagttgctcttgggtagttggattgatggcctcagataactaggtagctattagctagatttcaccctcagtttgttgccgtgtgggcctccctaaggtggcaatttacttcatcaaaaccagcaagggagagagttggctacaatctctagtaatgtagctacagaaatgacatccccttagcaatgagatattttattaattagaaagaaattactcaacaggaggggattacacaatgtagtgaataccaggaggctgagatcagaaggagctagtgtagaagctgcctaccacagtgagtagtattctattacatgaatataccagaatgtctgaatccacccaactgggcatagacgtttgtgttcattcaagatacagactattattattttaaaaataaaagttactatgaacatttaagtataagcttttgtgtgggcgtgtttcatttgttttgaatgaaattgcagggtcgcatagaaaatgcatatttaatcttataagaagctgcttaaaatgctttgcaatgtgattttaccattttacactcccaacaatgtatagcaatatatcatagatctagtggtttcatatctccacaaacacttgatattgtcactcagtttaattgtagctacttaaataggcttataatggtactcgttatgattttaatatgcatttccctaatgcctattagggactaattatgttaagcatcttttcatgtatttggaggccatttgtgtaccttcatttgtaaaatatctgtttaagtagcttgcccatttggattgctttacattttattatagagtcataagcatcctttatatattctgaatataactctttt

SEQ ID NO: 97 - DNA, 7156 bp, Homo sapiens
aaaggctatgtattctgagctcatctggatcagaggagtcagcactgtcatttgtgtttggcagagactgaaaggcagatgttcgtctgaagatttcaaagcccactgctgatttaaggtcattcacattcagccatgaagctgctctgaagacacaggaactgcatagctccctactgggaatgtcaagggctgtgaaaggtctaaggttttatcctacttgcaaccaacaagctatgcagccacagttttatggatgctgtcaaaagacatgacactcctgggtaagagacgaaagactttaccacttgtggtgtagtagccagctggagcatcttgtgttttgagttagtgccagttgtcccctaagtcccacagcatgcagtttaggctgctaacaacagcatgagggcaacctgctgtggtgacctaagctatgacaccccaccccaagtccgggatgcagctaactgagcaaactgcatgaactgggaggcggccgaccattgttcacgcctctccttcgcgtatgtgttttctactgttcttgcactgtaaaggcagaggttgcatcgggcccttatgcaaagccccaaataattactggctgactcttctcagggaacatttgctaaccctgtcacaagccataaggttccaccacagattgccctgtggctctctcgttacgtttctgtgtggacgtttccacatggtctgaggcattcatccaagaagagcaggatgtattagtgactgcacagattctgccttggcccacaaagaggacatccagggcagtcctggtcatctgtaataacattgcccagtgagttgaggctgacctgagtactgacttgggttgagttggtgtcactgatcacttcagccaaagatgggacatttcttagcacctgttctgattggctgacttctatggtcaggataacggctctcaggatgcgtataactgccaagtctctccgggaagcttccctgggttaccaaggaatcctcatgtctgagagagctccaccatcatccaagggccacacggagtttcttgcaatgcttcaaggtctcctgtaataactcctatgatagaagtcactgtgttttggggaggtagactgcagcatgcagttttgacagcatgaccaaggtcattgttcaggtctgattattcaaattcaaaaaactgcaacctcaggcataaaagattaaggatggagcccaagtctctgggtccccaagggggactgaagcacatactcacccatctgaatatgctggagaacaggaaggagagactcaagcttgtctgggtctgttggatacagactctcccatctccaccccatcaggtcctatggaggcccaagttcagctgatgaagttaagggagtgctcagtgcagaagggtgggagggcacttggggcattttggggtcctgtttttgttgcttctgcatctgatacagcaggaattgaagtattgcacacttgtccttcccatttccaagtgctgccttcccatcagtaagagccacagttagagagggaccaacaggaggataactcccacatgcttagcattccaataatggaacactaggcataaattgataagatgctttcaatgcaatcagtactctgccaggattcactaagtagagaatgactaaatatttacccatctcctaacaaaaatgcacaactgaggacagatgttttgcacttttatgtgtctacggactgtgtaagaggatttggctgggtcatcatcttcttcttcttcttagactggttgatggtgaccgttcattgatccaatatggtaaagtcatgtcctggtctgtgttcttcggggtccacaaccctctttaacagcctgttgtaaggttctcgaccacgtcactgtctagctaaaccattctgcatttcagtaggtaaaccagcaggagggcttaaaaaccacattgccctgtccacatccctatttctgattcttttctggcctgcgatcctacatctctatcctcactttaaactgttttcctcttttcttctcctttttcctgacctcctttatgtttttcatttctcctccatctgaatataccaaaccatccttttgcttcctcttttctcttcattaattattctaggggctattttttttattaggaagatgtattattttaacatgctttataaagttagtggcattaaggaattaatgtccttggaaactcatacatgttcagcttctagaaacccctgattccaaggagcaaaaacatgccatctctgacagtgtccacaagaacaataccagatcagacgataaagccaacacacagcatagccaatggccacacatccagaaaacactctcaacaaatttaacccttcagtattcactgtagccaatatatattcaatatatatagctgactttgtttttatatttgatgaagtcctgctatttgaaataaaataatcaaaccaacaacaacaacaacaaaaaccccatacatggtgatagcatatgtgaggcagtagcaatttctccatcttttctgtcctgtctttcctgttcttcgttcccatgctaagaagggatggatatatctcggagattacacaggttctagtcaaagacttcattgtgaacgtttgtttcacattttccctggataaggactaattaaaagtttggaaaagtatacctttttttttttttttttttgcaaacttacccatattatgtgctttttcttgatacagctgctaatctttgctgtatatgtagtgttaggaagtctactttaatacacacacacacgtttaatgaggtaaaatatgcataacataattaccattttaacaatttttaagtgtagagttcaggggcaagtacgttcatgttcttgtgcaactatcaccaccattttttctccagaaccctttttatcatctcaaactgaaactctgcacccactgaacaataactccccgttctctcctcctcctagaccctggtaacccctcatctattttctgtctctgtgtatttgactattctaggtaccacattaacgtggacttacacagtattcgtccttttgtgactggcttagtttatttagcataagatccccaaggttcagccgggtgccgtggctcatgcctgaaatccaagcactttgggaggccaaggtgggtggatcacctgaggtcaggagattgagaccagcctggccaacacggtgaaacctcatctctactaaaatacaaaaattagctgggcctggtggcgggcgcctgtaatcctagctactaggtaggctgaggcaggagattagcttgaacctgggaggcggaggttgcagtgagcagagatgggaccactccactccagcttgggcaacagagcaagaccctgtctcaaaaaaaaaaaattcaaggttcatccatgctgtggcatgtgtcataatttcatttcttcatattcctgaaatacatttctaaatataaatttttcattactgttttcatttcaagttaagtttatcagatcctgtagtccagggacttcagtctctttgaattatgtctttcttggacaatttgggagctcttttgagaaactgaatacaatttgaatacactaaaatctgaatcacaccatagataacgacatagtgtcttagtgagaagaaatttgattctgctgactaggatactaaagtttgacctttatggtcatctcttaataaaataaaaggagagcactgggctattaaatagtttattcatggatcatagggtgaataagacctagatcctagaggaaatcctccccacaaagacactcagacttttattcctgtcaatgttcttgtggatttcagggagcaatgatggctataaatctgcaactcatagcatttcaggctaaacacattcagcctttattaccattgttcatttgacctctttatccaatttttttcccacccacttgccaatatcaccttgttcttatgtaggctgtgtttcagccagcttaagccttactaacaaatgaggtgaaatccatctgaggaggaagccggggcatggtggattgaaatagcttgcctcaggagcagaaaatttggtgtggatcaagaaatagaactccaaagtatacctttccagtcattggctttagctggagccagcatccttcaatgaatcagtcaacatttacctatctgttccccacagcagttttgcaaatcgctttcagaaatcattgaaccactaacagtttatccactctgcaaaatatacacagctcttcccatatccaggagggttatcccttctcagctgcgttcaacactttttacaacccctgatttcaataagcagaatacatccacctgcttagggaaattactcttaccatataattgcctcttatgttgaaatgtccatgagaccctctcatgaaataggggacaagataaagcacagattttcccccaactcaaacatgcctgtctcatacatgtcatgcccttggaaatggccaacactgctctctgcctcctgtttagggttaaggctttcactatctcttgccacctctgatgaaattactaacaaatatattatccttaccctttgtcttctattccagcacttcaaatgcatcaaaggtccagagagaagcttcttctggtcaccttgatcttgtgatgcaaggcaggtgggagcaagggctccacctctgcagacacagagatgacggggtcgccatgccggcgttttagtcccggtttcctctgctcgagtagttggtggcctcctgcctgttccctaacataacttcactttccttacctgcaaaacgaaattagtatttcctccctcacaaggttatttgcaacttacctggctaagctgaactccagaatttggactagaggcttcaggatgctggtgcagttcaagtctggtccacatgtctcctcctccttcgagggtcattgactactttgtgtatcttcttttcatgacagttcatatgagtgcaagatggctcgatagacttgcacacaagtttaaagatttttgtatacacctcattccattgttaaagcaagttgcatggtcaaatctaacatctctggacaaggacatgcattcataccactctactgcactgcaagctcacgcagaggagcagatcataaaacgtgattgatgcatgatgatgataatgaccaacctaccatcatggacatgaccgtatgttgatactaagcctcttagtaaaatgagctaaagaaaccagaactatctgccttcagctcagctgtctgatcaaaaacttgaaatctggaaacagtggtatctggaaaacctactaaaagtggctttgggaaaatatcaattaatgtcaatttcattaattattcagggaaatccaatccaaaatatcagagatgcttacgtagaatttggaaaactttaattttcaccaaatactcatgtgctttgggcttacagcatatgaattttggcagaagagaagtgaaccagaatagaaggaggaggggatatttaataagagattacaaaaatgctttctctgggtaagagatgtggtcttcatttaatgttcaacttaaaaaaataaaaattataccatggaaaatgtgtgatttacaagatatgttaacaagtaataaaacctaataagtggatttgtatttttttaagagcataaaaatatcagtttggctattcaaatgcattaggctgttatttaggtcctctttttctttatgtgcccagtactttcatctttagaccttactaatgctagatgtcttcttgtcttacttgatagttttatattatattttattcagcctagtgatgggaagaatacgtttacaatatgtttacattgcacattagtttcttgtcatatttccagagattggataataactgataacaagagacagggaggttttcaggattttaagtccttttttctaggacttgcttctttttgataaagcagtctctacactgggtctttatatagagtacttttctctctgtccataaatagacttggttataggagaaatggcggaacagtttgagagtatggagtttcaaagcagagctcattattgatgttaataatttattaatttattaaacgtggcatgtggagtgctgttctaaatgctttcatgcatcgatgcatgagggtgctgtgtgcagtgatgccgggtcacattgccaggatcatcctcaaggactgaatgacccatttgcaggagtgtcaggacagtggatgctgactgatcacagcaaagtctgtctccaggaataacccctggccgagcaagcagcctcactcccactggaggcatccttgaagggtcacgggccagcacagttccagaagtccccctacattagtatttatattgtgtgattaattcagctacttatgttgcatttatatttatgttttttgattattgctgtgtctatgtgtttatgttttttgactataatatttatgctgtttgtttaattctgtatcaattaaaaaaaggaatgaattaatggcattcgcagcaacctggatgagattggaggctattataaatgaagtaactcatgaaaagaaaaccaaacatcatatattctcactcataagtgggagctaagctatgagatgcaaaggcatatgactgacacaatgggctttgaggactcaagggaaaagagtaggaagggagtgagggataaaatactacaaattgtgtgcagtgtatactgctcaggtgatgggtgcaccaaaatctcacaaaccaccactaaagaacttgctcatgtaaccaaacaccagctgtttcccaataacctatggaaataaaaaaattaaaagatttaatgaaaaataagtctagaagaagttcttaacccttagagtcttgtggtcacagacatttagatccatatttttatatcagcaaaataatatggtgatgagcaaagcactttgaagcatagaaacatttacattaacataaaattatatggaagaaatggaataatgtttatattcaag

SEQ ID NO: 98 - DNA, 13201 bp, Homo sapiens
actccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcgtataagaagaggcatcccggaaggggcttcaaaccacttaggaccgactgctgaaacgaatccaagcttgtggtgtctgcagaatttaactgtccgcctcaaccccagtttttgtttctaagattatcgaaaactgtgcggtttgagtgatgtgctacaaagtgtttaaaacagattgtttcccaaattaggggtttccacacaagaaatcgctgctgtcggcaaacacaggaactatctatggttaagacaaggtggtgttcgtaaccaaactataaacctacatatacgaggtggtaagagaaccagaccaatgaacagtttcaggctggcgtggtgtgcccgtgaacaaagaattgtaatactggcaaaaatctaaattgctttctttccctttattttctcatcactaaaattaggaaaatgaacagatatgtcaaatctcttctaacacccatgttctgtaactctcctcgtatgtaccttataataagacaaaggtaaagacatttccatgtgcagcgaggaaaagtaataataaaaattaaaacaactagcaagtatgaagccctctttttatacggtatgtgctgtataagcacttccctcatccacctctatgttttcacagcacctctcaagggcttggacacgtgcaaatgcaaactggcaaagccaggagtcaagccaggctgctcagtggcctttgtgcttcaccccagtttaatgcacccgtcttcagaagggacatcgtgtattaggtgcttcaacacaagatccacgaatatctcgtacatccctaaaatcaagcaaatgtcatctgaacccaattactgggacagccccctcattactcccacttacttttagccgtatcttccccaatccaatctcaagtgtgagccccaaaatacttctgatttttcacgcctccacttaaaaatcttttgattatgtcatattgccgttagggtaaagttcaaacaactcagctgattttgagggctacattggtgggtggtggagtactgcccgctttcccttcatactgtcatgacagtgaggttctgaactgttctttgtgcaaaccccacacgctctctgctctctccattcccatttttgcacgtgtgagtctgctgtctcctcttctttgcttctccttttcctaagatttgccaagccaactactctacacctccatcggattttagtttacatgtctctccccatgtttctccccactagaagcctccgttgatgatccctttctagactgtgatggacgtacctcccatagctcccattgcaccattgtactaaacttggaccactgcaactgtcatgtgtctatttatcccacatgtatataaacgctatatgttgtttatcactatatcttcagtaataataaacaggtaacataattgcataagtgtgtatatcatagaccatcatgaagtgtttattgactgagaaaagaaatatacatcgttgtgaacataatgaaagacgtcatttttcagaacaaacagtttgataatagatggtattgatgagggggtatgaaaacaaatgcttcctcaaatttttgatatactttaactagtaaaatctctctgatggtaaattttacaatatctatccatgtttgaaatgcatgacctaattaactaagcaatttcacttctaaaaattcgtcctctgatatacttgtaggtatacacaaggatttaagattgaaaacaacctaaattgttattcatccaaacaatggaattctctggaactgtcaagatacataaggcaagttaacattcattaatataaaacaatctcaaatatataatgttaacaaaaaaagaaaaacaatgctcagagtatttagtagtatgctatcatttatggagaaaagaagatctatagagatataatatttctggaaggatacataagaaaatggtcacagtgaagcggagttgaatggctctagctagagtcttgaggttttgcctgattcaataagtacatgccaacagaatgtctcccagcctatcagaaaagccagctggacctctcaagtgtgtatttatatgtttaaatagtgtattaatgggttgctaatcagaggaatattgggtttttaaaaaaacagtcattgaacattaactctaacttaagacagagcgacatttgggaagcacaaataattccagcaaaagacaaatgaattctgttgtggggtgatctcctgagaagttacttaaaatattagtcattctcttagacaatttattttcctttctatttttcaacgatcaccaagtaaccttgtaattattcatcctgcttcttagtttccttgacactaaaaagtggaatccttgaaaatgggtcaaaagcattctaatcacaaaaataaattgacattctgctttgaaactgcattgcatgtgattttgagtaacataagtacataaccaagaaaatgagcatctctgggtatattgaaacatccagtgtctggacctggaagtataatctcagacctcagatggacaatatttccatgactgggcccaaagccatgccccatttggtgagcttcctaactcacctttctattattaattactgttcaatctaaaacaggtgtcatcctagtcttaaataccaaccttgagtctcctaaatgccgagcttgataaaagggcttcaatgtgaagtttgaaagaaagaagaaaaaaaatttaagtctagataagactgcaagaccagataataatgagaacattatatttaacatttttaaatgtatgtagttttcaggaatttcaggaattttccagaaataacacagaatgtttttttaaaaagtgacacatttaaacatgcatatgcacacattggagacctcagttatgtataaaaccaggaaaagataatagagcttttgaaaatgttgtcactgaggaaaaaaagaaaaagaagtttccaggattaagtttccaggatgtatcatgttgtacagaaatgataactgagctctcttgtcaaagcctacaaggccccacttggtctctcctgtgcctcctccatccctgcagtccctcaccttctgactcagctctcctaacatcccatttctcatacatgctgtattagtccattttcacactgctataaagaactccccgagactgggtaatttacaaaggaaagaggcttaactgactcacagttctgcatggctggggaacccttaggaaatttacaatcatggcagaagatgaagggaaagaaaagaccttcttcacatggccgtaggagaggcagagcagagagtgaagggggaagagcccctcataaaaccatcagatctcgtgagaactcactcactatcttgaaaacagcatggggaaccacctccatgatccaatcacctcccaccaggtccctccctcgacatatggggattccagttcgagatgagatttgggtggggacacagagccaaaccacatcacatgctgagcttattcctgcctgcccgtaaagctctacctcagaggttcccagactttctcagttcacaccaccctttactgaatgtctcagtaattatttttcctggcacttctaggctgagatttatgaagatgaacctaacacttatgtttattaagtattcagatgctaacaattcaataaacatttacttcttgacaacattagtagctatttgaaaaaaacataaattgaaagaaaaaatgtttgtacttcatttgtaagcagccacaatcacttaccaatgggatagtaatgggcatgacacaacctctcaaatcttaggatcatattagacaccaccaccttcatttcctgttccacactaattttcatgtggtattgctccttaataccacatgaaattgcaaccaccaaaacccagctttgcaaacataatgatgtcactgaaagaatgtagtgtaatctagtgttgaaactatcaactacattgagtcagtagtatgcatggtgtctaacaaatgtcaagtatctctgagtttctttcaaaattttaatatatcctgcggtgcccctgtgaatatacggcagaaacctgagcacctccatgaacctgagcacaattcctgaactatggttcatatttttgtattgtgtttgtttttgtctgagttttctagaaaacagatcctgaggcaaaacttacaagccaagactttatgtgaagttgtaattccaggactcaagaatgaaggaaaaagagaatcaaggctgaaaaggaggggaaagtaaattcaaggtggcgagttatgaatgactacagcatcacaaaacaacatacctgctttcttggtcaccagcacttcttccagacaggacctacatcattatatccagaaacattctgtccacaggagagagtggagattctctgccaatgtcttcttgtctcctgttgaaactggttgaagtttgtcccttagagaactaattaattcaccctcacctccaggttctgttactggctctttatggcaactgctagggaacccagatcccccagtgattggaggaacctctgaggatacagactgattgcacctgagcaccaaacttgtgagtctccttctaatgcaatctcagtggaatccagtcactgggagaggctgaggtcactggcacagttgggatatgaggcactggcaatggcaatggtggcttgggctggccactgagcaagcaaagacacaaaggtgtgagagaatagatggaagccagccattctggggacataaattgtgtcttatgtgctccaattcttcttatcattcaggtcttacttctcatgttatctcatcagagaagcctctcgctccctaaactgcccttctcagccattagctaacatagaactgtgtctgtgttaaactgttcccgtgttcaacctagagttgaagattgtcagacttatatcatggccataaaaaatatgaagctacagtgggagcttgctgaattagtatggagaaaaatattttaggttctattgataggaattgatttcaacaggcagtgtctaagctagatttaactaaaaatagaactattatattgcaaggagggaagaggtctttagattacccagtccagccccctctcatgcatggtgctcccacagcatctcttcatgtgatttttttttttagacttaaacaattgaagttacagaggagtcactactttctaagacaacctagtcattttcaacaggctctgtcataaagtgctttccattttttttttttatcattattcctcattcgaactgctggtgtaccaaaaaaacctatgtataatttacaatgactgtacttgagcagctagtttgcggggggcaaattgaggaattagcttgcattcccactcaatttcctcttgctgtgttctgactctcactctctcaggcaaaagtctttgggatccagagtctgacattcattgcattcactatttttcttggttacttatcaagagcaggcctgatctgcagcaaactcaatgaagtcaccaataaatttcctcccaaaaaggataaggttggcctcagaatgtgcaatgcactcctggaaaccttaattcattctgacagtcatttgttttacaggcagttggtaaatgtctacttgtaattataatgtactgttcaaggtaccagtaattcagtgaggaaaaactaaagaccctgctcttttggtgctaaacattccaatgttccactaattaataacttctgtgtatagttattaaaatccatattaaaacattcagctggactctcattcaatctgcattcctgtatttgtgtgcaaagtttggttggtaaactatgcctaatattctttttattgcatttccctaaggtatcaaacaagaaatgctatcaaggaaaatgatgctaatctaatatgactttttaattaatccatttagatttgcagggaacatatatttactgtttcagcatattacaaagactttttgagcctcttcgtgtatgaacattctgctaatgctaaggattcaaagatggatacaattagataacttccctggaagagactaccatttaattgtaataaatgaaaaccatttcctttcgtcttcacttctttttacgtagagtaatgaaagtcaagtggcaaacaccttgaccttttaacttaaaagccattcacattccctttctccatcttcctagaatatagagatgtacaagatgaaatgctttcttttccactgcccttaagtgaagtgtgactatgtgacctggttctgaacaaggagatcaaagccaaaataatcaaatggagcttcttctggagatgtgttttattagtacagaaagataatatgccctctcagtcctttgcccttttccttcttcatgcttagagaggagctcaatgcccacaagtataataaccgtcttgcaaccatgaaaatgaaaaccattcactaagcatggaagagtcagaaaatgtaataggccttagtccttgatgacttctttgagcagttgccagccgactacagtccacctactgctagactttttattatgtaaggaaattaaactctgatctgtataagccactgttaagtggatttatttttttctttacttgcagccaaatgcattcttataacatggcacaaataaattcagaaaaatacttgatatattgattgaaatattcataataatccatataaaataagatatttggactatcttgtccctaaaattatacttttatggataatttccaaacttaactataaaattagcaatattactctttaatcaaataatctcacttctagaaatgcatcttaagaaaaaaatcccaaatgaagattccaagtaaagaaagatatttgttatagaattgtttataatgttaaattaaagaaagtgacttagctggtcaacaataggaaaataattaagtaaatttttcaatgtccagtggaggaaccttatgcagacctccaaaataatagttgtgggtctaagtagaaataatacaaattgctgatgatgtgctaaatgaaaacactaggatataaaattaagtgataccatccttgaaactatatagaatatgaataaacaaagaaaaggaacacaaaacaggaaattagttgactttaaagataactcttaatttttaaattatttatagtgttacacttgtaagacattttaaatgataaatattattttattaaatactgtattattttaaaatatatcttctcttgtgcctctaccagggacagaggtattataaacctatggtttagaacactggaaaaatataaacagagctatagatttaaacaaacaacataaaacattttaattcagtatatagaggtaaaattgggaatgctcataaagattagaatggttccactcaagaatgaacatgaaatgtaaagtcaaataaggtaaagaaatttggttatggttttgttttccttgagtgtcatgcacaatgaagttattttaataattaaggttgtcttttgcacaaatgaaaatggcaataataagatgtcagagctgtaagggatgttggagattatctgtcatcatctttcactcacaaattaagaaacagaccttgagaagataaatgactcacccaaggtcacataagtagtcagtggagaaggagcaatgaagttcaggtctttttcaatgttattcatcccccagaataaacacgcattaaataagcattcattaagtagctagctattctgtgctagctgtatttggacactgtgaatatacgggacactgtgtttcacactctacacaaagataagttgtggacatatcctacccttaaaggatcagagttttgtggggtgaacattagggtaataattataagacatattgatataagtacttgcattctactaagttccatgtgccttggggcatgaccttgaaggacataacataacatttggtgtctgagaagtctcaggaaagaaatgacttttgccttatctctaaaggtttgagtgaaattttaccacccagaaacagcacattgcaaaagcacagaaaaatgaaaaacttgggtgttctacagaatgcagaatacattgatatggcacaaatttggaatgggggtaggtggcaaggaagaaggggaggcagatgaggctagagtggggcaagttacagacacttggagagattcttctattctgaggattttgaaatttgtggaataggaagataaaatacatggattattcctaggcaggaaaaatggtataatcatataatgtaagtttcagaaatgtatcaaggtgtggaggacaaagctggacaggaagaagcaggaagacaagttatgaggctattgaggtagtctgtgcaagatatactaaggacctgatatgaggaagtgacagtgggctaggaaagggaataaatacttgaaagatatttctgaggtataatttttaaaattttaacaaattggttgtaaatagggaaatggtggaataagagttaaatccaaccatcctgaagtagtttaatcaataagtagctctagaaattttaggcaaatttaaataacacaaaaaccctaaaagaatttaatttgctcctatctgtacgtcacaaagtgatgctcaaaacttccataattagcacatcaaatctcttggtaatcaaatgcaagttttgcaagggagatcttgaattaagaatatatatcacacttaccaagactgaatcaggaagacatagaaatatgaatcagatctataactagtaatgagattgaattattaatcaactatcaaacaaaggaaagtccaggaccaaatgggtgtcactggtggattctgctaaacgtttaaagaagaattaacactaattatcctcagactcttccagaaaattaaagagttccaaactcattctataaggccagcattaatcttataccaaacccagacaaaaacacttcaggaaaactatagactaatatccctgatgaatattgacacaaaatcctcaacaaaatgctaccaaacagaattcaacagcatatttaaaagattctacacaatgactatgtgagatttatttctggaatgtgaggatgattcaacagatgaaaatcaatcaatgtaatatatcacattaacaaatcaatcaatgtagtatatcacatttacaaaacgaagggtaaaaaaaactcagtcgtctcaattgatataaaaaagaacctgacaaaattcaacaaccttgaataatacaataaaataactcaataaactaaggatagagggtaactaccctaacataataaaagccatatatgaaaaattcacagctcacgtcatattcaatggtgaaagactgaaagctctgtctccaatatcagaaacaagacaattatgcccacttttgccatttctattcaacacagtcctggaagcttaagccagcactattaggcaagaaaaatcagtaaaaggctacacactgaaagaaagaggtaaaattatctccgtctgcagacataatcttaagtgtagaatgctttaaagatttcaccaattattattttttaaactactagaactaacaaattcagcaaagttgcaggatacaaactcaacacaaaagaagcaggtgtgtttctatacactaacaatgagcaatccaaaaaaataagaagcagcagccaattccatttacagtagcaccaaaaataataaaatacttcggagtaacttaaccaaggtggtcaaaaaattgtatattgaaaactacaaaacaatgtttaagcaaataagacacaaataaatggaaatatatttttgtttattagttaaaagacttaatattgttaacatatcagtactacccaaagcaatctatagatttatgcaattcctgtcaaaataccagtagcattttttgcagaaatagaaaaatccattttcagattcatatgaaatcacaggggaccccaaatagccaaaacaatcttctaaaaaaagaacaaagatggaggttttacatttcctgatttcaaaacttattaaaatgctatattaatcaaaactatgtggtactggcataaagacatgcatatagaccaatggaatagaataagagagctcagaaattagctctcatacatagggtcaaatgatttttggcaagagtgtcaagactgttcaatggggaaacagtgtctcctcaacaaatgatgctgggaaaattggacatccatatgcaaaagaatgaatttggacctctatcttacaccatatacaaaaattacgtcaaaatggatcaaagatctaaactgaagacctaaaactataaaatgcttaccagaaaatatagaggaaaagctttatgatattaaatttggcaaagatttcctggacatgacaccaaaaacacaggcaagaaaagtaaaagtagacaaattgaaatatatcaaaatataaaacttctgtgcatcagaggacacaagcaacagagtaaaaaggcaaactatggaattaaagagaatatttgtaaatacatctgataaggaattaatatccagaatatattaagaactcctacaactgaacaacaacaaaaaaataacctgatttaaaaatggaaaaaaatctgaacagacatttttcaaaagtgatatataaacggatataaatggccaacaagcatatgaaaagatattcaacattgttaatcattagggaaatgcaaatcaaaaccaacaatgagatatcactcacacccattagaatgaagaagaaagaaaaaaaagatggaaggaaggaagaaaaaaaaagaaagaaagaaggaaagaaagacagggaaagaagagttgataaagataaggagaaattggaactttagtgcacgattgggaatgtaaaatggtgcagacacaaggaaaagagtgtagcagtttctatatgatccaacaattccactgttgcacatatatatgcaaaataattgaaggcaagatttcaaagagatagttacatactcatattcatagcagcactattcacaatagccaagaggtaaaaccaacgcaagtgtccattaatggatgaacagataagcaaaatgagatctattcatacaatgcaatattaattagccttcaaaaggaagaaaactctgacacagtcaacaacttggatgaattttgaaaacattatgctaagtgaaataagccagtcacaaagagacaaatactgtatgattccacttaataagagatatctagagtcgtcagattcttagaaatggaaagtagaatggtgattgccaggcaccagggcaaggtgaaagaaacagttgttatttaatgggtacagagtttctgttttgcaaatgaaaaagttctggagattggttgtacagcaatgtgcatatacttaatactcctgaattatacaattagaaattgttacaatggtaaattttatatatattcttaaccacaatcgaatttttgaaaaaagaatactagtggtggaaaacctctgaaagaagggtaaaaaactatgttatgggcaacaatgaaaataaatttacactgaggccacaaattattgaaattcatctctgactttaagtctcagaccatgagcaaggaaaataaattctcttaagaagataggcccaaatgactaagagtcaggtagaagcaatttgcaaagcaaggaaagaaataatttcttgatggagtcatctacactgtgatgccaatccctgcaccagttttcgttggagcgtgccctcccctcttcattaatcaaaggtaatgcagaattacagaatggaattacttgccaaagagttttccattttctgtccctgagatgatgctgattggagcgagaaaagttttctgaggacaaatgctcacgctcttagcaccagagtttgcttgtagcaaaaacagaatgcttagaggtgtgcttttgttattattctcagtggctctggtgagcccagtgcaatcagcgatactcatccaggccaattcaccattagggagccgcacatgaaaccatttacatttcccattttgtttcaagcaagtcaggtctttaactggattgtggtaattgaaccttcctgttacaacactgcttttgctgcccaacggattcaaaagctgctctcgttacatttatttgaacttttatttcattcatactttatacctctggttctcaatcttcagtcctgtagcgaactctataaaaggaaaaagaaattcttacagactctcacagattcatttaaattctttttttgttttattttattattattatt

SEQ ID NO: 99 - DNA, 3564 bp, Homo sapiens
tgaaattccacatcctcgggctgacaccgattctaaatgatcaaaggcagaagatttataccagataaagccatatggattgctggtctaaaattcaaggcaggttagttgacttaattctttggtgctggtgactgttagtttgtaaaagttcaataagtcagatgaaggaagggatggtgccgggagctgtcaagctgtactggtggggtctgtaattagagctaactggagggatcatgatgtctactgtccagtttggtgttgagccatggctctcggtagaagttgccggctggggcctggtcaggactggaaggagagtggtgggatgtgctgtgcctatggtgggctagctgcagccagtggggtgcctgccccacactgctgcccaccccttcatcagctgattctgctcccacataaagaaaggtgttggcttagtgtcacttcttcctagagccatgggagttttctgtcagcatgtttttgagctgtcctggtaacttggacgggaagcagtctggaggtgggtgccttccaaatctctgccacagaatctgaacttgcactttgcagcctgttagtcagagctgctaagtttgctctacctggtgtgcctcttggcaccacctgagagatgtatgtagagaggctgctaagaaatgagtgcccctggcatgaagacgtcatatcccagatgtttaacttctggctggagggagggaacttaatttggttcattatctactgggtacctttcctgtgcggaggggaggaccagtgactttccataataagctttctcctttaaaaaaacttcagactcttacttactcttttggttcacactaattagcattcattttccagagaaagctgcttgactttgaggaaataaagacaggtgtccttaaaaatggactgcaaatctggatcagtgtcaggtctgctttagggtccatgaaatcacccaagagtgttggtactaaaagtggtgtaggctgggcgcggtggctcgcgcctgtaatcccagcactttgggaggccaaggcgggtggatcacctgaggtcagacattcgagaccagcctggccaacatggtgaaaccctgtctctactaaaaatacaaaattagccaggcatggtggctggtgcttgtaatcccagctacttgagaggtcgaggcagaatcgcttgaaccaggaaggtggaggttgcagtgagccaagattgcaccactgcactccagcccggttgacaagagaaactccatctcaaaaaaaaaaaaaagaaaagtgcataggggtttgttcccccaccctctgaaagaccccaaggaaattctagaagcaaaaatttgacctcttggagcacagagactaagtataagtggaagaagcagacctaaccctcctcccaggcagtcagtcctatgagttttaggctgaggtttcattttagcctctgatcgatgtatctgtaaagctgatctaaactcccagtttcctagaagccactgctgtgagcctgggggttgtactgaatggctctgctggcacccaagagcagctgactccactgtcactgcccccgtttctgagcctccagacaggttctgggaggagccagccccctatgaattgtatcacttgtatagatagagatttgacttcaggacctccctggatggtggagattgtgtgtgcccatgtgtgcaaggagatagatagattctcaatccagtgaagcagtagccagctagaacagaacactgattgtgggctattaaaggagtttctcattagttatggcaccagattcccagcttccattttggctcaaaaaaggagcctaaaacccacttgtgggataatttaataagccattagatgcttggagggcaccaagccagccttgttgctgaaggatttactagaaagggcctaggagtccttcttccctttttgcttgctcttcccctagccccagttaatttaactatcactgtaaagctgctgtaaaccagaatccagttttttattcgtaaggcaccaggatagaactgttcttgccaccctcctatttcagtaattgcctgaatttccctgaaagggtgacatacttcacttcttgacatttaggaaggacagtggccactcagtggcaggtgactgtcccgaggatgcagtagacaagccagcatgctggctcagactgtaaattaggtagggtttgcatagctgtttctgactacaaaaatagcatgggtgttagttgaaacagtgcactgaaataagcagtggttaagttttgaacctgaatcctttaaagaaattagtctgaggtaaaatgttttaaatcatttttgaccttcagcttgtgcctctgacagagcttttgtcctaaagctgagagtagaagcaggattagatgtggtcatctgtggtgtggacacagcagacctgccatgtggactgacggtagatgggagaaccgcttgttagtgttctgggcttcctgatgatccccccctcctccccgtagaaagtctgtcatccgctgtgacagtgtcagtgaaaaagagaacaagtttccactgccagctctggccctcaccccaactcctttctctaagagtaacggggactgggcatagggaccccgggcaggagctagcggcatcctctaacaagaactacatctgtaaacaataaggagaaagccaggtggatagatgaaacctacaggagggcccttcaacaggcctaatagaagggtcacttccaaactggcacgagcagttaacagtgtcccttaaatctttctctggaaggaaggaaagatcaattacattcacaagttcacacttctgcctgtgctcctcaagggcagctgttgaggcctggaattcctcactggtcagagaggtgtgtactgattgtctatggcccgcaggtggctccgggaggatgagtccatttcgtagtccgagtcccgggctcgattcacaggctcatgctccaggtgctgcaggctgttggccagttcttcgggcgaaggcaccaggtggaagatctgctcggggggtgaggatcgccctgggagaccctctgggctgagcccccggggacagccagaagaactaaggtggggaaggcccaactctgaaccccagtgaggaagggactctgaatcccagtgaggaagggagaaagggaagaggaccgtgttgcaggaacctaggacaagtgaccaagagagaccacaccatcagtcttgaggcaagtgctgacaggacacagaacaagatacctgtacccctgggtctgcagcaagcctctaccctctacccagtgtcagccacccccttcagcaaagggcagtagggtcagacctggtggttgggagacgactaccacgtagctggagagccggacatcacaggcggcgccgcactcgagtgggatgggcgagcgctggaagtggtggagcatgtccacgaccgagggaaagtggaggtgctgcacacggcactggccccgctctgtcagcgacaggcgc

SEQ ID NO: 100 - DNA, 2986 bp, Homo sapiens
aacttggcctgtgattcattaaaatgtttcgtgaatattgccaatcttccccacttcgttagacttttcccctgcttctactctctgtgtctggctcagtcttgtcctggcctctaaatgtgtttattctatacagtttgtgtgtttgttcatttattaattcaataaatatttattaagtatctgcttatcttaagcacttatagtcacagatgttcataccattaagcatgccatccaagataaacttgaaaagtttttgggacttgatacattgcagaaacatcaaacttatttaagttcaatgtacacttgaagaatctgcattattttttcctatctagaaattttatactttaagaccctgagttactctttacatccaaaagaaccaaagtcatgagattaaattaaaaaagggtttggtagatccagagaattattagctgtcagtgttagggagaatagcattaacattttatggggtatttctactttatgcctatcacctcatatactataatctcatttcaccttaatatatataggtatgaagtatatatttatatatgtaatatatttatacaagtaatatattaatcccataaaaaggtataaaataaaaaataacgtatcttcactccatcatctctcttccctttgtatatatatccagaaaaaaggttttatgcatatacctgtatgtttagaaatacaatggatatgtgcatatatgtatatactttttattatatatgtataactttaattaacacaaatagagtcatatgatccacaccactgcctatgtagcttttaaaacataaatacatatgggagctgtttcctcaaaagcacatacagaccaagctcattactgtatttgactgtgtggcattccgtagtatgagcgtaccagagtatattacctggttcctattggtggacatttagattgtttcttgtttttataattataagtagttataagaatgtattaatatctgtgtcttggcagatatttttgactatacatctccatagaaaactttctaacatgaaatgactgggttaaagtatattggtatttagaaatttgatagacatagctgacttgctatcaaaaaatattatgtaaatgtacacttttccatcaataatagaagttgaaaacaaaattttagtttctttttccacacactatcgccaatattggttattttggcaaaatgatatttcatttttttatgtttctttaaattttagaagttgagcatattttcatgtttacaggacctttttattagttttcctaaaagcttcctgttcacagcctttgactattttctattgcaccatattttaaaaatggatttatattaggtcttttaaaattaagaaattggctttttgcatccacattgcacatagttttctaagtattttgtcttttgactttatgcatttttatgtacaaaatgttatatttctgtgtagacaatttatcattcttttaaaattgcatctaggttttatgtcctgtttacaaaagcccttccaattccaagattgtaaataaatttgcctgggccttattctagtgtttttataggtttattttgaaaaactttgattcatctggaattaaaactttttcgtggcataagaagcaatataatgatccatcctctttccagcccttcaccctttcttcttccctctctctctccctttgtcattggctagctacatgtcctaattctggttactgcatactccattcttacccctgctttgaaatgcctcttttatcatgttagtatctccagctcacatatgagaagctacactaacaaagatagtggcagagccagaatttgattccttgttaatttaaagctaaggtctgaccttttctcacttcagtgttttggattgatactgaggagaggcatgtttatcatcttttcaaatttgctttttttttttttttttttttttagtttttgtgggtacatagtaggtgtatatatttatggggtacatgagacgtcttgatacaggcatgtggtctgaaatagcacattatggggaatgaggtatctatcccttcaagcatttacactttaagttacaaacaattcaattacactctttaagttattttaaaatgtgtcatcttaatttagatttggattttatttattactttgaaactcagatcctcaattcatgccatactctcctcgttggtccaggcatgacttttaagttaattatttatttttaatataaataaacagccatatgcccaccactcaacctggaaatgaacattgatgaatatggtttttttcctttctagttccttgtctttcctacttgagtttccctattctaaatcttgtattgatttatctctttttttaaatatgggaaatacgttacttctggtatgttattataagaaaaataatgctatccttcctaaaaataatgtaatttagtgttagttatttttaactttataaaagaggcaagaagttgtatgtaacattttgggacttagtttttagctttttttttttttaactcaatgtcatatttctaaaattcatccatattcttattacagttaaattgttactgataatttggaaaaccgtcagcattatcttatacagttgagtctacacattctttacaactgataaatttcactctcatttatatatcccacagagactcttgcaatgcctaccagagataagtacaagaatgttaatagcagcatgtttgtaatagcaaaactctagaaataatccaaatccccatcaataggagaaaagataaataaataatgggatattcacatcaaataacattttgtactattaaaaattttaatgtaattaggctcatttaaatatttatcataacaaattcaacataatggagacaaccaatgtttcactaatttatgatg

SEQ ID NO: 101 - DNA, 1146 bp, Homo sapiens
ttctgacaggaggagtcacatgcctaggaagtatcctaacaggatgatgcagcatgaaggcccccctcagatgctggtgcaatgatcttggacttcccaacctccagaaccatgagccaaacaaatttctattgtttataaattaccccgtctcaagtattctgttatagcaacacaactggactaagacagagggttacacgtatctttcacaggaattccttggggcttaatacaaatccttgagagttctagcccagatgcagcctagaaatgtgaagatgaaggaggtaggtagtagggttgttattaatcctaggggaaaccctccactatgggattctgaaatcagcagataaatgctgcagcccccagacttgtgaagaaatttttgagattcatcttctctggttcttcagcacatcaccaaggcatggacctgcagttggctccagctataactagctcaatgatgcatccttcactgtttttctttctttccccatttttctctgtatgtttccttactttagcttcctgggatcaactcccaaataagctacctgaagccaactgtttgcccaatacactttcttcaggaaacccagtctgagacataagaaaacaaatcaaatgctaattcagtggttcagttggtaaaaataacagagactcagcctagttggcactagtggagataaagaaaagaggacaactttgttatgcattttatagacagtcatgaggcatgcaaattggtgtaatgtatgcagaaaaagaaagggaaattttcagtgtgatactacagttagtccactgtatacctagaattgtctttttcagagaaagatggtggcctttggaaaaggtacagatttgggaggaagatcgttaattcaatttgggcatgttatgtccaaactacattaaatacttgagaactatttctttaataatggatgagtgaagtcagttcatttccaagcttcttatttgtcttatctgtgaaagaaaaattgtgatgtctagtacccagatatgtaaaaagtaaatgtaatctaccacattaaagctcaaaatgctcgatgtttttgcaaatataaaataatgtgacttactttaaagataataaattaaatattaaac

SEQ ID NO: 102 - DNA, 2196 bp, Homo sapiens
ggcaacctgctggggtctccttccgcattgtggctgctttgttctttcgctctttgcagtaaatcttgctactgctcagtctttgggtccacgctgcttttatgagctgtaacactcaccgcgaagatctgcagtttcactcctgaacccagcaagaccacgagcccaccgggagaaacaaacaactccagacgtgctaccttaagagctgtaacactcaccgtgaaggtctgcagcttcactcctggagccagtgagcccacgagcccaccgggaggaacgaaagactccagacgcgctgccttaagggctgtaacactaaccgtgaaggtctgtagcttcactcctcagccagcgagaccacgaacccaccagaaggaagaaactccaaacacatctgaacatcagaaggggcagactccagacgcgccaccttaagagctgtaacactcaccgcgagggtccgtggcttcattcttgaagtcagtgagagcaagaacccaccaattccggacacacttccacatcttcaggtttgtcaggaagacctgcttgggacccctctctgcagcagagagcttttctctttctttcgcctattaaacctccgctcttggccaggcacagtggctcatgcctgtaatcccagcactttgggaggccaaggagggcagatcatgaggttaggagttcgagaccaggttggccaatatggtgagaccctgtctctactaaaaaaacaaaacttaccctggcgtgggggtgtgcgcctgtaatcccagctactcgggagcctgaggcaggagaatcactggaacctgggaggcagaggttgcagtgagccaagatcgtgccactgcactccagcccgggtgacagagcaagactctgtcaaaaagaaaaaaaaggccaagcgcagtggctcacgcctgtaatcccagcactttgggaggctgagttgggtggatcacctgaggtcaggagttcaagaccagcctggccaacatgatgcaacaccacctctactaaaaatacaaaaattagctgagcgtagtggcgtgcgcctgtagtcccagctacttgggaagctgaggcaggggaatcgcttgaacccgggaggtggaggttgcagtgagccgatcacgcctctggactccagcctgggagacagagcaagactccgtcacagaaaaaaaataaagaaaaagaaaagaaaacctcactgttaacctcaaaaaagatttgtctttcattatgtccctaaatacacacatcagttacttgtagcatgcatattcccatttcaatgctctattcacaaataaacgtcttttcctttagaaagcatgtttctgttttttatttaagttgacatatatggtgtcggaagtgagatctgaacagtatcactacaggaaggaatcagcaatctttggaactggtgtgcagtatatatttgaactctttgagatctctgcttcaatagctcaccttttctaccctggcaggatacagttggaaacattggttatattactaaggctttgactgaaatgttatatttaagaatatgcatacaatgcctagcttcaagagttcctggccctacactaagtgagtcaaacttgacatctttcagccaggtgtggtggctcatgcctgtaatcccagcactttgggaggccgaggcgggcggatcacctgaggtcgggagttcgagaccagcctggccaacatggtgaaaccccatctctactaaaaatacaaaaagtagccaggtgaggtggtgcgtgcctgtaatcctagctactcgggaggctgaagcagaagaatcactggaacctgggaggcggaggctgcagtgagccgagactgagccactgcactccagtctgggggacagagtgagactctgtctcaaaaaaaacaaaaaaacaaacaacaacaacaacaacaaaaaggacatctttcacatttgtcccttttgatcaagatctggcagatccaagaacctttaaactctctgcaggcaggaacaatccagcaggaagatcactgagccaggactgaggtgatttctcatcccaggtttaccactgacgtgtcatgggtcttgaggtaaacaacttaatttatagggtcttatccacagtccactgcagtcctgctagtccctggactgctcagtctggcatg

SEQ ID NO: 103 - DNA, 3914 bp, Homo sapiens
aggctgtcaaaggcaattgccacaagaggtcaacgccaaggctgctctgcagatatgaccagggctcattttttccatgatcttagagaaactggataagcccggggcaaatcgggcccagagatgagatggtaggacattatggcaggccctgaaaccccagcgtgccccagcagaggcctgtggtggcctctggggaggtgggcggtggtggaggtccgtgtgagagggcagcagcagcagcagattaggccctgtggaagcccacttccttccagagacagtgccaggggaggaagggtccagactgagggcaggacgggccagggggtgtggcaggcggatgcccccctgggcaggtgacctcatccacccctcccgtgtcgcctcctctgatctgctccctctggagatggggaaatccagagtaggggcaacaggaagtatattcccaagaagactgtagacccccgcacagggaaacgatggagctcaggaggggcgctgatctcgggagcctggatccaccagttatgcaagtgatgaagtgagtacgcacggtcctcgaggccagggccggcgcagtaagaacgaacaggttgttctggaaaattgtctggcagcctccccgcggcctgcctgcaggaactggcatctgtggagtactttgccttgcttgttgatccacagcacttaccacatcctggagaaacaggtcaatacaggtggccctcaggagccatgggccccatgtttggaactctgacccacacaggggcaacctgaactcctgagccatagccaacccctcccacccggggcctctgatgagctgggcccccctgcaaataacgttcctgtctgtttccatctgtgagctcctgctcgcgatctaaggcccagctgaaagtgcttcttccttcctgggccaccttcctttcattctcagcttttctaaattatgaacatttcaaacattcccaaaggagagagagtgcacgatgcacctgaaccatatgtcgcccagaatccatggctatcaagatcttaccacagttgcttcatggatccctgcctctacttatttctttctgagttgctttaatgtttcacgccactttatatctatgtactagattttgcatctctaaaatagaggggcatttttatacgtaatgatgttatggtcgtctggcctaaaaattgccaacacttccttgctatctatcattcaatacccagtccatattgaaatttcccttctgaaaattaatttttggaatcaagtctaccatcggatttggttgaatttctgaaggaagggggtccattgctctgccgaatgtccccacatggcttctgtctccatccaccacgtatgtccagcttgcggccctgactctaggtgccctcaattatgcccactgtggaaacggcctttctgccacatctgaagcttgagccttggaggcaggcatgacgtctcatctctgtgttctttgtggttcccaaggcaatgcgtggtgtatccgaagtgctccactgagtctcgaaaacgtccctgcattggagggatcatggagtgaattttgtctttgccactccacttacaacttcaagtctggagattttgaaacaccccatgactgggagtgaccgctggctcggagaggtttgtacacagagcagagggtagactagatgacccttaagatccaccatgactctgcaattcaggcatgcggaacctggctgatgacagacatcgactttgtcctccaacctttttccgggacttatcaatattctcgtggttaaattccacaagctggcatgatctgaggagggaaattaggacatggtttcttgccattactttttacagcttggcaaggggcaggaggctgccatccccttctgtggttgctgtgtcattctgtggggttgctggagccggggcctgaggtgtcagggcggtggaagctcctgaccctgccctgctttctgacccacctctcatctcacaacctctgaccttgtttatttctagaggcataatctgtgtgccatattgtgagtaaatgagaaaatgtggcttggattatggaattcagctttatgattcatttgttcagcaagctctttttgagaatctatcttgtgccaggccctagattctgggggtttaaaaattgccaagacccaggcgtggtggctcacgccgctaatcccagcattttgggaggccgaggtgggcgaatcacaaggtcaggagttcgagaccagcctggccaacatggtgaaaacccgtctttactaaaaatacaaaaaaaattagctaggcatggtggtgggtgcctgtaatcccagctactcgggaggctgaggcaggagaatcgcttgaacccaggaggcgcaggttgcagtgaggcgagatctcaccactgcactctagcctggatgacagtgcaagactccatctgaaaaaaaaaaaaaaaaaaacaacaaaacaagaacggccaagacccaccttgctagcaagaagttcactgtctaatgacagagacagaccaaagtggcataagagagcaagcctgaatgctatgagagagacccatttcagactgctggggtataggagggcttcctggaggaggcagcttctaagttgagtcttaaagggtgaagtacagacatgaaagaagcaatgcctgggaaggtactcaagaaaaagcatgatgtggtggggaagggctgcagcccagccctgtgcctgcatcccacgcatttctacttgattccttagctccctaaaccttgcttgtctcatctgtaaggtggagataaaaataacagtcttcttttattatgtgagttgcaaatgacagagtgcatgtgaaggctcctggtgccaaaaatgttagcagaattgagtggaagcagagtgaacactcactgagggccgggagacttaggagggagctggaccccccgggatgctttgctggatgaccacagcttggggagggggctactgcctttggagaatggcaacactatcatgcagctcagaaggctggagtctaataccctgctcagcaaccaggcatagtccattccatcacagagcctgggttcaccttgaggacagtgagaactcagccctggccatgtggaagtcaaagcgtgcagcacctacgtacatggacctcacctgtcatccaagtctccaaaccacactgcaatacaaacatcgccaaagtagcaggcttctctcctctgggtgacatccacagggcagatctgagcaacacttagtgtctcctgggaccttcccagcctcggacagaatggttgttagaggaacaaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattcccgctctaggccacagtccaaatccttgctcttctctctcaggttctggaagacagaatggaggcatctacagagcaaggacatgttttctacctgaattagcttttctgacaccttcaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttat

SEQ ID NO: 104 - DNA, 1948 bp, Homo sapiens
atccattttcaaaattctctaggcaaacaacacattcagtacagtgcagcatatcagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttataattgttctatttttattagttgttgttgttactgtgcctaacttacacattaaactttatcacaggtatgtatgtataggaaaaaacatagactatataggatttggtactatccacggtttcaggcatccactgggggtcttggaacgcatccccctcagataaggggggactactgtaaacagaaaataacaacaattcaaattgttaaaaacaattcttgaaagttatcctttacaatagattaatatatatgatctgagctgaaagaatggcaagcaatggagacaatatttctcttctgtttctagtagatattttcaattttaagcatagttttaaaaagtacaaccctcttttaagggcttaaaccaaggtggctgtgctgattggcttagctggctagttcacagtgccaaggacagggtttcaatctcattcttctcagttgtcctgccagagattgttctttcagaccaggccagccatttgacagatgtaagccactggcctcaaggaacacaagccagacagtggtggtcaatgcaaaccttgagcatcactggaaaaattaagcaggtgtcctactgcattatttccatacatagaaaaaccacagaaatacattctatttttaaagagttgtttttcaactattaatacctataaggtttaaaaatattttcagagaaaaaaaatttagcaactagaatttataatgctaccatttactatcattatttgtccttcacttcatttgtcaccttaccagagaattccttgccactctcatctccttaatctgcttatttttcttcttactactttccactaactgatgttatattaaatatttatttatttggtgtctgcctctcccaactagaatgtgagctgcctgacagagcaaggccttagcttggtgtgtgtttctggtatatcttcagggcccagaacagggcctggcacacccacaactgaataaacttttgatgaattctgtcacatatttattacaggagcttaattcatggatatctttaacaggacatcaaaaacagtagatcatttacaagccaagaacatactgctaactattgaaccagaatgtatttgttgtctataggcagcagcctatatagcaaaagaactcaagacttttgacatagcccttccaagtttcaaaggtgtgcaacatcttcaccatttatttccatgggatcattcaatgtgggtgacatttagacactgaaagcagggcagtgggactggctattcaattcatcctcagtaataaaatctaaaattatcaaaa

SEQ ID NO: 105 - DNA, 4758 bp, Homo sapiens
gggaatggggcctgcttgccctccaagcttcttgatcggtttcagtgtatcagcatctgggcctctctcagcaaagtccacctgtgagcctgggcactgcaggttgcaggctggagtttctaagaaagttttggcacccagtttggataatggggccactgttgagggaactgatgttcgtgagctgacaaccccccgcccgccggcctgaggatggggttccctctctaaacccccatgtcggcagccgctgaccttcatgttcactcaaggcccttgactgaaggcccccatctgccacttggttgcccaagttctatgttccgtatgcgctggcccatgcatggctccccttccctcaggcagaccctggtgctaccatcctggccttggcgagcacctgccctcctccgcatgacctgtcccacttgtaacgtcattaccaagctccgtgatagctgctgtctgcccagactgcgcctctgctcttttctcccagcctctatccaagtagccccctctgcctggaacagtgctactcaaagtgtggtccccaaaccagcagtgtcaaggttgctgggaactggggagacatacatattcccaggccccacctcacactgactgaatcagaaccgctgggggtgggggctcaaggatgtatttcaagcgctccagatgactcttctagacactaaggtttcagagccactgtccccagacagggtgcccctcctgctctgcctggtgactatctgtctgcctctctctatctctctgtttgtaggagctcagatcatgccctggagaagcaggtgacatcgcggaattttcctgttccagatgccagaagtctgaaatgaaggtgtaaagcagggtggttccttctggaggctctgagagaatcaccccaggcctctctccagcttctggtgctggtattctcaggcttgtaggcgcatcacccatgtctgcctccatcttcacatggccttctcctctgtgtctgcctgaagtctcccttcatttctcttgtaaggacatcagtcattggatttagagcccaccctaaacccagaatgatctcatctcaagattacatctgcacagacgctatttccagataaggtcacagtcaaaggtaccaggggttaggatatgaacatatctttttgaaagacacgatttaacctacagcaggtgctcagggcagttgggtgggggcctgtgctaggggcccaacagccaaggcttaaagccgcactccacacctaggcctgtgacacctcccacaagcttcttcacctctcaagcctcaacttctacttctgcaaacagggaacaataaaagtatctccctgcccccaccttgcagggtttccagttccaatgtctacacactcacctgggagttatctgaaattgttgttcacctgcttaaaccttttgagtttccagcaccccccagaagtccccaccctctagtcccttagcaagatactggccctgcgtgagcttcccaccttccttgacagctgcatctctcatcattaggacctgggcaacactgcagaatatggcaggtcttccctcatctctgtgctttgcctccattccctgacttctctcccatcctcctcctgtcacctggcctctccccatcctactggccttaaagctcagctcctgaagcctccctgatgctcctcccttcatagcccctcccagcctggccacgtgggctcgggcagcccagagcctgggcctcctggtcacactctgagcacacagcccattttctctccagtgctggcttgtgtttgacaccatgcctgacacattgggggtgctcagtagacctgtgtgagatggacagcctcccgtacagatggacggacagatgtacaggtaggtgaatgaactttcgttgcccctaaagcaggagagactctgagtttctgagacaacggccaagaactttctgataagatctctgcatttaaggttcagaaaaactcgatgaggacaatatttttctcccgattttgcagataagaaaatagaggcatagagaagtcacttgctagtaaatgttagaggcagctttctaacccaggtccatgtgaacccagaaaaagaggcagtgagcacctgttcacccaggagcagctctcagaagataagataatacgaggaggaggcagcagacccctatgccacgcgtccacctggggctgtccatcacttcctgcaagatcttgctggtagccagattctcagagacccccagtgagccccgcctcctggttttcacaccctgtgtagtttcctttccccagggatggtccaagtgaccagcagcccgtggcagaagtgatggaatagcacttccaagcttaggttatgaaagattgcagcttcaatctcctgccccacaccccgtctctctctctaaccccactccctccctccctctctcatctctgactctgggggaagcacactgcagccccgtggagatgccctgtgtaagccactgaagcctctggccaacagcagtgggaacctgagacgtgtccacaagcatgcatgggagcttggaagtggatccttcagccccagccaagccttcagacgatgcagcctcagggacagtatgactgcagcctcatgagaccctgagccagaaacacccctccaagccactcccagatgcctggccctcagaacctgggaggtaataaatatttatggctgtttgaagctgctgtatcgggggacaatttgttacacagtaatagctaactggtgcagtcctgggactcttagcagtttggagtatcagttattttgccaaggcggggaagttaacagtggtcattgcagcagctgcacttggggaccacaataaagaagctttctcagactggtttgaacaaagtggtgaattctctgcaaggacacagaggtgtctctcaaaacccaaggatgggacagcaggcctcaagaagaactggaacctctgtcccttctgtgcttctttttactcctgtgttctctgcttcttggagcacttggcagttgggaagtggccatttcaattctcgtggtcaagaaaccagctcagaaataacccaaccaacacaggtggggtcaggtgtccatcctggctccatttgtcatggcgggagatggtgatgaagagaaacatccaggaccattggtagggcacccgaatgagattccaggagaggccagttctaagagaagggtactagaaagatacccattgaagtcaataccacatgtggcacatcctcctttcaggtggcaagtgtgtagccaaagcaaggttcagggtccatatttgaaagtcagaaactgaataaactgttttctcccaccccgagcactgtggggaactctgctcacaaatccaccatccaccatcaccagccgtgctcatctgaccattcatgcaggctcacacttgacctgatgtgggttctgtctcctttgcttgagaattgaaaggcctgggagatgcaaaagctttaggctccagccatctccccatgtcaggtaggccttttgcctagtgtatccagttggtaatgctgcagagatgcatgaagctggagtcagaggccacctgtagtgctgccctgacttcagacctgagcccagcccagcagcagagagggggctgggagccagaggaggcctcacagtaacagcacagacaggtgggggcccacaacaggccacatgtgttcaaactcgagtgtgggcagaggagcatgggaagctcagagccctgagctcaccccacacccaacacgagtggggtcacccaaaatcagcctgtcagcactgtcccagcagccagtcgcatgctacattaacaaattttgcacaggccagcaagcaggatcgctcaccagccaccctcctgaactggcctatggggccccaggatgatgccatagccacaagtctggagttcctcaaagtacctggtcagcacaactcagttaaacaatgggcaaaagacctgaacagacacttcgccagagaagatgtacagatgcaagtaagcatttgaaaaggtgccccacatcgtatgtcgttagggaatggtccaatccagaacactgatggcaccaaaggctgctgagcatgtggagcagcagaactctcattcactgctggtgagaaaaatggcgcagccccaatagggaaccctaatgcagactctggacttcactggaaatgacgtgtcagtgtagctgcgtcagttgtaacaaatgcaccagtctggtgggcgtgttgataaccggggctgcgcacgtggggagagaggacctgtgggaatgctctactttccactcatttttgctgtgaacttaaaactgctcttacaaaataacattgtttgttgttgttgttgttgttgttgttgttgttgtttttaagtatctagtcagctccacacatgacccgggcagagtgggaagttgtagagtgccccaaggagagaaatggaaccaggtctcatgtggggccaagtgtgggctccctgtcctctcagctggtcccaggaactgaagggaaatttagacaacttggagaaagacactctagggctcggggcaaagggtggtgttgatgagaaccatatttttttattgctggtgtaagcacttgtatttttctgattttccactggttcgataataagggtaaaagacaataaag

SEQ ID NO: 106 - DNA, 4608 bp, Homo sapiens
gcttgcatgtggagcccactaaggcccgaaggggctggcctgcccaagttcacggctctgccgcaagcttgctgcagatcaccatctcctccattcctggccccaactccccttgcatatggagcaaggaaagatcttttgaatgctgaacgggcctgagacaccttcctgaaggaaagctgtccttggatccaggcattgtgaccttgttacttcatttggccttcatgaccacctgtctagggccttcatcaacctcttttacagatgagccctcttggatgataagtaaatggcagcatttggatgtgaccctggtctctctgagcttagctctggactcccctccctcgtgcccctctcaaacaagcaagaagaaggcaggagagtaagttctaatcctggctgtgccactgactccctatgtggtcacaatgaagtcttttccctctcagcacctctgttgctatacctgcacaacgaggagctttgcttggccaggaagagggcacaataggtacagagtgcaggtatttctgggcccatagacaaggaagggtgggaggaggggagcaatggtggaccctcttggttgacaaatctaaacaataatatggagcctgagaaagccaaataccagctccccagcttcctctgcagccaggcatggccatctgactgagttcaaactgatgggacattttgtaaaagtcttatgagaggttctagagatgcttttgctttcttgataaagagccatttgcagctggcacttcccctgtcccctccagtcttgaacatggatgcgatgcctggagctatggcagccatcttgcagctgtgaggctcagagagtcccagagataacatttggaacagtgttgagcccctggaccaatacagcagctgcctagctccaggcttcctgttgagtgaggaaaaacaagcaccatgttttcaatgagtagttctgaatgatacaagcagggctggtagacatccccacagttataccaatttttttgccataaacaatattaccatattttgtctatttcccctggatacaggggaccaataacaacacaagaggggccaggggcccagggggaaggaaccagatggggaggggtgaggactcacgaagttagaagctggggaaggaggctctgcaatagtggaaacaagcgggagccgtaccgtccagtcttaggggtcccgagagtgggcaagggtgtagccaatggagaaggagctggagaagaccattcatggggggggcaggacaaactggtgggatggaggaaggagactgcaaagactgaggctgcaaagcctccccttcgccctcagtggacccactcccacagcccagctgacctccgatgtaggccacagagaagcccctgcgggtggtgctgcggtctgtgtgcagcagaagcagaagctggttgtggcttgaggtcacgggtggtggcaggtggtgtccacaccaattccccagcaggggtgcctcctcgctggccccatcgaaggccgccagatggtcaaagtcacaggtcttggtcaggctgttgggctcctccaggtccaggtccaggaagaacaccttgacctggtagcccgggggcaggcggatggtccagtggcagcggatgttgttggggtaggagctggggtactgtgggctggagaagttgccccgcatggccatgtatacctcctggcattctcctggatgggggatggggaggtggaaggagcaacagtgaggggagaggagaagtcactctctgcagttacagcttaggcagcaggtgccacagtggtccaaaaaccaccagcaggttgtgggcaccatggctagcacaccagacaattgatcccaactatctgaaagttgggatgcttgatcccaaagcttgttttaaactgcaactagctgaaagctgggacttgcattccagttgacagtccccttcacaggtgtaggccctgttaggaattcaataataatacacaatacctgtcctcagagttacctctgaactccctggcttgacagatgatgtggttcatgcctggcctttccccttttctcactgccccatttggtatgtactatgagcataccaaacactctctgccctccaggcctttgcacatgctgttcctcctgcttggaatgcccttcccttctgcttccgtctaactccttcagggtactgctcaattctcttctccacgaagtcatccatgattcttactgatggatagcacagatcataatggcttgcgctgtctgtttccttataatctctctaactagactgtaaagttcccacgacttcatccattcatttgtacgaaaattgagtacctactatgtgccaggtacaaagataagcccataagggactcagtcagacaggggagattgacatgcaaaccacacacagaagtgacaaatgttagatcatagtgtaaaaaacttatataaggagttgaaaaaaggattaattctggtaaaacagtaagtcttcgcagaggtgacatgcttatgtcttggcataggccaagggtatgctagagcattccaggcagagagagtgcagaaagctcaaggctgcggggggcagaaaggtgtgacccctgcaagtgtaatggggagacaggagcccagtaggcacaggaggattcagggtggagcgccagcccctcctacctgagaagtagtaggccttgaagccacggcctccgatgttgaagtcggacttgaagaccacctgcagttcgtggcccagagacacgagggtggggggcctggtgctgccacagtagtggtgcccacgggtggggccaggccccccaagcacagccacgtagtcataggtgcactcttcattgccctccacctggaagtccacgaacaccagcttgacgtgggcagggccagcggcccggatcacccagtggcactccatgctgttcgggtagttgttgggatactcaggactggtgaggacccctgacaggccagtcaggacgccgccacacacatctgcaagggagcccacttgagctgacctttctttctccttgtggctcccagtttcctcccttgggaacaagacactccaacatgctgcccccacaggtatctcattagggcctcattaccatccagcaagcacctgctacccaagtagcaagtgtagcacgtgctcaggcccagcatttggcacctatgctgcctgttcaaatcctcagagtagccgcacaaggactgtgctgcagtttctctgattttataattaagaaaagggaggcaaagacaagttcagtagcttacttgagtttgagttcacccaggcagaccttgagataaggatttgagtgcaaggagtttacttgggagatccaggggcccccaggtggggagggagggagaggacagagaaggggaggtgtgttcaagtcagctgctgaccttggggggaactctggggacggggtaaagcacatacttcagagttctgtcaatctaggagcaagggagctgcggcatttacatgccaactccccagagtgcaggcagagggctgctgtgggctgggagtgccctactgagacttcagaaaaaagccctccagcatagaactgtggaggttggcagaagcacatcgacgtggcagggcccagggaatgtggtcagggccctgagagcaggtcacccgactggtaactgggaaagtgggatttgaacccaggaagactaactatggatcctgtgcacttgacccttgtgaccttcactgtccactcctacgaggccagtggggcacagaggctgaggtgcctgagctcaggaatgtgatcaaacctccctaatggatgaggaaaccaagacttagagagaggacctgatgaagtagagcttggtttgacatctgaagacaagtagtctcccatctctgccttttattagctgtgtgactctagggaagtaacccagcctctctgagcctcattggaacattagaaatcataagactgaaccagcttgatccactgggctcagacttgagcacagtctgaaaatatgctgctggaaactctcaggaagccagcttggccagtacaactacacggcaagtgtgggtgaatgctgcgacttgctggaggtcaccagcagggaggacatacgtgggatgtgtttcctgagactccagcatctcgccctatggcacggctgtgtgaccagggctctggatggggcatctaaggacttggcgtcttttcccagtgctggcccagccatgtaactttaggaaggccctctcagggactcagattttgtgaaatgagagggcaggtttagatagcctgtgagatcccttccaacactaacaaccttcgcggagacttcccaactgtgccctggggctccccagcagccccctggagcacctgctggcacctggtgcaaatttcattcttatgctgtatttcaagctctcttttaatgtaatgaaaagatagcacccacagactttaatatctttaacaagatattaaaatttaaatattctacatttaaaaatttaa

SEQ ID NO: 107 - DNA, 2769 bp, Homo sapiens
ctcttcctcgctccccagtccgcgcctcgctgggctcagcaccccggcccccggcgggacggaggctcgggtccaaagcagtggctgcaccgacacgaacccgtctgcgtttctccacctgtcttccctcgccacctgcatctactatggtctctaaatgcctcgctttgtactttgtggctttctggcagccctttaaagcagcggtgaaagaaaggagagagtcaagacacgggagaaaatgtttcatcccgggttcttctagtggtgcccggtaagtgactccggactgacgagcagaaaaatcccagggccatcaatagagggccttcggtgtagaatgcggtttgctcagctgtcagcaaagagggacgcaaaacctaaatttgagatatcagaaataactaaataaaatagaccttggctgattacaactaatggttctgaaacctagcaaaagggtcagattctgatcttgaatatactctcgagagaaccgtttcagtacgggggtgtagctcagtggtagagcgcgtgcttagcatgcacgaggccccgggttcaatccccggcacctccattccttttgcttttaatttttttcccattgctttactttattttccttgcttaaacagaaagtaaccctatttcacaacggttttgccattaatattagtgctgttccatttctactcctcagccttgacacgactcgggggactgcctaagcaaaaggtggaaaagatggagctggaagacaaagacggctccggattccaaaacttcaatggcgtcgccaaattgacgagctcattaacctttggagtattgttatttaaaaagtaggaaataaaagataaatgtggaaatatttaataaaagaaaaacgtaagctctcaattttctttattacttttttttttttgagacggagtctctcgctctgtcgcccagtggcacgatcttggctcactgcaagctccgcctcccgggtttacgccattcttctgcctcagcctcccgagtagccgggactacaggcgcccgtcaccacgcccggctaattttttctatttttttggtagagacagggtttcaccgtgttagccaggatggtcgcgatctcctgacctcgtgatcctcccgcctcggcctcccacagtgctgggattacaggagtaagccaccaccgctcccagccgatttcctttattttttttctggtccttgtttagccatgatccatcgcaggctgagccctgacaaacgcaaagccttccaaactgggaaattgagaaagttattttcatcaatgaatgtagaggcgtcacacttctgccgaaatagctccactgggaagcatgctctgctgaagatctcaaagttcacggactgatttccagttttattctgtcttcactcctgccggataatttgacttcccttagatgacgttacagaagtaattttacctaagacaggtgcgccctctatcgtaaggatatctttcagactcttggtccacacaagagttggtggcaccggagagcttgttagaagagcgaaatctcagcttcacctcagacgtactgaaccagaagtagcaatttaacaagatccacaagagattcttttgcacatttaagaagcaatatgacgtgctttgacgtggatggagtaagggtgtatagtataaatacgcggctgtgttttttcccccaattttctattctaacagaaaacataattgcaaaaaatatatatttctattgctgaatcatttttgtgttctaatcattgactctgttccttgcctctctggcaatattgtacttagtaatattttttgaatcactattcatgattgaatatgatgtgaagttttcattttcttttttttttttcttgagacggagtctcactctgtcgtccaggttggagtgcagtggcgcgatctcgactcactgcaacctccgcctcccgggttcaagcgattctcctgcctcagcatcccgagtaactgggacaacaagcgcgcgccaccgcgcccggctaattttttatattttttttagggacggggtttcaccatattggccaggctggtctcgaactcctgacctcatgatccgcccgcctcgcaaagtgctgggattacaggcatgagccaccactcccggcctttattttctttttcgcaagttttgcaataaaggctgtgctaacttctaatgtaaactgggaagtttgtatccttgctctgaaacattttaaatagaataagaccttgtaatcattccagaatacacagccctcttctcatcagctaccaccaaatcttcaagaacttttgtattaacaccactttgtattctaagccctgtgatagattttaaagatccaaaaccctttgctaaccctaatgaaagtgtgagctgaaggatatctcaagaattgggaaatccttggtttccgatataatatcaggccacctctgtccctgtgaagtgattaggaaattttcaatggagaaaataagttccaaaagtcattctttctcagattaagatgtcttgggtttcagtttacttctttaaagaaagattcagagttagtactgaggacccagactttcttgatgtgggaaatagataattttctgttctgttgacattttttctctctcttctctcattttcaaagtacagttccacaatgtctctttgccacttatactcactgtggcagaaaaaaattattcacagg

SEQ ID NO: 108 - DNA, 1407 bp, Homo sapiens
cggggcctttgtctctcactgcacctggagctccaggtctcatcttcactactctgtgtcctctgctgctggaggcccagccctgtgacctgacggttttgggagatccacagctaagacgccaggacctcctggaagcctagaaatgagttttcgctctgttgccagactggagtgaggtcctacagttgtgcagccgcgcgatctgggctcactgcaacctccacctcccgggttcaagcaattatcctgcctcagcctcctgagtagctggaactacagtcatgtgccaccatgcccagctagagaggtttcaccatgttggccaggatggcctggatctcttgacctcgtgatccgcccgcctctgcgttccaaagtgctgggattacaggtgtgagccaccgtgtctggcgcctctttttcttttatttttccagagaacttaccggaatgtttttgggtcaagattaccctttggaaactttgtaggatgatgtgtcctcagccaaccttcagtttttttctggtcctgggttttagtactttctgggaataaaccaacatacccactatggctatgtctgctagagtgtctagtgactattatctcttgggtcattttctcccataggaccacctgaagcatggagtgtagactttcaagggagcaggtggcagccttggggctgaaaggcatcttctggtgcacttttttttttttgaaaagctaaccccttgagacatgaagattgtcttcactcaacctggctttcatttctaggagacacattgctggtcagtcaatcagatgctggtattgaggggaaaacaaataatttctgtcttctggattatcttgtgggaggggcagaaaaatagtgaaaaaacactccaaaagacaaaaaactgaccccagtgagatggcataaataacttacaaagtaaaatgcacctggggcactcactggggcatagtgcagtgtctcctgggagggtggttattgcgcatgtaagtgaacaggatggggtgggtgattggatctgtaccttgaaaagatttgtttacttattttgacctcagtttttttttagacagtctccctctgttgcataggctggaatgcagtggcttgatctcagctcactgcaacctctacctcctgggttcaagtgattctcctgcctcagcctcccgtgcagctgggattacaagcatgcaacaccaagcctgggtaggtttttgtatttttagtagagatggggtctcaccatgttggccagcttgatcttgacctcaggtgatccacctgcctcactcttccaaagtactgggattacaggcatgagccataaacactgtattctacaatcctatgaatattaagccacaatacttactttgaa

SEQ ID NO: 109 - DNA, 3367 bp, Homo sapiens
agatggagacacccaggagaaagaagagggcgaattggaagaggccacccagaaaggacggtgtgtgacactagggagccaagcatggagagccgaggactaacgcttggaaggaaatgtggaccagaaggttccggatgagggaaggactggcggctacactctgccttccgagacaacgaggaataatctcacttcagtcagttcaacccttgtaaaacagctactgtgtgcaagacacggagggaaagctgaagtagagaaaccacagacgctgtcttcaaagggtttaatctaatattagtgatgagaaaaatagggtgcagagcttaaggcatcctggaaaaacgtatgtagcgccacatcgcgaaaatctctcttctgggacccctctcccaaaaacgtttcttcgccctcttctcccccttctgcctccactctttctggacttcaggtacaaatagttgaaataattatactccttggttcatgaaatgtgtaagactcctctctggttttattttccccctttatccccatccctactcccaacccctatcctcaaccccataggcattcatgctgctgtgcttccatatgtatttttgggaaatgtacaaaatttttatcagtgtattttttaaaaatgtttaaataatgctactggactttggagattatcttattttctacttttttcactcaacattctttttaaggatctgtcctcgttgcgattggcaagcatatagttcattgcttctgagtactgcacagcgtttcataaggggcatctaccacacttcacttccattccccaggtgttaggtaacaaggccgcctctaattctccaatacatcaagtaatacagccatgatcgtctttgtccgtggtcccttaaggacctctgtgcaaattcctctgaaatatatgccaaggagtaagattgttaaagttatagggatgcacagggacatttgcttatgcagctgcgtcctgcacaaacacatccagccatggggcaatggaggctgaaaaactgtctctactctctttcccgtgccatgtgccctactggagaaaggtgtgcactttttattctcacaaaatctctgtacgccagccaagtcatgaacctagaaggctgtaactatctagagggtgtgatattttcaaactcatctggccagatgaacagttttccaagagcacaacgatgcccagtagcctagtacaagccctgggtacttaccaagcactttaagattgtgtaccagagttactgccctacgctgcactccagtgtggggtttccatccaacacttccatccatcccttccagaaggtgataggtcttttttattaaacactcataaagtgtttagtaaataccagatactattctaagtgctttgcaaatattgactcatctaattagctaattttctaatttctgtcaatatgatgaaagtagtgtaagctcattttttgctttcattttcacttctctaactactagtgaattttttgaccatttctttatacattcataggctacttgagattcccttctgtgaactgccttttcagtgtctgtgtctatttttctattgatcttttttctttttcttttgatttacagatatctttgagaagcctggacatcaatctgctttagaagactagaaactctgcctttatgtctttaagggaacaatagtccttaactttgatactgtggctctttagctctttttttccctatattttttatatagttttttggtattatttagacctccttaaccccacggtcataaaggtattctcccatcatttttttctatccattagcttcatagttttacttttttacattcagttatctaatccatctggagttctccttcccatatggtgtgagatagggatctaactatatttttctccatggggtgagcaaattttccaacaacccatgtcaaacaatccattctttccaaattggtttggggaagtttccaaatagacatgagtatgttctgagctctctggtttgttcatgtgtcagtaccacaaggttttgtcactgtgggtttttagttagtcatcatgcttgaagggcaagttccccattccaaattcttctgtgttaagattgctttgtctatccacgggcctttatcctcccttataatgtttagagtaagtttgtcaagtttatgagaactgtgttgggttgatgaataaatgcaaggaaaactggcaactgtgcagtgacatctcattcatgacctgacactgtatatctggtggacaaaaagagggaaatgtggctgagtcataatgtgcatggaggttgctggagaggtggcagatgaactggagaggcaggctgaaccacactgtaagccaagctaatagaaatgagcttgaaatgggacaggcaacccagctcaggctgctttgtgtgttcacaggaaacctgattacacattgggaccatcggtttgtaggattgccatgatccagagaaactccataacatttctgaaagtatataacaaaaataaagacctagagggccctggtcacccatacgttgcactgatgtcaagtgcagggctgtgtgtcttcccatgtccaagggatctcctaaaagagctttcataagtaggtgccctgcataggtgacagcagttcaatccagtaaacaattttttaaggaacgtactgcatggtaggcacaaggctgcccacaggaagcaccaaggtgactatggcagagtcactgccctttgcattcacaatctgtattaggggaaagacagaagggaacatctacagttaattctaatgcaataagatggtatcatttagtatatgccattttaacagaaagcacaatgggagctcagagaatctagatactggtatctgagaccttacttataggaggacaaaaagacccaaatatgactgagcaatcaaagaaccacaaggaggtagaaaggcgcgtgacatgttcagctcataggaaagagatgcagggggcatcaacacagatggatgaatggatgaaaggatgggtggtcggacatatcaatttatgctgatgaaacaaaatgtttgatttccaattttctggattacagaagactagtcaccaccctgctcccctgtgttgttgtaataacaagaatcactaggtggcattatagtatcaaagtcctcacctttcagagcctctaggagaaacacacccaacaagatcgcgtcagcccctaatttagacaaatgagtgcttctattcatctcatttctcattatatccacttaatttatttcttgagcacctactatat

SEQ ID NO: 110 - DNA, 49725 bp, Homo sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcagggaccagctctgtgaacacggcaagtaacaacagagagaaaacgtgaggagaaaagagagaccgggattttgaaatcctgtttcctgaatgccatctcaccaggcacacgaaagaataaaattaaggaatcaagagccaagaattttcttattttctttcaaaagctaaagtcgtctggggcaactgttttcatcgctaacccccgctaatttctccagctatggtagtattgctctccctctgtgggatctaaaacatgccctgtccttttcaggttttaaaccccagacccagccgcaaacagtcttttcatgtcagatgagttgcttcgcaactctgagtcacaggcctcttgtctctcagatgagggttatgccacaggacacaggttcctcactgggaatggtgtgaggactatatccagggatatttcacggcagggcctctggatcaactgctttacattggaggctgttcattctcactggtttatgcagtaagagccatgccttgctgtgtgcctcattcctttctccagctgcagagggtcttgctaaaacacagatttcatcactcatcttccaacaacccctgaccatcctctggacgaagtttaacctcctacgcctgacatagaagatccttcatgatctagccctttgtttgtatctgtggcttcatttcttgccactctccttccttataatcattatctccccaaacttgctgtttttttctttttacctttaaagcctttagatgtactattccctctccttggaatatcaagagtctccttttatagtttggatatcactttcttgatgatacgcttagcccagtagtaggccgggtgcctaacttctgtattccatccttattcccagcattgggcaactctctagcaatcaccatttggcctgcccgcaccctccactacattactgtctcttagagtacaccacagtccctggcaaatggcgggcactcagtataaatcggctgaatcacatcagatcttttcttcaggtgtaaccttcttttcccttcatctccctcctctttctcagcctttcccctttgctatagccttactcctgagcagtaaatttaatcttcttccaacatcacctgcatcagctaagcctctggaggagtccgatattaacatggggcttacagttaggaggtcctaccttctctgggtgcaggagaggagcagttctccccactctccaccctacacacatcggagaacaggaactcgcttgccaaactctcgccggtttctgggagagagaaggaaattttatgatgaacaatctggcagcatatggttaaaatgtttgaagtccccaattcacggctgattaaacaattctttacataaataacaccctagaatcttgcatataaattcaaagcagaaatgcaatttacactttcatttggtgatctggatgggaaaaaagccaaaaatgtcaattcctgtaggcttactagaaatatcgcacttaaatagcacctctccaactttaaagacaaacagctgaaactcttagacagatactactgaacgtacagactctggcaagatttataccaagtctgcacgagaagcattagcaggcattaatagaaatccaaggtccaggccagtttagtccacaactctaagatggctggcagtaaatgtcacttagtgtcaacttgggaggctggagatacatgccaagaacacagcatttgggagggagagcacaaaggctggctggctcagtcagccacaacgattctagtctgtttcttagactcgggatgaaaaaccagtagtatttcactaagtcgggccaactattgtaactgagagaagagggcacttgggtaccattcaagtattatggtcattttttttcactctcagaattggaaatctcttctgttcttgctatgtgtaaaaataacatgagctcactgtaaaacctgcatatagtaaaaaagccccagagagagctactgctagcagtctggaggtacagtcatccatgttttaatatatgtatatgggctttttaatttttaagaaaacataagaccaggcatagtggcccacacctgtaatcccagcactttgggaagctaaagctgggggatcgcctgagcccaggagttcgagaccagcctgggcaacatggcaagaacctatctctacaaaaaatacaattagccacatgcagtggcaggcgcctgcagtttcagctactggggaggctgaggtgggaggattgcttgagctcgggaggttggaggttgcagtgaggtgaaatcataccactgcacatcagcctgggagacagagtgagatcctgtctcgaaaaaaaaaaaaaaaaagacatacatgtgatcctactatagttatccttctgccatttccaactacatcttgtgggtatttttccatggaggtttctaaagatgtacctatgtgcaaggcaccccacctcatggatgtaccatgatctgatgaaacacccccgaacatttacactgcttccaactgtacactgcagcgaacgttctcccatatatgtctgtttctacgtgcacagtcggcagcctttttttctttaagtattgatcctagaagtagatttactcagttaaagggatgcatactccaacgctctcaatatgtatggtcactgctttacaaaaaagttgcactagtttaaaagatgatgttagtgaataaataaatgtcagatctggtcacccactcttagcatttgatatgccacattgccacattcattgtgagaatgaagacctgtatttgaaattcacactctgcgtgttagggagatacaatggggagatatctgcattactaaagtcgttattttctttagttcagttataatcaggaaataatcttttagcattaaaaagatcagaagatcccaaacccacctggaacagctgtttcattgggcagcctatctacttccaagataaagtcatccttgaagaaaagatagcccactattgagaacaggtaaacgaggatcagagccagaactgctgtcaggatgatggaccgtccattgcgagtgacacttttaatgacattaagcaaagtctcttctctgtacactaaatcaaaaagctttgaaaacaaacaaaaagaattttaagaagccttgatgttagatgtacatcactatcccataatgcaaacttggtttatagagagtttgccctcttagacactcaaaagcactacatatgatcttaacactgaacatcttccctggcttcacagtgaaacggagatggtaaaaatgaggaaaaataaacacagaagaggaagcaggaaacaatagcaacttcaagtagtatccagagccatttagagggactggaaatagagaaaatacatgcttgtgccaatgagtttcagagacaaagggagaggaaagtgatgagggtcttggcatccattcatttagaaggtactgaattgagtttatgaagagccagccaccctggtccctgccctcctgcagcccagtgtctggtgggaaggcagacgtactacaagccagcgtcagtggcaagaactctggacttagatgtaaattcaaatctcagctcagctactgtccaccgtatgatctcgggctaggcactttcctcatcccctctgagtctccatttcctcatttgcagactggaggatgtagagttgttatgaagaataagtaaaccacgtacgcacagtgcttagcacactggcatccatatgctcagtaagtacagtaaatagtaattatcatcaatttcctgatcaagagactggggcagggtcacatagctggtgtatcgcagggacattagtgacgttaacattgcgagggtaagacccctgcaggtcacagtgccttcacaatccaggcttgccctctgctaaggaacctgctctttgcaagaagttggcttcctgaggaatggaggatccttgtaggtacatataggtatgggaggatgatggctagttttccaagagctacagtcacagatacttgactgggagaatggtggggagtgtggggagagagctctctgaagttactcttagacctgaggctagtttttagcatggcctctggctgctgtctaatcctgtacagaaggtttggtctccactgtggctttggggtgtgactgcaccatgaagtgagtcaggggacagggttgaatcctgactgcttttaatttgttgcaagatgtcggccaagccatctaagctctctggatctgtttcctcatctgtaaaataagtggactgagacagctgatctctgagtcccttccaatttagaatttttcatctgaggtcattttccggtcgattggcttttctgcctccttgacaccaatctgtgttctgagactagttctgtgaagggcattgggtagagtaggatacttaaagggaagcaaggaagagggattttagtcaatacaatatgacagaaggcaaagtgttgctgttaatgttggttaaatgttttccagcagctcaatataaagtggcaagtaagcgcaacttcagacaacaaacaaatggcacttgttttctgtggttaaggaccgcagagattacacaggctccaaatcatagaaatgacaagcgattttttccttttcactcatctatagtttctgattttaaaacaatcaataagtattatttatataaaagaaaagctttcttctaattggaaaattatacatgttcaatggagaaaacttggaaaacaaaaaaaagcacaaaggaaaaaaagtcactaataattcaccatctagagacattcgctcaatagcttaattccttctggccttaaaaaatgcaatttatagatatatattgtttacaaaaatattagaccataatactggcacataaccagcctttcaccaagccatcaggaacattttcctgtcaaaaatgatcacctggtatttcactatatgggaaaaacatgattaacataaccaatatgttttttaaaaacagtcaagatgtttccaattatatgtcataacaaataatgctgtgaggaacacttctatacatgcctccatacgtgctcgtctagttattccttttcggcgaatttttggaaatggagtatttgagtcaaatggtataagagaaacattttgcctgctgctttcagaaaggcaggatcagtttacattcaccactagtaaagaatcatgcccattttaccccactctcactagtactgggcaccatcaggctttttaacctttactaatgtcacaggtaaaacacaggattgcgctgttttaattagcatgtctttgtttagcaccaaggatgaacatttttccatgtttactgaccatctggatttctgcttttgttaactgcctgcttatgaactttgcacattttcatctccaggtgttaatatttttctaaggacacagctttaatgcaggctcacgaccaggtccggccagtctttgtgggggagggggggcagcagtttaattaggccaccagatcaccctccctaccttccggcctgctggcatggagggagctctcccaactctggaacacatgggtgttccctgctcaggtctctctccttttacaggcagcccgatttcttttggttgcaggctttccttattagtagaataatttgaagtgtcagtgttttctggttcttaccagacacattgagtactgctttgataccaaaaggagcacatcacttgaagacacaaacaagtcaaggtccacacagcttagaaaatccccccgcaaagcacaggagaggcagccaaccataatctggtttgatcctattgcgtttcctaaaagtgaactgaggtagcatgatcagaagctgagagttactcttatctttctgtgataggttggagacttgaaagcacagatgcaaactggaacgtgaaatgccagtttcactgatgcaaggactttttcacatgcttgaataaaaggcagtgtcaacttgggaatcaacagagttgtgaggctctcctgcctccaccagttactgacagtgtgactctgagcaagttacctaacctcaccaagcctcagtttcctcaggtgtaattggaagataccatctacctcaaaggtggtagtgagagtgtgtagagaagagtgcagggtgaccactcacaaaacggctgtccctgtaatgtgctcctgactgtgaggcctatgagggtagggactgtgttcctctcaccattatgtgccctgcgtcaggcactggcactggcctgcattgcaagtgatgaagagaagaggactcaaatgaacagaaaagaagccaagccaactggaggcagattggaggaaaggtcgaagtgtctactggggcaaggtggcgttgaccaaaggggcatctcctgtctcttgggagagagcccttggcagggatgagagagaccaccaactgaactctgccgccctcccaagggaggacaggaatttgttgtccagggacatgatggcatgagacaaaaagttccagaaacagacgtaagtctctaaaggtttctgatacaaagtgaccaaaataggcgacataatgggaatcacaaggatatcctgagacctctttgcctaaaacctcaaaatatagccagacctattttaagatgagggaaaagaatccattccctttagcctgccaaaatccacccctaatggtatgagctaatcctagtgatctgaacggtgaattccttatggtgttttggacgggggaaggaatatagaatgacaaagacaataaaatagctggcaatcattcggcagtgctattctaagaccctgacctgaacagctgcatgtaatccctgtgacggccctgtgagggagatacactgttctcattttgtagatgaggaaactgtggcacaaggcagtcaagtacgttaagcgaagggagcatctcacacagttgcattttgtactttcaaatctctaacctattgcagaaagataagagtaactcccagcttctgatgctgaactgctcctcagttcactttaagaaaacgcaataggatcaaactagatcgtggctggatgcctctcatacgcgcttcgggggggttttctaagcatctccctgaagagcttcccttgctctgccttttgtaagcccccctctctttgtaagcccccctctctttgtaagtcccccctctctttgtaagcccccctctctttgtaagcccccctctctttgtaagcccccctctctttgtaagtccccctctttgtaagccaacccttaggccttgatcatttttgtcctcacaaatattttaatattcctaggctgtttatggtgttgcttgcagataggtcagttttatgcttcctgtcattttatgtaggcacaagaaaatggtttcttatctacaacgccacaggtctagattccctccaactacaggaaagtaagtagttccttgatttgtcatttaaaaacctgctcaggaggaaggtgatggaaccagcttgtcttacagactgtcaagacattaagcacttggctcatatcggaggaaaatgagctactgaaagggtctcctagaccaataaatctactgagctcatgatcatgaatcccggggcttcaaaactagctcctactcttatggtcgctacacgtgttcacaagaaatggactccctgagagctgttggatgacagcctcaaaaacactcctcttggtgtaagtgcggctgagtctaagaagtaaagaaaaacaaaggtgcatggaaaggaaacatctcctgaacctactacaggcatgttccattactgagaagtaacagatcgggagtgcccagtacacagtgcggttgtgtgactcttgaattcctgggctgacccaattcctgtggagctttcctctcagatcccccaaaggctgccaactgtggagcttcaatcttggtggaccaggcacaccaatcaccattaaaaggaagggtctgtgatgagagagaggacataggacactctcctagtttccccacacataaaatatttccacaccaggtactcaccagcagactgtagaagaattcatggacaaagagccccatggcacagatcaccagatacaacaaatgatagaggaactcaacatccagaaccatggctcggtagcctcttgtgaatgtcccacagttgcccacaaagctcattagaaagatgattttattgcatacctgagaacaatgacaggaacagtcagatggcacggactgtgccaaactcttcatgagagcaacgagagcatctcacacaaatgtatttcagtcaccgtgcccaaacaaacgcttccttttccacccggtgcccaccaaacccgccaagacccatttgcagatctaagtcatttcattactttgcttttcaggcatattacaaattacatggtagtcaaataacttcatgcgcaacagtaatcaagtagcatttctctatggcaaaaacaaaattaacacatactgagattatgattttcaaaatgagatatgaatcatttctaacattcttgtatgagttagtcaaacacagaagtcacctcaatccacgaaccctgtgatcagcatgatcaaaagcattttctgaatttgttacattctaggcactgtaaggtggcaatttaatgagcagtgatcagttcttgcctttcaatgctcctaagttcacagggaaaacaacaattttcttgggggaaaaaaaatataagggacttcaggatgagttctattcccctgccctctcttctgggaataacttctaattttcctttggggaccattcctctctgagtagcagtctttgaggtctgggtggggctccaacctggccatcacaatattgtattcccctgggtacaatgactggtttagagatagacacaggaccaaatggagccaatgatgtccactgagctctttcttgggattgcagccaaagataattttgttctttcccactgaccttgaacctgagcagctgtgaactctggagctgccacattaccaacactgaaggcaccaccagcactggggacacagagccaaaagatggcaaggaggaactgggccctgaggacactgtgtgagcccctgtatcagctgtgcctgaagcgaggctgttggtttcttggtcaaaatgaaccaatacatattctcctttgctgaggctagcatggattaggttttctgacatctgcaactgaaggagtcctaactgaactactgtgcaatatagtctcacctttgatagaaaccccaatgcctggaagtccatctctagcaatatgttgacagaaaaacttggctcaggaggaggccagagagggacctctctggatgcacttggtaaaaccatcttctgctactctagctcccttggccacaggtgcgggggaaatactgccagttaatctggtaggtcggtgtaagtgagcttctcggcaatcagataagcgaggaagccgacacccacagatcgctgctggctttctcagacaggctaagcattcaatctgccaattttttccaaaattctcacctttgctagtggaggggatttcagagggtgggaaagtatcactgattctggatgatccatgatgatgtggtttcagggagaggcagatggtgccctgggtgacatcacacattacagcacctcaaacacaccccagatcctgccaacttaacaacagggtgatccacttcacctgagtccattctcccctctaacttctgccctagttttctccattgcttccccaggaaatagctgctatttgtggtctcagcctgcggctggactctgcttgttagtcttagatctggcttccatccccacctctcaacagagacagctcatgtgaagtctccaaggattctgcgcacccagcagtcttcccgtctgctcttagcatctttcccagctccctgcggcgtgacaagtctcccagcgcaccctgctcaccactctcccagctgggctttaggaccccaccttctcctcctccagctctcagaactccaatattctctctctgtctccgtccacaggtactttccctctcccatacattccatgtgggtgtttctctcttttaaaattcactctaggcggggcatggtggctcacgcctataatcccagcactttgggaggccgaggcgggtggattgcctgagctcaggagttcgcgaccagcctgggcaacacggtgaaacctcgtctctactaaaatacaaaaaattagccaggcatggcggcacacacctgtagtcccagctacctgggaggctgagggaggagaattgcttgaacccaggaggcggaggttgcagtgagccgagattgtaccactgtactccagcctgggtgacagatcgagactctgtctcaaaaaaaatgtaaaataaaatttactctaaataattatttattatagctgtttgccccctaccagcttatgttgttgtaaatggtaattaattatctcagttgagtctttcccccaactgatttgtgttaaagaagtgataactgtggaatgattatcagagaaggccagagaagaaaagaactagacagcccatagaagacagcctctgaaatactgaacattttttctacctagttgtttatgtaattcttttgtatttctttcttaaatggtttcctctcactgcaggcaatccctacattcccctccccacactgatctctctctgtagttctggtcatgtatttccaaatgccgcagctcacgttaacagcgtgtctttccacctgaagcccagtaggtcaacgatgtaaatgcattttcaccctgaaaaactaaatctttgcatgacttcattttagatggccacattattcttctcccaatcatttgtgactgaaaatttggagtcatatttgcctccttcattacccaatcaagacagtgataccctctttgtctgaaaaagggacccagagtggcagtatggtttggttctgtgtcccccccaaatctgttaacttgtaatctccagtgtcagaggtggggcctggggggaggtgactggatcataaatagtttagcgccacctgtcccggatacagtatagtgatagagagctggttgtttaaaagcgtgtagcgcctccccatccgcttcctcctgttccagctccaactttgctgcttttactccgccatgagtgaaagctccctgaggcctccccagaagcagatgctgccatgcttcctgtacagctgcaaaacctcaagccaattaaacctcttttcttataaattaccgagtctcaggcattttatagcaatgtgagaacgaactaatagaagcacattgctttctgggtggggtaaggctctgactctgtgcccaccatgtgttactatttcctcatctctctttctctctttctttctttctctttctttctttctttttttttttaatcagtctcattctgtcacccaggctggagtgaagtggcaccatctcagcccactgcaacctctgcctcccaggttcaagagattctcgtgcctcagcctcccaagtagctgggattacaagcatgcattactatgccaggctaatttttgtatttttttttagtagagaggggtttcacatgcatactggccaggctggtcttgaactcctggcctcaagcaattttcccgccttggcctcccaaagtgctgggattacaggcttgagccacggtgcccagcctgtttccttcccatttctgacgtccataccttccttctttcttctacactatgtccaagactcaggcttctcaaacctaatcaaagcgtcgctacagcccctaaaaagcctccttgcctctagtccctcctgatgaatccacataacaagccatactgaatgcattttctcaagaatacttctttgtatggaccatttcttggctcaaaaacaccacaggcactttccactactgggaacagagtttccaacatacattctatacaacactaatctcaagtgatacttacaaaaaactgcaggaaaataagtttgggaaacagaaagacactgttttccttggaggttcctaatccatattagtacattaaagtctgtgaggaagcctgcagtaatgaaacctttcattgtgtttacctcagcatttttcatgcggattcaatcacggaacccttttttcacctcatatttatcaacgtggaatatgctctgggaatgctgacctgggggatgaagtccagttgctttatcctaaaattcagtgctgcaagtgacttacacaggatcagttcctactgatcactactgaaccacgaatgaggtgaaactctttatttattgtctgttgataacatcccgagctttcccactgttctgctctggcctatggggcccacgaaaccaaagaactcttctcaatccccgcttcatggccagatcctctccattcccttttttttaaaaattatttatttatttgttcatttatttatttttgagatggagtctccctttgtcacccaggctggagtgcagtggtgccatcttagctcactacaacctccacctctcaggttcaagtgattctcctgcctcagtctcccgagtagctaggattataggcgcatgctaccaaacccagctaatttttgtatttttagtagagatagggttctgccatgttagccaggctggtctcaaattcctgatctcaagtgatctgctcaccctggcctcccaaagtgctgggattatagatgtgagccaccgagcctggccctccattccttaagccctaacttccatcctgcctcctccccgctgtaagcttttcagcttgacatgacctgttctctaaagtccttgctgcctgtgccatttgaatactccctttggggcttttgctgttgcactgaattactatattattttgcgatatcacttccagttttgcatgggacctcagcttccttatatactcagggcagaaacccctggaaggcatttttagatcctccagtgcctcacatgtccaaattttctccttcccttcacaaggaaacctctccaatgtatggttttatatcagtttgtcctaagaattctcccagagatgaaattggcttctatctttcaatggtagtgaaacagcatttctaaatgtcaccactgacttttaaagaattgtctctgcttctcctcttccctctccacctgccctgtctctgtatttggccaggccctcttacctatcccctcttttctatgtggccctttccagaagtgggtacggtgttaatatttgatcatttcacttattgtctaaaatcttctgtcccaacaaacctttgaccagattggcaaaactaacttaaatctcaaagcactaccactttttctgcctatctcctgacagggatagtccctaaaagtgaaagtgctgatgcccaagggatccattacaaggctcactgcaccacgcggaggtcaagagggagacgtccacctgcagccatcccctgcttctggctatttaaacagttgccccaaacaataattttctggactgaaagcacaggccaggattctagaaaccagagtgcaaggcattcctattaatctgcaaacaaaacagtggcaaggaaggtattcacacttacattgaaagcgcccagaagaaacaacgtgggttgtaacccgactgaaaatatcagtcgtagaattgtggaggcaattaaggcccggatgccatggggcttggggagggcaatgacgatggccagagagatgagcatggctgtccacaggagtcccgaccagtggggctccagggttcctgcaaggacaaaacagggttctctcacaaatctgtgccttcactgagtacaggggacagacctaaaacatgcactgttacagattcctcaataacttttttggcttaccagtcccaactctcacctcaaattctctgccccatccataaccagtcccatcagcattttttgacctccaagcctccacacatgctccttctgctgggaagttcttcccttctcattcatctcaggtcttagctttgacattacttcttccaggaagcctcccccaatccccttcctccccacaaaaacatgtcaggagttccctcctcctccgtactccctgcttccagtcatccctacaggacactatttcctaatggtcagtttacttgtctctctctcaccagattgcacattccccaggggaagtacctggtgcctggcaggtactcacgaaaagctcgttcgagaaataaaactcatgcatgtgtcacacttcactcaaagaaggcgacgtggaagcctaaacttaatttctattaaaagtatgcaaaggaaaactgcaggtcccctgcctgaatcagatttctccaagggaaggagaaaggcaacttccgtgtcatgagcatcatgctacaattagattatccctgcagtcaaagagcttataccaatttttgtcatctcttgctactgcaagttctatttagagtgtcccacgagacggcttggttatataacatgagccaacacggctaaaaatatagttctgtaaaacactcattaaaaaaaaaacacccctatttcaaatgctgtcacattttgagtctccttcagatgtaaacaagcagcactacatgattaaggccacttatataaaggagcttcacttcttcagagatgcttggattgtggcaccactggggaggagacacctttgcagggcacagctcttccaccagctgctggctgccctagttcattgagtccacgcctgcggagattcagcctcactttaacaactgttccccccagcccagccacttacctcttcccttttgaaatccttcaaaaggcaaagctgattgggaatggggacaaagaggcagaggtttctcagaaattcaagaagtgcacattgaggcacatgtgccgctttctacgcatttaacaattgttagacatcgtgtcaagcccttgatgttgatgatcatttattcatcctactgtccccggtctactctaaaggaaactgagtctcaggttacatttcttgcccaaagtgatgcagcaaatggctgcagaccatttgcctctgaagtcgatggtccttaatcaatattttaaaaaatccatgcattttaagtgtaaaatttggtgaatcttggcagtttatatagtcatgtgaccaccgcatgtaattgtcaccacagtcaagatacagaacatttttatcactctaaaagtctccttgtgcctctttgcaggtgatgccttgccccatccctacccccagctaccactgatctaatagtgtcagtccctatagctttgcactttctagaatttcataaaaatgggaaaataatcctatcaggtagtcctttgtgcttgacttctttcactgagcaagtttttaagatgcatccaggttaccatgtatgtattgatactttgtactttttattgctgactatattatagtatggatatattacaatttatttgtccagttaacaatcaatgagtttccagtttggagtgattacaaataatgctactagaaacattcatgttcaattcttggagtggacatattttcatttcacttggacaaacatagagaagtagaatgttggatcctacagatatgtttaactttaaaagacaataccaaactgttttccaaggtgaatgtatcacactgccttcccaccagccgtgtatgacagttccatctgatccacagcatcaccaatacttggcagtgcccatctttttcatttagtcattctagtaggtttgcagtggtatggtgtggtgattttaatttacatttccctgataactagtgatgctcaacatcgtttcatgtgcttactggccattcatacatcttcttctgtgaagtgtctgatcaaatgctttgcccactgttttaattgaatagtttttttattgttgagttgtaagagttctttacatattctggacataagctttttatcagatatatattttgcaactattttctcccagtctgtggcttatcattttctgaaatgcttaatgccattttaaatggactcttaagatgatctcagtatcatcaatgtgaccagtacaatgtatgtcccaaatcctgaagaggccaatgtaaaaatgctgtctcctcactataacggcagtgttaaaaaacatagtgctagattccaaaaaatcaactctagaaagacatctttgagacagttggagaaatctgaatttgggcaggctattacaggatttgctgttagttttgttagatatgataatggcatggtgattatacatattttaaaatgtcctcataagttatacactgaaatatttatggacaaaaaatccaagatgtctagacttctttaaaatgtttcagaaaatatagtatggggatagatgaaacaagataggcaaaattgttaaagctggctgatagatatatggtagctcattatactgttctttctacttgtgtgtatatttgacaatttcaataataaaaacatttaaaaagtagtactacatttgctttagccatcacggcatgctcacaaattcagtaagcaatctgaagctgcctgagttgcacgcttttgaaagactgtaacttgtcagttctaaaacaaaggtggaggggcggtgatacttttgaaaaggagcttttaaggccactggttcttggcagttgcaaaccttgtaagccacagaaccacacaaaatcagcacacataatacggccattatacacattcaagagggacattatgaaatcttgcctttaggatgcaacaaatcctaacacatattagctcaaagaaatactttcaggtcaacaaaccagatcttgtttctaggcagggttaatacaactcttctactgaggatggttagcagtgagtataggaaatgccctcaatgcatcttacaaaaggaaaaaagaatccctctgagagtgaactgatgcacttaaggcagtatcagctactagataatggaaaaggcttccttgggtcatatcagcctcaggtcaaatctcctcggagctctgaattatgctctcagtttagtccctcagcatgaagttctaaagcccatgattccaaaccatgcatccttgcctcctgcagaccagcctgagttggtggctcattcagaatgcaccattttagagttggaaggaccctcgatagtcataccatccaggggatctcaagcttggatgggcaagaaacacatgctctggagatcttgactagtttgccaactgttcttccccgggttctacaggattttctgaagccatatcaaagttttctaaccatgggcttaatgtaaacatctcttcacataaaggatgacaaggacttgctgaagtggcttgcccagagtggcttggcaaatgggcggcaggagccaggcagagaccttaagtctctggacttcctaagtctaagaaaggcactgcaggaggcttgtcaatgaagggtggggggctgttaactccctgtccccagaactggcctgaatgctgccacaaatgaccggtgaagaaaacagacgtggcgaataataaaatctgtttgaaatatttttaaggcaatggagagtaaatgaaaacacagacaaggtaagggttgaataatctgccgtgaggaacatgacaacttccctgaggcgaaaggagacctgggcctcctccgccgccgccagctgagctcctcactagccctctgccacgcactcctctgctgtctggcagcagggttaaggtggacatccccaaagagaaaaccttgcagctctgggttctagtcaaatctttttagacatagacacgggcattcatgtttcctgacatgacattaaaaaaaaaatcccccctggacttgtgtttagattgtacttttcggagcgggggcattcagatggtgccttccacgtaacttaaggtcaaacagaaaagctaactcctcaaaagggtaacttaggcatataagcattacataacatcgctttcaagttggtccttaaactgactcattacccatacatgtctgcttccgttgatgtctgcatgattaagctaaagagtggagcctgaaacttactcctgtgtggtttttgggctctttatcccattctctgtcacataaggtggttcctggcaggttgttctatgcgtatgtgaggtgatctgccaaaaagctctgatgaaaaatttagccgggaggtggacctcccaggtggctgctgtggatgtcagaaaaggggccatgaatgtatcacagaagaggagctttgaatgcttgtcgaggggccccaaatagcaaaatgcccacctccaaattgtctgccttttctcagcaaaatgtgtagcctggaaggaggtaggctggggggaacccagaaagaccataatcatcatgttttgttatgtgaataatggcaggtacctcttaatagactaaacattgtacagtctgcagtcattcaagtcctgcctcccctctgacccctggcaaaaaaaatattccagagatttcttacaaattctttagtctgaaatcaattccagaagtgcggtgtggaaacacatatactggactgagcatcaagacgtctacgttttagggttagctctgccattagttagctatgtgactttggcctgatttcttaactgctctgagacatagtttcctcatatataaaagaaggggctgattaagagactttctcacaggtttaatagtatctagctgcttctctttctttcctggttaaaaaaaatggataaaaaagttaaattattttaagttagatttaaaactaaatctatggtaacagctacaatctcctcttgtctgaatgtggataactgggatccccagtactgcaccaatacatccaggaaccacaactgagatgcaagtcctagccttcctgctgcttctaataggatttttgaagttaaagatatgggtacctcctcggactcccttaaacgggtagaaaaacgccaccagcaggttcatcaggacggccaggttaaacgaaatgctgctccagaaagacatgttgcgggcacaccagtacaacacgggctgggctgcagagacaaaggcaaagccgcgtgaggctggagaccccaagccggaacgccaggaatgcaatgtggcccttccgccagctctgccccacaagtccacttttgttcccggtttttaccacaagagtaaaaatgatcatttgtttggaacttggtacataatgacatcagattggtttatttctgtgtggagtacttactggaacagaagatgtattgggggtggagtaaggagagagcaaaaagagaaaagttggagcatctataaaccctgcataccccagccgcagccatcagttgcggaatctgggggttatccagagttcacacattgagtcctcggttccccctagggctctgggaccagatgagatgcccggagagacccaaaaattcaattagctttttagaagtgtggggcactggggaggggtgggggagatacagcattcagagtcagccccgctgggccccagactagggctggtatcatttccacattcctctctggctcaacatgctccactaacacgccagtgcctaaaagcaagacaatgattcctttcccggcattgagtcatctgccatttccctgaagttggatgatcattcttgaggacagggaagcgaggggtacaagttgctgacctcgtggtcagcagcagagttcccatctccagggctgtggcagagagaggatgtggcagcaaagccatcacaaaggggcaagagacagagacgctttggacattgctgccaccttaatccaccgctgcccacaggttatcccacgctggccgggcattctcagtcttagaacaacaaacacttggttacaggggtgcctttttccctgaactctttttcagtggtgctttacacttagggtgatgctccaaaatagacatggtaggcataatttcagtgtccatgtcacaggcaaagtttccaaaagacagtctcattccacatcatccccctccagagaaaagcatggagtacgtgagaatggatctcgatcgtatatttctttttcccaatgaagtcatcatgtaactttgcgacagcagccaatgacaaatccaacggccttataataatgcttgtagcagcagccaagcctttgggagcttccaaccaaaataaaattatggtacaattaaatagagccctgggtaatttattaatcgcccatatcatgtttgcacttggtaacaggcaatgtttccaaactgtagagttttagagccatgagcaatcatctagtttaaaatccctcattgtataaatgagggaaactgaggcccagcacagggcagaagcagtggagatcttgttatccaggttagtgatcctctggggtcagcggcagggataaaaataaatgacccatgtgacaattgaatggggggccagccaggacccagtcaaccactacgtagcaatgtactttctttggtaagttgattgctgaagcaaatttaagctgagacatttatctgctctagaaacaacagctattgtgtttcttctgggactgaagcccatttccgatctggatatgtaaactccagaagaggacagaagagatgaatggcaaagagttgataaccgctgaagctgagtgatggatatgtgggaatctgaaatatcctctccacactagtgtgtgtataaaaagctcataaaacaaagttggggggaagaaaaggatctggcaaagctcagtgatggtctgtgtaagccagcattcgtttcagagggagtgctccgtatcaaatgtgagtgcgtgtactgcaggatacgctaatatgattgtaataaatggtcttcaactatggcatatagttcatgaaatgaatcttatttttataaggctaacattctacttaagttgtaatgttgttttcaatctggacaaacattcagtccttcaaatcaactaggtatttatccaggtgcaagaagatacttagagaccaatcttgacatgcaatgtcttttatttcctgtggcacatggaactatgtccctatctacctttccagacacttctcccactccccttccccatatactctgcctttgtatcccaatctagtggtggttcccgaacacaccccgcactctccagcctctgcacactcgctttgtgtcaatttaaaaatatgttcatgaattatttgatcctcctcccttcaagtggtacatcttaatttcccttccacttgagtatgggctggacttaacaacctgttactaataaataagagtagagtgaaactgctggttcatgccttctgagactaggtgatattaataaaaacactgtggcttccttctcctcccctctctctccctctccctctgtctcatcaataatttgctctgaggaaatcatctgccatgtcatgaggatgctgaagcagacctatggagaggtccgtgtggaggggacctgaggcctcctgccgacagccacgtaagagcaccaaggagcggaccctgtaggtccacttaagccttcaaatgatggcagccctggctgacatcctggctacaaccccatgagagacctgagccagaaccatccagaggagccactcccaagttcctgaccccaagaaactaagaaaatactaagccccatcagtctcagacggatctcactacgtgtctgagtcctagctgcagatttactgaagaacagatgatcctctgcaatacattcaggaaaagagagatgccacgtgggagagcatggaagagtcagtatgccccccaccaccatgatgataaacccatggacttggtgtatggcaatggccctcaacaatgcaacctgctctccaaggtctcaggatccatccatcctgcctgtgctccctggttcgttttccctccagccactgccaaatgccaggacacaagtcaccacctcccctatgcttagccttgtcatcctccatgtcattgaggccttcacgactcccactctggaaccaagcaatcaaggcctctgaattgcactgttgcactgaccgttcacctccttactgtctgccttatgcagagtgcaagctctgtgaaggcagatgcctcgcctgagtggtttccagctgcccccagagcacctagaagaggcccagcaaatagaaggcactccatgattatttgataaaagaatgaatataacccaacactttatggctccccataactggatgcccccctccccatggtcagatcctttttatatttggtggacatgacagaaataaatctccaaaataaatgaattctagaaaattgctcaaatatgagaaagcaactttcagttgttcacttctttgagagctcttgaaccctcaggtcaataaaggagacaaaaaaatcatgggggcaaagaatgcaacctgaagccacctaattatggtgactgaatttctcaccaagacagaccatccaacatctcacccatgcgggcttacagaggactgcccgctaaagctggggtgcaccagaaggtggccgtgcagggccattcgcttcagctgctatcccagctgtgttctcatggcatggaagcagctttaaaagcattttgggacaatctggtcattcaaggaaacaaaagcccttcaagtaagtaagtaaatgaataaataaagcccgccatctgttatctgacagcagcgccacgcgacacacacagatagcctgccacggaccgcgctgtctgacggccaatcgggtgacccaatggctgtcaaccgctagggtcagggtaagggaagctcttatgagatgagacagggccaggcgctgagaacgccacattgctgtgtgtgtttccgccacggtcactaggtttgtttcgcattactgattccagtcctcagtcgctcaagggttcgaagcagctttattgatagaatgtgctcaataaaataataaaatggataataaggtctagaagacacaagtaagcacagaaaatcaaaaagagaataggttgggaactggagaatggggaatgaggattcagaggagtcccaggctgggctctgaggtcaagatgaaatgagaggtgtgctcagttacactactcttggtatcaaaaggagatatacaaccagtgcctcaacggaaggaagacatttcttttttttttattctgttcaagtaatttttagaaactttttaaatttgttaagttctggggtacctatgcaggacgtgcaggtttgtcacaaaggtaaatatatggtggtttgctgcacctgtcaacccacccatcacatacatattaagcccagcatgcattagctctttttcctaatgctctcccccaactcctgcctcccccaacaggacccagtgtgtgttgttcccctccctgtgtccatgtgttctcattgttcagctcatacttgtaaatgagaacatgtggtgtttggttttctattcttgcattagtttgctgaggataatggcttctggcttcatccatgtccctgcaaaggacacgatctcattcctttttatggctgcatagtattccacattttatggctgcatagtttatgtactataatttctttatccagtctatcattgatgggcgtttgggttgattccatgtctttgctattatgaagagtgctgcaataaacatatgcatgcatgtaactttataatagaatgatttatgttcctttgggtatgtacccagcaatgggattgctgggtcaaatggtatttctggttctaaatctttgaggaattgccacactgggaaggtgtttcttaacagaggaattagcagggcaggttttgcagtcagactgcctgggtgtgagtcccaggtccttgacccactggctctgtggacttgggcacactgcccagcctctctgaatccacatagaagggctgccatgatgcatgccaagtgcttagtacagtgcaaactgatggtgttaattttgtttttctactaccattacattagtagaatgtgaaaactccaaggtgaaggtgatcctgtgagcagctaggacaggagagcaaagtgagagctctgtttccagagtcagaaaggcctggatctcagctccaccgcttactagcgagtgtcaccttagaaagtgacaatgtctctgaaactcgaatcttctcatctgcaaaatgggcaataatcgtacttcatggatggttgtgaaggttcaatgagatcactacagtaacacgatagctaacactcactgactgctttcaagctaccaggagctcaggcaaaccttcacatgttatctcacccaaaaacccatggagctagttacaaggcctacctgggcaacatagtgagacttctgtctcaatgaaataaaaaaaattaaaaaggtacccccgaagaaagaagtggggtttctagaacagaagcagtggtatctattgcaagagtagaagtgaaacatgatggtagtgtgggtaaagaactaacatacttcttcttagaaggggcgtgcccttggagcgaagggaggcagagggccctcagggagggccttctggaattgctggctgtggctgctggaggcattcacctgccccctctgctacctggtgtgacctagacttagagagacaagagccctccacacagtcacagacctgttcattaagcctctttctgtaatgatgcgtttgcagggcttgggtggggaatggaatgttctcctcaggactgtctccctatggctggtgggagctgagagcagagaaggtgggtgcacagcctccccgccccaggctcctgaagcacggcccctctacccgctacactgcctccctctctccctcccggaacctctttcaattcatcactcttcacccagaccaagagcaaatcatcagagattttacttttccaaacttttcactccaccccacctggcaggtgtgaggtagcccttcaacataaacctggcccagactgggaaacatcaggtgatggtgagagaaatcaaaatggtggttgctaggtacccatcaacagtgggctgcgtaaagaaaacgtggtacatataaaacatggaatactacacagccataaaagagactgagatcaggtcctctgcagcaaaatggatgcagctgggggtcattttcctaagcaaattgatgcaggagcagaaaaccaaatactacattttctcacttgtcagtgagagataaacattgggtactcatggacataaagaggggaacaacagacagtggggagtgcctgggcgggggcaagggctgcaaaactcttgggtacaatgttcaccacctgggtgaacccccccaaacctcagcatcgcacaatatacccaggtaacaaacctgcacatttacctcctgaatctaaaataaaagttgaaaaaaacaccaaaatggtggttgcctctggagggtggggggttgtgagtagaaaaggactataaatgggaatgagacaactttctagaagaaaataaatgtcttgattaggttggcagtttcacaggtgtggtagacagaatggtccccgcagacatgtccatgttctagttcctggaacctgtgaaaatgctgtcttatgtggcgaaggggaattaaaggtgcagatggaacaaaagctgctaatcaccgaccttaaagtagacagatgagcttggattacccgggtgggcccaacataattacaaggagccttcgctgtggaggcaggaggcaggagaggagggtggcgagaggcaatgtgagaaggactccattcaccattgctaaacctgaagatggaggaaggagccacaagccaagggatgtgggtggcctctggaaactggaaaaggcaaggaagccttctcccctagagcctccagaaaggagcgctggcctgccaacacttgctttagtctagtctagtaagactcatgttgaacttataaaacaatacatttggttcctttaagccactcagtttgtaggaatttgttacagcagccacagaaaactggtacaatgggtatagaaacatttgtcatatcgaatcaaagtctacatttaaaatctgtgcctatgattatatgtcaattatatcacaataataataattaaaaaaagataacagaaagtctgctttgttcccagaaagctggggaactctgtagaggggccaccttctgaggctgcctctccaccagagggaacggcatctgcccccgccaggccgacctctcctcaccctccagtcgtctccaaatcacatttgattccagagccctttccatataagctgtctcaccagagtcttaggagattgccaaggcagatatcatcattcataaatctgtcacattatagatgagagagctggggttaggagaggtcagtgacttgtggcagagccacaaccaactctcctcccatctgcacgttgaaccgacacagacaaccagccccagcagtgaggccggagtcaaaggctgggaaagcagaagacacaaagctggtctgcgggcagatcctcagcaccagtcccagacatccctgatgacagatctgatcagatacgctttaaggaaaaggccagggcaggggcaggggcagggtgaggcagtgaccccggcagtggctgtttccatcctgaatccactggacagggggaaagggaagtgggcatggctgctgtcagccaaccttcaaccacaacaaaagagcaagagaacacagatcacagaactctgcagctggaagcactggaatccagcagtttccaaatgcctttttcagcagggtaacgtgctcctctccggtcccaaaacaccatcttaggataaagacgccgctagataaaagacaaaaggcaaaacagctccatatgaagcagagcaaagagggtcccctccctcttgccattgaaactccttggaacttcaggagagcagcacttgaaaaccacccatgtcgtccatccttccacatttcacagatgaggaaactgaagcccagaaagggaaagagacttgccagggccacacagaacctccctcccctgactgcccaagacagttacttttgaccacactggggtgtggctggttgaaactacaacccgagtttacattcttaccttctgataattgtcaagtagacagttttccctccttgggttgactgagctgtagaggggccaatgaatccgggtcttagattaaaagaataacaaaactaccttttcagatcagccttgaaaataatataatattgcttaattagcctggctcccccatcctcccccagccctgcaagtccttgcaaagccatggagcgtggttatgacgagcctgccttgcttcaggaacaagagccaccccgaggttaggggctagtggacagtgacggccacctcggtgacagcagggagacagagggcctggaattatcactggatgcaagttggacaccagtctttggccatttacataacacccacctcctttctggatccacctatcttacccttccctggaaaggggtattattgttagacaactgtagcactttgcatctgagtagctcttggtagtaatcaaagtgtttttgacacctaacgtttcataacaaccttgctggaccccagcttccatgtgatgctgacatggcagatggtaagaccctcatttttcagctaacgaacccagggcacaaatgaggttaagtaaattgcccacgatcacatggctggatagcaaggagccaaggccataatttaggtttcccgacttccagttctccaggcacgctctgcctagccaggtgtgttttattacctagttcaaagggggacactcctttctttaggtgcaagaggtcacagtcctaatcaaactgtgtaaacaagtggtcctggggaggagaataggagagacaaatcttctccatgacctagacatatacccatgaagccatctttcccagaattcaggaagttcaggggaaaagacaggccttgcagtccaaggatcatggtgctccctggaatgtgagccagcctacctgtccgtttctgggccaccagaccattctaggggaggagcccctttgtggcatcttagctgcaagacagggcagtggcggggagcatagatgtatgtgtcccagggtggagcctggtgggagcgggcatggcttgcgggggagcagtccagcacagagtgacggctgcaggactcagatccttcctcaaagaaaagcatttccatcagcttctaaaagttggtccacctttcagaagccctcgctctgggccttgagagaatccagagaatgggattttccacctcactgcctcataagacatggccctgacccatctagcccatgacactcaccacggctgctcacttacctgctgcagaatgatttaagttctcaggttaaggccaagaatttgaaaaatgtggctgccaaacagtgagccaaagcttgagtttccacaggctgaggaaaattctctgtgggcatctttgatttttctcttttcacatcaactctgggagtctcagggacttcagaggacatctcccaccagactaacccactcctgcccagcttgaacagatactctgtgggtgacagagcaacgccagtggctaccaagaggtggggcttaccttggctgtcttcctacacctgtggtgaactgagaactccccactccctggggaccctctctctgcaagttttattatagtgaacggcaactgaacgtttccgatttgccgggcgctaagcgctttatatgcattatctcatttcatcctcagaagcaccccatggggtaggtgccattatcatccccagtttacagatgaagaaactgaggccccaagaagtaacccgctgagtcatccacctaataagtgccctggcacccaagccccacctgtccgacgcctcagccctgttcccaaccacatgctctgttaaacacctctcccctgagcaagagtctgtcctgttctgaacaccttttggcattttataatccaccccacccctacccctacccaccaggtctttcagaggcataaacaggctcctctcacagtaaagaatagtggcagaaggtacacatgcattcgaatgcctcaactttcccatgacgtttaatacatttgttaatatgggttcccaaacaatccccttctgcaagctgaagggctgccagggctggggtaataaattattaacaaaaccattgtcacacaatgactgctgtgggtctggagtccttttttagaaaccaatgattacaatcaaaactcaaagaccaggaaccatgaactaggtaataaaacacacctgggtaggcagagagtgcctggagaactggaactcgggaaacctacattttggccttggctccttgctatccagccatgtgattgtgggcaatttacttaacttcatttgtgccctgggttctttagctaaaaaatgagggtcttaccacctgccatgtcagcatcacatggaagctggggcccacccagcaaggttgttatgaaacagtaggtgtgaaaaacactttgattactaccaagaactactcagatggaaggtgctacagttgtctaacaataatacccctttccagggaaggtgtaagataggtggatccagaaaagagctgggtgttacataaatggccaaagactagtgtccaacttgcatccagtgataattctagttggttctggtaggttgaatggcctctaaattgacagcaaaaacacaatgaatggcaattcccattaagtgtcacaatgtagaatttttttttttaagtttggacggcatgaaaaagaacgagatcatatcttttgtgggaacgtggatggagctggaggctattatcctcagcaaacgaatgcaggaacaggaaaccaaatactgcacgttctggcgtataagtgggagctagatgatgagaactcatgaacacaaagaaggaaacaatagacactgaggtctacttgagggtggagggtgggaggagggagaggagcagaaaaaataactattgggtactgggcttagtacctgggtgatgaaataatctgtacaacaaaccccagtgacatgagtttacctgtataacacaccttcacatgtaccctcaaacctaaagtaaaagttaaaaaaaaatttggctgaaatttcactagctataaaagccattcaaatttctgcacgtgcagagataaacatcgttgcttccgcttgtcaaagtttaatacacccaaaggcagaatacaagcttgtgtcagaccctcctctcaagtaatccccagcctttccacataaagcatttcccaacattttaaaccagtctcgacttcagcaaaagtctgacctatgaaaagggcctaatagtgagtacaatgggcattcagaattggaccctcccttggcataaattatcactcaccctaacaagaaacttttttgcaaggtctgatggctttcaaccagccaacatctgcagctctcagtttaccagcctctctcaggatgtttccagctttaatgagttcagaaataacatagacttccaagtagaaaggaagcgatgaagtgaagcaagtctgtattggagaggtgtcaacatttcaatttcatttgtctgaaataaggtcctccctcatccacactgtacagtcaccttttaacaagtgagagacaaaccagtttcaactaccctgccaggcaagggtggggcagacgcccttcgctatgcctgacacctgagagaaaaggtggaggacaaagaacccttccttcactcttattaatctggtcactgggctctggggaacggcctaagctccagggtcaaggccaaggcaggggatcttcatgatgattttcaaggtgaattcagtcttcttcaagcagcaaagtccaacctgttctattaaaaacacttttcagggtccagtatggtggcttacagctgtaatcacagcacttccggaggccaaggtggaaggactgcttgagcccaggatttcaagaccagcctgggcaacatagcaagaccccatgtctaaaaaaaaaaaaaaaaatgtttttaattgggggaaaaaacacctttcttctgagacagaaagctcaacagctctcctttcctgtctcccagtgcccacgggaactgggacttactgggaaagctctgccctatctggtaagcagcgtggtccccctccaccctgtgtggatcagaacgctaacagtttcacacatattcaacaacaactcaaccaacaaacagtaattcctaaaaaaaaaaaaaaaaaaaaattaaaggtattatcgtaggaagcccctgatggtgtaggcaggctactggcaaccactgtttccagcaattttcaacagtaaaaccagatttcagagaagcaggtcagccaccaccctggaggaccctgtggctctgacccaggaacaagaagttaaggagactccaaattttctctgggttcaatagtcaaacagatgccaaaggccagtatcttttgtggggatacacggcacagccgtctgtctcttccagccaagtcatgaagattggaaagcctccagacaaaacaaagatgaccagtggagtgtcaaatcaacgatacccttgaaaacagatgtaaaatagatgcaacatcaaaatttgcctgaagtggaaggggactgtggtaggaagctccttggtaatcctccaagagggcaagaaggtgttctggtggctcttcaagccaatatgaggcttattaaaaaggtactctaaagcaaaggagagtttggttagatctcaggaaggacttttgtccaaggaatcagagggctttaaaatctcagtccataaagaaggaatgaacaatgtgaactgcatgtctgggctgcaggagacacatgctagcctctgagggtggcttccagggctggttctatgattcaatgacaagtatcctctggtggctcttgtgaaactctcaggtcctgtctcagctcacccacatgatcactgtgggaactgtggccaggaggacatgaagactttctcatcagacctccaccttgtctcatgaaccctgaaaagacagatgcaagaggtgcttggaaaattctatcatcaagtcctcttcccgggaggagggtccagtgctgaggacctggcagtgacttgggtgctgttcctccatgggggtggcaatctgcatcgtggagagcgagggctgaagcaggagttgcagggtcaggggagtcgatctctggaaacaactccccaggtcttatttccattctgtgtacctgagggacaatgaatcaacaccaaccaacatttcctgtcctcaatgctccgaggttcccagggaattcaacttgaaatttatacagatgccaagaataatccttgccaccccccccccattttctgtgtttgtgcagtcacacggctcagtgaaagcgatctctatcctgcatctttagcaaggtagaaacatacgcataggggtgacttaggaactgggtgggtttggacagctcatttattaacttccatcctcagttccctcatctgcaatggagaaagaggaggagaaccacttgagattctattgcaaggagtgcaggagagaaaacaggtgagagcccgcacagtaccggcagggtgtctacaccagccacgttcccttcgctgctctccacacaaactgtgacaaggacacttggccatagaagccgaaaaaaataaatccactcaggccggatggaggcaaggacactggcttaggtggcaaagcatcaagcaaagcaagtgcctccttgatgaagactgcagtcacccccagtcaaccctagtccttcccaactcaactgactctcgggtacagccgagtctggtccccagcagaatgctctgggactcttcatgtctccccaccctgcatccccatcttgctgtgtgctggcccaccaggtaacttccacacggccacagagagcatccctggcagctgacagtaagatgtacagatggccaagcggttagagcagggcagggtgaaatcacacagcactcatctgggtaaagctgctttgtatattagggctttggcggcggcagcgcatatccaagcaggggacaggcccaagccaacttggtgccctttagaagcaccgactagggatcggcgggaaccacagagatcacctcatccagccccgacttgatgacaagcccatcaccctggtggagcagatactttccgcagctctgcccctgaccgaccaccatggggtagaccgcgttagcttccttcactcagctcctccaacatcccaagcacaagccaaccctcttctgaaatactcttgccctctgctactcttcacacagctccttctcttcgcatctgttgggtctcagcttgaacggtatctccccagagaagccctccctggccacgcttcgtggcgcctgtttgcttccccatcacacttctctgaagctctgatttagctgatgatgagctgatttcctagctctgtctcccacaagactgtaagctcctggagggcaggggctatgttggtctcatccctgactgtattgacgccaatgtgtatagcacctgacacccagggagtgctcagtaagtaaacatctgctatattaagccggctgtggtgacacaagccagtagttctagctactccggaggctgagacagaaagatctcttcagcccaggagttcaaggccagcttggtcaacacagtaaggcctcttctctctttttaaaaaatttactatattaatgaatgaacaataatcctgaaggaggtgcaattccgaaacactcaagccaagctttgcatccatggcagctgaagtataactttatggccagaagaagcctgcatgtgaaagctcaaagtcctgctaagtgggaatatgcagcacaccgcagaccagccaaaggcagctgatgtggtgttgtcacctctacgggcttatccggtttttgcacgtaactctgtgatgggctcagcctggctgaggatccttaatccatcgagttaactgttaactaccccggccccagtgacacagcagcttgcatgattaactacagcccgggagggatgatcatttgtgcaccttccgtctccaaacctggctccctccccagacttgatagctacaagctctgggctcaacagtttgtgggtttgtgttgcaaggaggctaataaaaacatatttctcaaataccatatggtgagggcaactgcaacacatcctcctcgaagagcaataaaatatatatatttttaaagtcctgaattccaggggaaaaacgaggcttgaagacttcagagggtttacaggactatccccttcagtgtcagagccatcttgatcaaaagtctaaaacccaggaataggaaattggtagaaactttgagagagcctctgacagtttcaaagaggaactcagaggacctcaggaaatgtgagcgggcatagatttctccgtgaaaaggagggtcaaggcagaagaaccagaggcaactgtgaacatcaagtcagttctcagggaagcaggggatccaagtgtgtacatgaggcgccttcactgtccctgcatcaggaatctagctgttggcaccttataatgagaaaacagtctcaaccatgaagttaactctgctggaagatttccaaagggaaagtccctcccgttactcagaggggaaaaaaaaattacctacttggtctggaatccggggatattttatgcagatgtctctaacagaagttaataaagggaagtcagcttgcctctgattattcaaacaggctactgctattaaggattgcacaacttctgggcaaggcagagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatggaagactcctaggataggtctctctcatggagggattggcacgatggtaagagtccagtggatggaaaaggcctcctccttaaagatggtgatggaaacgagcactgcacagggaaacacaaatcaggtcccctgaaatccagcccaacctggccagaccctccagtgcccatcagggcttatgaacagggtgcttcagtgtctttgttaggggtggttaaaaaggagcacgtgcttataggggatgctgctgagctccatgattttgacttcctgtctaacctgttgatgctacaaaactcttttaaaaacagttaccatgggaacttttccctagcaagcattcttcaagaaacgttacaggtgctggtgaattcaatgcccttggtgtcaataagcttttgctgagtcttagaatgtgtggcttgaactgagaggactttcaaacagataatgcgaagtttccaatgcaaatgtcttcggggttaagtgtcagtgaagtgcagtggaaggtagggggataaaatgatctcagtgtatatggaggccccacttaagcattcaaaaaattctatatacagtgttttcaatgtattatgtatcagcaaaacaaaataccccatagggctataatcagctcagggggtcacctcagcaagagatgctctggctatcactcctactacgggatttcctctctcatcagaaccagtaggtggtcaaaaccacaataatgcataaatgaaggcagggaattgggtatccaatgtgagcaactgaaaaggtgccatgtattagctatttgccattatggttctgcaagtgctcagatgactcataaaatgaccagaacaaaagtttgttcttttgtttttactttgagaagataaagaatcacgaattagtattcaaggttacctaatactaacccttgtctaccacgtgaccttgcattacagggagctgttgttgggacaggacaagagtccacatcccctgcccagtgcctggttctgggtcatgtcaccgaagcgcatcagcccatctgtcagccaaaccccactagccttgtgccttctcttctaaatccccgcggaggaaaacaacttctgccttctacagtacgaacagcgagggtctgctgggaaccaatacaacttcgcgtcccagtgcagcaatgttgccaggtaacaaatgtagaaacatactccaaaaactgtatgtgacaatatacaacctccgctctgcagctgataaccgagggagtgttaaaacaccgcgttctcttaacacttgggtttttggtgtgaaagtaaaattaaacgggatacttcctcttgtaaatataagacaggcatacaactcacacacgtatccactaatcggaaatagtagaggggtttgcaatagctatctgcagtgcatcccagccttcactcttaccctcaagatgaattccagaaaacctacagaaacgataactgaggaagagcctttcttctgtcggggacaagctctcctctaacaattgtgaggaagctacccacaagaaagacaccagcagaaattaaggaaaagctcatgcattgttattaaaaaaaaatgtgcttccattccactccattttaaaggtctacctttaaaactcattggctaaccaagcagtgactacttgcttctcagatcaaataaccagtgcagcctgttcccaccccaaacgaaaacaagatagacactgctctctagtaggcagagctccaaagtgggtacagggcactgaatagctccctcacattgtactcatgtaacttaaaggctggctagcatgggagaaagctgagagacttctgagggccttgtgttcaaatcccagctctgccaactgggtgactttgggtaagacacatggcttttttcagactcagtttcctcatctgcaattgggactattccatgtagcccagatagagtacctactggctccacgcacagtgctgggcactttataaaatgagaagaccttcctccctttcccttcgcccaaacatgaatattcttcaaccagtaaagactcagatgtggggagtatctggtgcatttagcttctctgagcaaaacgggcaaaagctgagatctaataaccatcacatgatgccaaagaacatatgcttctttagacgcaagcgaaaaacaaaaatcgctattaatccaacttttcataacggccctaattagatgagctgctgtcaatctcttccacagtgaggaagttctgtaggacagtcttcctgtcattaactttcctaagacctgggaacctggaacttgctggaagtacatgtatgtagcacacataattgtcatttggcaaatgagatgcccagtctgaaaggaaaagtctttcatgatttcctcctccagaattcatgggcagaccttataaacaaagcaaatacactgaccactcgagctgccttctgattatcaggagggcacagtgtctcccacaaagactccactaccaaagaaaacaaaatgtggaggcacaacttccaatctgcctggcaaacagacgcaaagtccttgaagcggccatgtctgtgcctggaaaattggtggagtaaggaggcggcatggtagagaggttacaaactcacgttctggcagaaaacaaaccctggaacaactaccagctggctctgtgactctgagcatataacctgacctctcggatcctctatttcctcattagcagaaagggatcaaaacagtacctactacataggcgccccaggaagatggatgagaccatgcagtgagggcgcctggctagcccgtggtacatgagcacttgttaccactactgtccatcattattacaaagaagaagaaaagaggactgctgccatcataaggctatttctccaagttgacatgtatttcccatgggctcagatcaattccctcccacacctaaagaaggtcccctttaaaatggcaataatcatcaacaacacaagttcacatttcacatcctcatgtttctattcaaaaatggtaagaaggctaaagtaacacggtggccacactgggtcagaacttctatctctacatttacagtctgagtgctggggagtcagatggagacttgaccccggaagaaagtgcacccttgggcgagttagtgggtgagggaagataaacaaccaaaaagtaagcagagttgctttggatgagctgttacgatgtgttaaaagctccatgctgagctgagtgccttccacatattatctcagtgaattcccagaatagtttatacagtaggagtatccacactgattcatcatgtacacactgaggacctttcatccagcacgtgtggaggctcctcgaggggactcggagtgaagacagacttggtctctgccccctcgggtcttacagtcaagctccagttgaagtgtggtcattactacagtaaatgaagcacaacccattatctctgcctcaggggatcaagaggaagtttctagagtaggagacatttcaatcagggcttggggagcctgccaaagggaatgagggcacgtcccacatgaagcaaaggcatctgagttcatggccccgctggggattggcaggcatgagttgcagctgcaggacaataagcgtaggggagtgagtggagaaacccaggtggggccagaccacgtgaggcactgatgggttccatcagggtggccatgggctccatactccacagaaggctgttcagatggggaagcaggtagtgagggttccatttggggggcatcactgacaaccgcgtggaagagagaaatgcccagaggcaggaggccactaaaaggctatctcagttatccaggcaaaaaggctgacaggtgcagatctcagcagccctatgctggcaggcggtcgagcctggtggtcaagaatatgaatcctgaagtaacagtgcctagtttcaaaccgctgctcctccattcccagctgggccactctgaattcacagtgccaactatctggctcattataagtcctaacaatggttaaactcccaggaggtagagtgggcacagattagttcctggagaaaagcaagagaaaaagaagtctgatgactgcaaagcttctagcttgggtatccttggctggtggtgagtccactgagaaagctatggaacacgagagggcaaatagaatggaggaagggagatgacagtgtcatggggtcctgctaacttatagctaacacaagtggagatgcccatcagggatttgagcagaaatctagaaatcggcagagaggtgggaccgagagctgtatctttgggaggtgttggcataaatggctgctggaggcctgggcagtagatgagattacccaaggggatcggtagaaaaagaaggcaaacaggctggagatggggcctcaaaacatttcagatgttttaaggtcaaccgtatatgccctgagaagtccctgtgtttaccactaggaaaacgtttgtaggaggcacagaaatagcacagcattaagccataagggagtgactaacctgaaaccatgatgctttggggtaggacggtcagagggggctcacagatccaaagtctgtaatcgcaggtgtctggactctcaggctacatatacaatttcctaaggaatgtcctgctttgtctgcgtcccgaatctgtgttgaaagatagtaaactggggtgatggagtacatcctggcagaggctatgtggggagagcagagatgactctagggaagaaaacgtcttttaaaaaacaaccctgtctgctcccaccaaaaggaagaaagaaaagaaagaaaaaaatgaaggaaaaggggaaaggaagggaaggaaagaagggagggaggaagagagggagggagggaaggagggaaagaaaaaaaaaagacagtgagaaagagagagaaagaaagaaaacacagaaagagaaaggaaaagaaagagataaagaagaaaagaaagggaaggaggaaggaaggaaagagaaggagagaaggagggaaagaggggaacgaaggaaggaaggagggagggagggaaggaaggaaggaaggaaggaaggaaggaaggaaggaaggaaggaaggagggagggagacagagagggaggaagggagggagggaggccccagcctgtttccctgaattcccatttattagctgagtaagtggccaacatatcttgggacttaggatattgctcatctggtgaatatttacttaaaaattgccataccaggggatgaggagcacagaacaaaggggaaatactgtggttctttcccttaggcagtttaacatctacatagtaaagattaaacaaaccctagggtcagcaaacatttttccaaagggccaaatggtaaacatttcacacgctgagggtcattgcagctatctgtcacaactactcaactctgcccctgaagcaggaaagcagttaggacaatcccaaaggaaaaactgcagctatgcaccaataaaactttatctacaaacacaggcagctgtctggatttttcccgtgggctaccatttactaatccctgaacctccagaggaagactgaccaatcctctgcctggcagttcccaagaggcatctcacactcggaagtcactaaagaaagttaggaagagcacagacctcttgctagaccagaaggaagagaaagaaataaggaatatctggacctgttgaggattcagtgggataaaatgaattgatgcctcactttacaaaaatttccaggtcttctctgtcatttttctctgcacttttagtaaaattttggagactgtggaaaacctgaggttctctctgaagacatctcctcttagaaacaaattcctagccagcgtggtggctcacgcctgtaatcccagcactttgggaggctgaggcgggcggatcacttgacgtctggagctcaagaccagcctggccaacatgtagaaaccccgtctctactaaaaatacaaaaaattagctgggcgtgggggtgggcacctgtagtcccagctactcaggaggctgagacaggagaattgcttgaacccatgaggcggaggttgcagtgagctgagatcgcgccactgcactccagcttgggtgacatagtgagactccgtctcaaacaaacaaacaaacagacaaacgaacaagaaacaaattcctgcttctaggtttcgcagaaaggaaggagattaacattctgcttccaaagttcttcccctcccccttccccctcaacaactgtagtcctctcatggaaggccagacaagcagatgtatgtaactgtccacttctgcccatattgttggctctgctactcaggaaataagaaaaatcacgctgggtctccagctcctctggaagcatgaaccaggatgcacattctcccctgggaccacctcaaagggattgtgcctcttatcaccaacctggagggactcacagatgaatgatgctgacaagtcttgcagtaatttcttgccccgaactgggaaactgaatgccagtaggtgcatgcattacctactgtctgccgtcactcagagagctgcgctaaggatgaccagggcagagttgtgggaactgccatcttcttctgcaggagggctcactcaagtctgatatgcctaagaatgtaacgacttttgaattttgagcttcctccttaagacctggatttagaccaataatcctcaaggactcctgttcaataacagtccagtttcctgggaatggtgaagaagggtgtgaggtgttcaggtcaaaggcagataaagtaggaggaaaggaagagaaggagggaaagaaaggaaaggaaaaaaggacagacaagacaatggcctgggccagggagcacttcaaaccacaaagaagtgactagattgctgtttttctttctgcttcatcccagaatgtctctcattactattagtggcaaaaaccgcaattacttttgcaccaacctaaataacctgtactcaaggcaatgaaatttcccaatgtcctggagttctaaaatcatttttaatatacagtcagaaggacttgggtcaattgagtgtgaaaataacataagacagagcgtcccccaggcctgctggatgataaaccactatgcaaaaatagaaaatatcagaagtaggattttagacagaaaacacatttcacaaaatacagcatgtatttaaaataaataaaaatattattaattagaaccgagcatggtggtccgcacctatagtcccagctactcaggaggctgagggaggaggaatgcttgagcccaggagttcaagtctagcctcagcaacatagcaagaccctatctcttaaaaatatatatgaacaaataaaaataagaaccacatcatcttgagatctttgtattggccagatgccacgtgaggtgctttctataaatagtctgtgaaaacatctcaggagttctctgaggtgggaaccgtcaccatcctattctccaagtcaggaaccagtgggatgagtgaggtggacttcgccaggagtcctgaggtgggcatataggaggcagggcttgagcccaggctgtacccacaccacagaatcagcagccctggcagcagctccacttgtctaccggaccacacactttaccctcatgttcttcgtaactccataaggaagggactaggcttttccaaccctcattttgcagatgaggaaactgagtttcaaagtggccctgacaaaccccaaggtcactgaaggctggcaggggcagagctggaattccagcacaaatattgtggtctggaggcccgcagttgataggctctctccttccagggggtcctccctgagtccctaacctttacgccaccatttctcaaaggagccaagctggtccttgagccaacctggggtggctttgctgacccctcacagcttccgcagaagggcagtgtctctggggacgcctgctggggacaagtcactgcctccctctttctttaatgccaacagctctcgaacccccacgtgcaggaggagagctgccctgactccactgctggcttcactcctttcccacatggataaaacctgaggttagaaaacaccgctcagaagtgactcattcctgacttccctgccaaaaacaacacccatttacgtaacttgctcacacaccaatcttttcctcctcctcagggtgactgccctgtcaaaccaaggctgatcttcctcacaaactggccttccatttccagcagaggcaaatcaaattgccctttccgccctcatctctttgctaactggggtcagagatagcccaaccaacgtgtccctcccacactgtgttggtgacttccggaagggatgtgagatttcctatctaacacttgttcttgggctgatttcttaagccaacctcaaaaaaaaaaaaagagtgtggtgtaggaaaggcctcatgaaccagggatcactctctctgctgaatttgcaggccagtttcctgacggagcacttctcacattttccatctctagctgcttacgtgcagaaaagaaaacccttttcgggtgtgtctgtagactagactttggcataggaatagacgtgggcagccatttgatacatgaaattcccagtgcttctgaaaccagaagcaattagtccaaaaaaatgtttaactatctatccccataatgtgctaggaggttctctatggtcatgtcagcatatatatcccaaaacatctgtattggcttaaaaaaaacaaaaataaaaaacgaggtatgtccaaagatagcctgtcctcctcttcattccaggtaaggacagcccctgtccttctgtaaggaagaggaagcgaagggaacttcccccaggcgctggtgggaacatcttaggaggaaggaacatagaaattggcaaggactcgaaggacggatatgaaagtgccgtgagccctgctgagccccatgtgtgccaaaaattaattcataagcaaatgcttattttatagtttcccacttgctacaaaacatcaagccacaaggaaatatttcttctgggggctgacaggaagcgggtggcaccagagtggggagaaagaaagccggaagttctcttcaagacaagcgtgatcctatcacctgacaacgtgtcacccgtttctggaaaatccacgggctgtggtactgtctccttgttcccataagcggagggttcaatgtgaagcctgctctgatggcagccaggtaggagaagtctgggagtcacgatctaccctcagatgttatcaccattgcaggagccggggcaggaagaaaagatgctgggagacctggggacaccacccctgggagtccattatgccagactgggaagtaacctgtatttggcttccaggcatttcagggctttaggtgatgatgtgatggatgacagggtttcataataagggagcaaaccctccatgagagtgcctagcaagcactgtatgtcattatttgtggattcccataaattgaatcctctagggtctggacaatgaaatctagaatttctggagtgctgtgattcccagtgagcttatcctaaggcaggactgaattttcttacaacatccaaaaggagaaagacaagagtcaacacttttgcaaagaagggatttagtatccagggagatccaaactcctcaactgcagagacaatggtgtctccctttcctgcagctgtagcatccagcttgggggcctggctgacccatggtaggtgctcaatcgattataatgggggtggtggtgaggaagccagtccccaaaggtggtccccaacaattctctctttttatacatgtaccctcctcacaataagaggtggagtttttctccccgcctttgaaatggggctggcctcatgtctggctttgaccaatagaatgtgatagaagtgatattctaggaattctaaacccaggctttgaaaaggctagtagcttccacttcctgcttcttgaaacactgtttctcagaacccagtcaccatgttctaagaagcccaaaccacacagagaaccaaggcactccaggcagtacccccagctgagctctcagcaaaggaccagcaccaatggccacagtcatatgagtgaccacgtaagctgttctaagaccagtcaaccccctgatggttgcagacccagccaagatcacacagagcaaaagaaccacccagctgagcccaagctcacagaatcatgctaggcaccaaaatggccattgctttaggctattaaatttttaggtggttattcagtgacagataactacaggtggaggtgggacggacaagaggtacaggatattttatcatgggttttgtccagctctggaactctgagtaagtcataacctccttgagtttctgtttccttgagccactgtgcccagcgttccctaaatattttaaatctgcagttggttgaatccacagatgcagaaccgacaaacacagagggcagactgtatacatttctggaactgtgtaggcctgcctgcttccctgcaactcccctttctaccacctgtcatcaggaaacatggatctcaagaaggccagctgaccacagacccatttcccttcctgagaccctccatggtgcaccgaacaggaagtgaccgtgctccaccagctccggcaagaacccaccatgtcttcagtggagcaaagcatctcagcaatcattaattgccacactgtggtcttagcccaagtcaggctcacttcccagctggccacttactactctgaaccaacttctcaacagcaagacgaaactctgaatcactccccctggggcttcaaggttcctgtccttaactggccccagacacaaccctagttccacatcattttctccagagaaagagaagcttggggccaaggggctctgacaagtcaagtctaggctagaaggcattttcctggaaccatcggcctcctgtgagacactgggttagactgggccccccaggggtcacagaagcggggaggagaaaacagcatgtgcgtgcggccacacccgcacccttccatcctggcatggatccacaggcccccacaccacccctgcgttcccccaagagaaaacatccctgctccacacgtggctgaactgcggtaactccatcatggcatttcatctacagcctgggtgtatgagtaataaatgtgtgaaaccatgaaactaatattcataatgaccttacaagataaagaacttgaaggaaaaacagcttctgtgtgcctggccgtcaccatcagggtgctccgtgaaaaacatggcatctcaccagagccacagacatcgtctccccaggagcctcagtgctggcggccctcagccccaccagccactatacttcattgttagtccttaattaatggtgcctttgtgcacctggtcatcccgatgccaagcccagaaccgaatggggcctctgacttctcttccacgtctaatcagacgccatttcagccaacatttaccaagtatcagcaggtccaggcctgggcctggtgcaaggagtgacagggtctctgtttgtgacatcctgtccctcacccccacccctttagtcccagcaaggttcagagtctcattccctgccctcatttcttttatttgttgattgacatataacataggtacagtaaagcacactaattttaagcatatggcttactgagttgttgttttttttcttttttaaacttttattttaaattcagggttgcaattgcaggttacataggtaagcttgtgtcactggggtttatcacatagattgcttcaccactctggtattaaacctagtacccattagttatttttccatcctctccctccttccgacctccaccttccgaaaagccccagtgggcgtcgttccccctataagtgtccatgtgttcctgtcacttagctcccacttataactgagaacatgcggtatttgattttctgttcctgtgttattttgctaaggataatggtctccagctccatccgtgtcccagcaaaggatacgatcacggagttttaaacatgtgcacagtcatgtaaccaccacccaaacaaagaggtcgaatatgtttccagcacccagagagctctcttgtgccattatgagaaaatatcctctcccaagatatgaactcttttatcagagatttaagttcaggttctcatcagctcttccacaaattactgcccattaactttttaattcttagactgcctccttgggaccctgctttcctcagtttacctgtcctctactgccaggtgtatagtcctccgttacagctccaaagccccttggagggctgcactgctcctatatatgaaccccaacccccatccaaggcccttcacttctacatagcactcctcggtctgaaagacccaaccgctgttctggaaacccaactgctgctctcacacctctgggccctctctaccatggaatatgacaaagattccttatgccccaggtccatgcccaatttccccctttcagtcccatgtccatccttgaaagcccatttcatccacagaccgtctgcaggctccccagagagatgctggtccttcttccttggtggttccccggcatcacttctacttcttggagggcactaaatgtcatccttgagacatagcatcgtatgtgcacatccacgtatccttgttagaggttcaatttcttgaggactgagattctgggatttctcaaactggtaaagctttgaaatttggggaagggaaggaataacaacctagggtttccaacttctaatttggccaacagaaaaaaaaaatctatcatccataatcaacaccatttcattaaagaagacactgtggctaaggataaagattggagagatataatctcagaaaaaaatggccaggtcttcaacctgaatccattggtttatgaaaagttcaccacattgtcctcattttccacacttgactatgcctggagaaaatcctcacagacgaactggctcccatgtctggaaaccactgccccatcatcgcccctggtatagcagcacatacgcagaaagggctcaatgactattcagttcaactgctctaatcacaggaaatcatgtggttctaagacaaggagcatttcagctctgcttcctcccaacacaggagcccagaacacagcagtggctgggcaacattccattgatgagaaggactgcaggacccacccacacacacatgacaaaataaaaagcaatcccaacgtgtacgactcgtgcccacgtgacaacttagacaagcagtgggccttgccactggcccaggtgcctcactcattgtcccaaatcccaacctggtgcaacacgtgacaatgaacttcaaaagtgtacgttgggggaagcggggattggaaggcgaaagaaaagggccaccgcagttggctgcacaggttgtgccaaggcacaagggtgctggctggaggagcaggcagggactgaaatctcacctgtgctgcacctgccaagccaggcaccctggccgggggcacactgactcacaggaagaaacgccctttacaaagttgcacaaagaaccaagacttcattaaccgagactccgaatttcagttcaaggccaagaatatgtcaggtcaaatatatacatcagggtgaattttacagtatgtggattatatctcaataaagcttttatcaaaacatatgtgtgtgtgtatgtgtacacgagtctgtacatagatacacgtccaaaaaaaaaactcttattcagagagctaacaaagaaggaagagtgcataaaggaggtattaaaaatatttaaagggatcatatataaaagttatgttatttatgtattattaaaattcatgttctaagatgactgttgtggaagaaaaaatcatgaaaattgttttttaag

SEQ ID NO: 111 - DNA, 21509 bp, Homo sapiens
acacaacctggtgcaaacaaccttgaagcgggacgcagccaaagaacacgagatgccatttctcagcccaattggaaagaggccgggagcaccagttccctgaccccctcagccccaccgcctgccgccccctggtactgaccagctccttcttcctcttctcctctttcacgtcggtcttcttgatctctgccttgaaggcctccgcctcgccattctggtcgtccttggccagcaggtccatgagaaggcacagatcattcatggggatgtataaccgaaaccagtcctctccaccgcctggggatcttcactttcgcagtctacgactgcctgtgactccagaaagacaaactgcagattggccaagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatctaatcaagtgactatttttgctttattacaaaatttatgtatttaattgggatgtttaattgcttagtttttagaacactgaatttttctttttccagacaacagagtgatatttaatgaagtgcttataaagataaatacgatggttcatcaaagataaaatagtcataataacaagatggcatttgagtcaatgtggagtggactctgctttgtaaattatactgctttttaaaagcatgacctaggtatttacaatggggacatctgagaagagaaactcaagagtcctcaacttacacagccaagaatacacaatcatgtaggagaacttgccctcagaagcatttctctattgacattgccatttcttttcctccatctagtacttccatttgctctatttcactaaaaagtcacagaattaagagtggctgctgcaactcactgggctttctctgcttaaaaaaccttaatatcacatggtattaatacagctacattaataattgaaagattcactcagctgaccctatgatttttctaattattgttaactatctgaatatttggaaataattgtatttttccactgactttttctcattgccttgggtactagaaggttttttttttttttttttttttttttttagatggagtttcactcttgctgcccaggctggagtgcaatggcgcgatcttggctcgctgtaacctctgcctcccagttcaagtgattctcctgcttcagcctcccgagtagctgggattacaggtgcatgccaccatgcccggctaattttgtatttttagtagagacagggtttctccacgttggtcaggctggtcttgaactcctgacctcaggtgatccgcctgcctcggcctcccaaagtgctgggattacaggcataagccactgtgcccagccgggtgctagaagttttaacatataacttcagacacaactgagtaaatagttagctgtatatattttattgtattgttatttatattatgtcggctttgtgtcagaaaggatttaaagcacttgtttcaagaattggtatgctatatttttcaaaatctgtgtataaaaataattcccataagtaccactgtaatttacttttcatgtgtattacaaaatcagttatgtgttctggtaaacattttgatcccaagaggaagcaggattacatttagaatgtgacaaattttaaaaattaattttgttgtaaagaaatctttataatgatatgccataaagttattactatgcatgtaaggccgcataccatagtgattaagagcaggtccttggagttagaggcacagtctgaacttgactacaaaagttatcagctgtgtgatcttgggaaagtaaccattctcagctttagttaccacagctgtaaaaggtggataataattatagactctgtcctgttgttgtggtgaacatttagtgagacgactcacatgaggggctggcatagggtaagtacttactcaatatcagctgttctctttggcatagctctgttagagtggcatgccacagttaccttcttgagagccactaagcgtgggaacggtaacagtccacagaatttttggagattggtatgaggaggctgcattggctcccagccctcagggttgacagggtgaaggtaatggcttctggctgtctttagagctcccaaaagatatgagaagatggttctagtgatgacaacccactgttctgtcagtggaaatctagttttatgccatcttcatcattcgtggtgtagtctatcggtgcctgacacaaacgtctagagtggggaaaataacaccttaaagaaatagaatatcttaggtccatgatttgcctgctgtgtttattatgtaccccagcagtaaaatattttaagtatatttatttgcaaatcatacatctgtacatctttactgatatgtacatgataaacctgtgcaaaaaataacctaaaaaggggtaagattaaaatgaagaattagacaaaaggtttaaatgttttaaggtaagattcagcatcatcaacagtgggtataaatccatacttcaaatagccttggtggtttaaaaatcctctggttgatttacctttggattcatatcatcagtgtttccgtcttgttttgtggctgagaagaggaggagcagtgtcagttctgccattttcctgtcaatggtttatgtctgccttcttggaatcatatttaatgaaaggttctttgcaggaatatttttaaaccccttgttcatttggtgaagattagtttagttaaaactggattatataatatatttcaatctaactgagccagacaaattgtaacacatttcaggccatgtgtgcttctaagagggccactgttaacccctctgtggtcaagagctcccccttccctgaggttaccttgtgtgctcaaggcagctgagtaacataagaagaagcaagggtgttgatgccaatggttaccctattagtgaactcatttctgattgtttgtatgaaaacaaatatgatttctgttataatcttctgacaccccattccttggggcaccactgtcctagactctgaaatcactgtggttcctgccatttcttgaccttgacattctgtgacagaatgaaggagaccttaggttcagtggacttcattttctataactagctttactctattgatcacatagtggtatagctcttcagtgtttgcaaatcaatgttcacatatttctgtcatttgaactcagcatctttatagggcaggtagagaaggtctgattctgtccattgtaaagatggaagagatgaaaccaccagtgttgctgactgcagatggaagataattgcgtaagttcacacagcggtagacctgggtttgaatttgtttttgaaagcaatatcatcctgattcttttctatcatgttaacacaatttttaaatgatattcatattcatctgaatggagtagagacagacagttatatagtagttgcaagtttagcttttaaagaaactgccaaactgtcttccagaggctgtactattttacattcccattagcagtataggagtgatcctttttctccacatacttgccaacatttcttgttgttcttattaaaaccaaacaagtggtgctgggaatgcattaagagaaaacatatatattattaatagaataaataataatcaatagataatgtgcaggaaggggatttgcatttacgaaacatctattgtatcctatgttctttacacatattatccctttaatatagttctatacttgcagggacaggttttgcatgtaaagaaattgaggttcagagatgttaaataatttgtctaaagtacacagcatttaaattgtagagtttaaaccaaagggatctggtattaaaaaattccaggtaatgttaaaataaaacaatgcattaaatttgaaagtctttctgttactttttgttccaaattggatctctgtctttggctaaaaatcaaccatgacaacaagaaatgttggcaagtatgtggagaaacaggatcactcctatactgctaatgggaatgtaaaatagtacagcctctggaagacagtttggcagtttctttaaaagctaaacttgcaactactatataactcagttattgtactcgtcagcatttatctcagataaatgaagacttaagttcacacagaaatatgtgcatgaatgcttacagcagctttaataacagtgaaaaactggaaacatctcaaatatccttcaatggaaagacaaacttaaccattctgttaacagttaagcatgtatggttaatcgtggcacatggaatactacttggcaataaaaaggaacacattgttgataagtgcaacagcctgaatggatctccagggaattatgctgggtgaaaaaatccaaacccaaaaggtaacacactgtatggctccatttatatagaattcttgaaatgacaaaattatagaaatggagaaaagaaaagtgcttatcaggggttaaggagcagtggggtggaagagaggtgagtgtggccataaaaaggcaacaaaatggatgcttatgataatggaaattttctgtatcaatgtcagtatccttgttgtgatattgtactgtgtttttgtaagatgttactattgggagagactgggtaaagcgtgcatgggatctctattatttcttacaactgcatgaggatctacaattttctcaaaataaaaagcttaataaaaatgcctactgatcttcaggaagttcagttccctgttttccataactgatctgaaaataggggaaggacaattgagaatttaggagttgtaaactctgaggctgattttcagcgaactactcaaattattctgatttttccccttgattcttattatggattgtaggacattcttcctactattttggagaagaaaaaatgccacctctctatcataggacttctgttttacatatgatttaaaaatctattagctgactaatttacacactagaagatgaaacttggttacattagattccattgccacaatttattttaaaaatcagagttctcatctttcttgtttcttcttcctgccttactttattttcttttttccttattctatttgaacccatattttcctatattgtactgtttagtctaaaaactagtaagcatgcatattgttgattaaattagcaattgacgctcttaaaatgagaactataaagactcttgagcttccacacattatgctatgcttgccatatgcttgggtgttcttattttcggagagaagtaatggagattataaatgttatttttaaaatttactggtgatttgttgagaagataaagtaacaacactattacagagggttgctcttgatctcccaggccaccagtgcagtcaccgagccctctgcaaacacctgataatgctgaagagtgtgttagtcattgtagaggagctgctgtcatgacaaataggggttaaattgtgagaatttcaggatatattttggggaaggattaaataaatcaggggacttgctgacagcaaatagtatctttgatttgaaacacagaatcagagaattgagatgaatcccaggtggtggttgggagtttgaaaaagtcccagtgagttggctgactaagtgtagacttcatttcaacatcattaaatagtctttaagtggtgacttaataattgttgccccaagaaaagattttgctaaatacagaggtggaattaagtatattaatccaagaaacattttatttaaatgattttcctaacagtaaggttggaaggccctagaactgcttctaggagcttgaagtgcatttaatagttaactgtcagaatgaaaaatgaaattttaaatttcaacaatgcaattaagttcttattttcttatgatagtgaataataaatttcattcaaggacgccattggcagatgttgaaaagaaccattttcactccactagcttgcagtggactaagaggtagcaggaagggagattggtactacagatcctgaaaaaacaaaacaacacaaaacaaaatccacaccacaaatggacacttccagatgcttaccaacaggaagtgccttggaggacaagggctgtgagacaggtgaactctagggaacaagaattcctagttccatgtctgtttacaagaatttgtcatgactggttcacctcactttatagtttcctcagaccaaagagacaaagaaaaagcaaaaaacaaaaacaacaaaaattctgaaacgaatggacaatacaaccaaaactttaatatgaaccaaaacaaaaattgggctgattttatgaggttgacttaaagtcaggaaaagaatgataaacttttgagaggaagaaagaaatcatcaaagccacgaggagctcaaagtggtgtttaatagcagctatcacattgcgcccgagccttgaccacttctgacgcagctgtttcgttttaagatgttcccattcctgttccactcacacagtcctccacagtgacctgagtgcacgcacccaagccggcaggccactctagaaaaccgtaaacccctcagagagtcactgcaggaataggggaaatggaagtgatgaaattcaatatagcatttagctgaatcatcatctgaggttaagcccagtgaacaattagcagtatcgggagtctcctcgtacctgtcaaaatcgcaccgacgggattttgtgcaaagtatgtatgtgtgtggaagttgttttttatgtttaatagcaatggacctggggtagtaatttagatacaactttttaaaaaaaatactaaagggcaagtgtggtgagaagcttcttactcaggaggatcttttcaaacattgcaaaacatcaggccttgaaataattcattttattaagtagcgcactcttgtcttttcattcacaaaaggaggatgatttattatacagataaatgcttgcataggatgatgaacacctgtaggaatgcatgatattctggaagttgatcaaggtccactgtacaccagtaattagaggtcatgatgatgataataataataataataattaataatggcacatactatgtgtcagctcctgttctaacttcgtttctcatattaacttatttatttttcatgattagccactaagatacaattattatccctgttttgtagacaaggaactgagtgaagctcaaagaagtaactaggatcacactgtcacacaggcaggaatgaaacccatgcagattggctccttagtgtgctctctgatctattatcattcatcacatatttactgagcatctagtatatgaaaggtattaggctttatgcaggcaatactttagcgaagccagggagatgtctctgccttctttgagcttatagcttggtgggcaaaaagctaatggtttaactgtataaaaaacttgatgttgtgaaatgatatatgccaatgtttgcatggtatgatgattttgattaagcaccataataaaaatagggagcctgggtctcacacagccttgattgtcttcttccttctgctccccagtggagtgcgtaggaaggtcacaccctcaatgtcaggctccttcactgttctcagtgagtgtctcaggttgtaggctacatgagcaggtttgcacctggatatgattgtggcagtaacaatagatgtgactatacacagtggcagtggcagtaggggtgggagttgggtgatgggatgatcttagaatgcagtgttggtattaactcagttttgttttgttttgatgtacagccagccatacgactctggaatatgactctgggtttaccaacttggggatggcccggggatttaggagatggccccaatggctctcctcttttttagaaaggactgttcaagttccttttttttttctttttaaacaggatctcgttttgtcacccagatcgggggcagtggtgtaatctcagctcacttgaacctttgcctccctggctcaagtgatcctcctgcctcaggtgtgagccaccatgccaggctaatttttgtattttttgcagagacggggtttcaccatgttgcccaggctggtcttaagctcctgagctcaagtgatccatgtttctgcctcccaaagtgctgagattacggtttgagccaccacatctggtttaagctatttcttctaaagatatagtcacatctattatctttgacccctgcctaagcaattctgttcagatcttaagactatttcttcccgggattcaaactcagagttaagtagagtcaactatatgaggtatatgtgaggttaatttttgaaacttttatttttaatttcatctgggatctcctctagggaagaccactttatgattatgggttgcattcccaagttcagttgattgaatttattcatacattatttaataaatgtttattgagactgaaaataaacttgaaatcctagaattcattggttgtcttaaaaattctaaatatgaaatgctaactttagcttcatgagtatttagaatagaaaataaataattcaaaaattgttcaggaaaaaaatccatgatttattctactctggaggagcatattcaatttaaaacataccgattcgtataaacttattggtaatgaggcgatatactttttatgagaacatatcaaaccatagacattgagatccagcatctcctgagtgagtaaaatgtcagggttttattgatactaatgataatgggagtgacatatgtgcatagagtaagtccatggttgaaagcctggctgattaggcgctgcgttctgtggtttttgccacttgtgtgtgattaaaccctgcagaatagagtctgttgccatgtatttggttcgtgaagaaaactagtaaagtgatattgaatgaatgattcagtttctcaaaagggtagactattggcctaacaccttcctaacttggagctgtcaacgtgtttagtttggttctaatgggagctaggctggagaagagaaaagttttgtgagaaaggttatgtgatattaataagaaccacattccgtttgatgttttctcaaatgattttttttatcttcctaagaaattgaatgattcaaaaataataaatcttccttttctatggcccacaaatgatcaacattttggatgatcaaaacaattttgtctttaagatatcacaacttctagtgcctctttatttgccagtgctgatttacagcagaaagtatcacttcatattttttccaagcatcaaagtcatgtgttttacaaatattcacaagtgcttaaaatccatgaacctctctctgtattcctatttttttattcttctataagtatgtatttaaattggttaaacagatggctttctacttttgaaaaaaaaaaacccactaagaatattcacctcaagatggagaactcataggttaaatttcattctggaatgcacgtttacaaccaggtaattaacctttgaaaatgagggtactcgaaggaaacaaggaaaatcttaacaagatgatctcactaacgctggtgtgttagacttctcagaagtagagatgccccagaagtttaacaatgaaaaactttaaaatatttttaaaaacatagttaatctttgtagctttccagttttcgtcctttattacgataaccttaggaggtaaacgcttcaaggggtgtatccttataatcataggaattggtacacagattttggtggaaagatggaggtgtcaacattaaccagtcaacatatatttgttgactgcctaccacatgcacaagtctcttccatgcttgcgaagagatacagtgatgtgcaatgtgtagaatctgcccttcatgagcttttgatttagttagtctgagaaggaatagatcagtgaaaagttaaaaggaataatagatggagtgttgaggcagtccatgattgttatctgagacattgagtttacaatgctaagttaaaagaatgagagatcactatgggatagaatggacaggaagagttcctctccttgaagcttgcattaagccataaaagacaaagcaattttggaaatgcagaatttggagatatgaagaaagaataattcccagaaagggagaagagttttggagccagacagatctgggttcaaatcttggttctcttgttctctagctgtgtaatcttgggaagttacttagcttttatggacatcttctataaaaaggatatgatagcgactattttgttaattttttaggattaattgagataatatatataaagtgttttaagcacttgataaaaggtaatcctctcagttggagagaacatcctaaacaagtctggaggaaggagacagccagccatgttcatgggacaaaaagaagactattatgagtggagggaaagattaagagaagtagagtgagatcacatggaaagataaattaggattagcttcagccattcacttgtttcttcatttaatactttattgcactctttatgtgggaagctctctcatgtgggaaaccctctgctcggcatggatatgcagagacaaagaaaacttagccttggatttctcttgaatgtcaggttaaggagttggaacttcatgctgaggagaattatatctttcaaaagtggaggagcttgaaagtagcatttttggatagttaacatggaatgtgattcttgtgacccaagatatgcattaagttaccatctcctagtggttgatggttaatgttgtgcctggagatgtgacccagattctcttgtaggtcattcctgacagagggtccattccaatgagtgaggaggaggagcttctgggctgaacttaatctcatctcctgaaataaagcaatgacattgaaatttttcatattgcacttgtgtttacatttctcatctaatctgagatattccacgtttggtgagtcttgctttgggcctgcagtcttggtgacccttattagttgcactggaatagctgtctattcagggagaagtagaatcctgggaatctggtcttcagtgactttctccatgatcatgaatttcatgagaggaggtccccttcctgttagtagatctctatagcaagaggttctgaggcacacaagcacactggatactcacctacagttctagtttaactgatggaacataggtatttctttcatgaaactttgcctggataaacagcttctgtatcttctagtgacaaaattttgcctcctgttttcccctctagctctagtcttaatctctacttccttgttcagtccaaggctcaggagaacccagatcatataagatatggaacctattgcttcctaggatgtccttgtacacagtgactaactgctaatttcaaggatcaatttctttctggagttagaatcatattatattatgtttcagaactgaaataaaattcttttaaggtgattatattttggctctcagcttggaagatgccactggggcatggcatacaagacacataacttataggaggacctcctttaatgcccaagtgccagcttcatgcttgttgttatatatcattttattcctggctttgatgcccacacacagacatatatccacacaaagttcaatctatatattttttgtagctgtttagctcaggtgattagggcattgagctaatgagaacaaggtcacagtttcagtctttgtgtgggccagcaaggtttgctttgttcagaggccacagacctggtccagccagctgtccagcacatgtctgccccaagtcatgagaggacggggcaggagtgtgtggatggacaagagcaaatccatcaccacccttagaaaaagtcaagtcaagcacgtgtcctactaatgggggtcaataatgtctcatttaaatggggctgacattttattacctcttgctgagagggtcttttgagcaccaaatttaaacattgtcgcttttttgtgtgaatttatttctaataaatggaaggttgtacaagaccttagatgattacaggtttccaaatacagattaatgacttcaatatttaagaagttgatgtgatattaaaaaagaaagttcagtatggctattcagttatcttcccttattaaaatctgttttggctaatgaaataaaaagttcataagttcttccgagagtaagtgagaatcattgccttcattcaagaatgaaaacattattattaaactcattgataatgagaccattaaaagttagcatgaagcaggtacaatacaattctttattattgaagtcttcagatattacccagcctacacatcccacctttcatttttaggcaaacaaattccccaaactatattttttttaaatttagcattaggtcttgttaggcttcaaatgggatcaaaaccaatcctttccaaagtgttctaccccagctgtttccctcacctgggtggtagtgagtataaaggcatttgatacagaagggggtggtggggcagagaacagaaaggaaacttggtgagagaatgatgaagaatgatatattagagattcttttaaaattcattcattaaacaaatgtagcataatggaaatgtctattaaattttttggcataggtaatgcacttgcaagggtaaaaacagaaatatgagatggtattttatgaaaagttttgctcaccccgcatccatcatgaacccaattctactgcccttgtatagccatttttattagtttcttgtgtactctttcagaatttctttatgccaatatatcttaaactctttcctttttttcatacaaaaattaacaccctatcaattttgttcctggcagggtgaggtggctcacacctgtaatcctagcactttgggaggcccatgcgggagaattacttgagcccaggagtttgagaccagcctgggcagcttagggaaaccctgtctttataaaaaaataaaaaattagccaagcatggttggtgtgtgcctgtagtctcagataactcaggaggctgaggcaggaggatcacttgcaccagaaggttgaggctgcagtgagccatgattgcaccattgcactgcagtctgggtgacagagaaaaactctgtctcaaaaaaaaggtcttgagcttgctttttctacttaacaatatgttttgtaaatctttctgtatacgcaaagtagcctcatttttcatagttgtatatcattctattgatgtgccacactttatttatctacccccctattgatggaccttcatatagtttctaatattttctattacagacaacaatgtattgaattactttggaatgcattaggtagaaagcattcttctttctttaaacatttgcgtagcattccactgaatggctatatcataacttatttctctagccccctattgatcgtcattgagtttccaatcttttatttttaaagacaatgtcataatgaataactttatacatgtattatcttatatatgtggaattaaatttaccatgtctagataattttatttgaatgcaattaagtatgatatcaaaaattataaaatcaaaactgcagtgagaattcatcttaccccatgtaaaatgactcttatccaaaagagaggtgatcatgaatgctgatgagaatgtggagaaaggggaaccttcatacactgttggtgggaatgtaaattagtacagcactatggagaacagtagagattcctcaaaaaactaaaaatagaactaccatacaatctatcaatcccactgctgggtatatatccaaaagaaaagaaatcagtatattgaagagatatctgcactctcatgtttattacaacactattcacagtagccaagacatggaagcaacctaactgtccatcaacagatgagtgggtaaggaaaatatggtacatatacacagtagaatattattcagtcataaaaaagaataaaatattagttgggcatggtagcatgcacctgtagtcccagcaaccagggaggcctaggtgggaggattgcttcagtccagggaagtcgaggctgcagtgagccctgatcacaccactgcactccagcctgggcaatatagcgagaccctgtctccaaaagaaaaaaaaaaagaatacagaatgaaattctgtcatttgcaacaacatggataaaactggaggacattatgttaggtgaaataagccaggtaccgaacgacatatttcacatgttcccactcatatgtgggagctaaaaattaaaacaattgaactcatggggagagtagcatgatcattaccagaggctgggaagggtagtgggaggaaggaataaagtagggatggtcagtggatacaaaaacacagttagaaggaataagatctagtgttctgtagcacaacagggtgactatagttaacaataacttattgtatattttaaaataacgaaaagagtggaattggaatgtccctggcacaaagaaatgataaatgcttgaggcagtgaacaccctaattatcctaatttgatcgttacacattgtatgccttcatgaaaacatcacatgtgccccataaatgtatactgttatcatgtacccatcataattttaaaaaatagaaaagaattatcacaattattttaaatgaagaagcactaagtaggaaataaggtacaatttaattcagaatagctttccttagtagtgttcaacctactgtacacatcaacaacacgcccttgcagttaacattgttgctggatgtttactgttatgtgtgaccagctgacatgtccctctaaagaaagaggatttaaataagtcatgtatgaaagactgggtaaaggtgagacactgtaagacctagattattttggggctgtagcaatcagattagctattgagtattcattcataaattcattcacttcactgagtcatccacttcttgtcagattctgtatttattcatctcctagtaagctactcattgtgctaaaatgctggtaaacagaagtacaaagcaccagttataactcacagtcttgtagaggaattaagaaatggacaggaaacagtaagggtgcattgtaggtatctcaagaatgatataaagtgttatggcagatctaaggaggaagacatgactttccatagataatggatggtggcatctgttctggagtaccagaaaattagagtaacaaaaacacagcaggatagattttcttacaatgcagtgattcatacaaaggctaccttgactgttagtttgtgactggaaactctcagtcagggctgacggagggagtcctgcccctgccagctgttcacctttccctggtgctggggttgacacttcacatgctcacatagtctggttctgtgctgtctactagggttgagtgtgctgctgggcagagaattttggcatttctccagatgcacatgaggggcagaccgcctcagcagttgctaatgacccaaagaagccttctttcatgacttattttgtcccctcattttattttttgatgtattttggtgagctgagctactaccttctcaggcagtcccaacctcagaaaattaaccatgtagctttctcatatctgacattgcaaattgaggcaaggtcgcatgctttctgactacctgactgcctgggcatttctttcatgcaacttgtttaagccgcccatcctgatccctgttgctaagccaccatggctgcatttggacgcagttcttcccagctttgccgcagcataactgtggaaaggatcttgatgaatttggacctggggagggacgtgggaggaaagagaaatggtctaatggaagaaagtgaacaaacaaagacatgctcacagaaaactgccaagtgtgaggggtgggaaaacagagttcagcctggctgaacgtaggaatctggatgggaatggtagatcttaggctcctgtttttcagcttgccgctctagtgatgattcttgtagatatatttttccaagtaaaaggagcatttccaagtgactgttgtttaaaataaagtacatgttgcatttgtaatgtatgaattatgagtattaaaactgacaatgaaatgagagtaatatacttaattaaaattaattagatctgttggcacaccactagaaggacaaatatgatatttaatatatcactctactccagacctgtccaattaaacttttggccatgatagaaacgttccatatctgttgtccaaaaacagtaacccctagtcacatgtggctattgagaacttgaaatgaggctagtgcaactgaaaactgaattttaactttgtttaatttcagtgaaatttaatttgaatttaaatggccccctgtgagctagtagctaccgtattggacagggaagctctaaacagggttctaaacatgtggaattaacagcacttaagagctggagtagaccttaacctttaccaggtctcaaactttgatttacaaatggggaaatggcagccaagaaggtgaaacaccttgtccagaggcacactagtaggaattagcagaactggaacctggtgtttggatgtcctggctcccggcctgggggactcttgattccaacacgctctctcccagttatgacagagggctgtggctggacccaggtaaggatgctgggttggtagattgagaaaataaggccacgcgtagtctttcaaatcaaccaagcaagagatatttgctgtacatggtggcagacactgagatcaacagagaggttgttgtggtgtgggggagggcctgtaaaatggcataaggagtctactgggaaaaacaggatagtgatagattatatatctctatatttatctttctatataatctaccctgttttcccaaatggatttcccaaatgtgtgtcacttgtatatctggctgtcactggtacaaggtagtccaaatggacagggtacgcaaaccccagacagggctatggaaatttagggagatctgtgtgggtgagtggtcggggagagcttcagggataggacaggcttgacttatattagatagtgtaacacagaaggtaaaatacaactttaggatcattcaaatttaacagtggttgatatgaaacaaacttcttatccagagttggttttgtattcttgctttctgtattaattatatgtgtttactgattcaccacaatcagctatactgtccctagaattttaaaatgtgaaaagaatgtggtttgtttcaggactatttttctgtagaatggtgattgtatagaattaattaatattacagttgcattattagaccacagtaaggtaaatggtcacaaaagaccatacatttaaatcaggagaaaagtaatggctattgttatcctgtaggcatagctgggaaatcatatccttacttggcttgctaaagtcttaacctagtactacatgacagtatctccagagatttttttttcccattcgtaggcacaacaaatgagacccaagtgctcatagaacattccaaagagtcaacagagagaagtggaaagtattagaaacatgattgtgtttgcaaagggagacataaac

SEQ ID NO: 112 - DNA, 5132 bp, Homo sapiens
aaaagagaattttagaccaatatccttgatgaacattgatgcaaaaatcctcaataaaatactggcaaaacgaatccagcagcacatcaaaaagcttatccaccaagatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaataaaacccttctagacattggcttaggcaaagacttcacaatcaagaacccaaaagcaaacacaacaaagataaatagatgggacttaattaaactgaaagccttctgcacatcaaaataaataatcagcagagtaaacagacaacccacagagtgggagaaaatcttcacaaactatgcatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatgcaatgtgctctctcacatgctctttccttctcttaaaaaaatataatatgtacatattatatattatatgcatagacacacgtgtgtctatacatatcctatctatacatattgaggattaacaggtgctagtagaaaatattaactttctttgtattaacaggtgttagtagaaagtagtagtaggtgctaagataaaagccataattaaacctcctggtgaatgaacacaccatcaccaacaatcttaccaaaaatagaaccaagcacgtgtcctagtcaaacctctggattcaactgtcatttggataaaacgcaaaggatagtgaaaatgtcgatcttcactgagagtctcaccagcaaatttcacagtgtggacatcaagtgacaaaaatcccacatttttcaacaaatatattgtatgggaaagaaaactttgaaaagaaacctgtatgttagaagggattttaaaaacacgacaaatgaaaacaaatgcgcaagactaaatcatagtgtcttggaatgcatgcatgaaggacacagccgtgaaaatgcaaggacgcctctactggaacagtcacgtttatcgtcacttttcaggagaaaggtggctgcaactgaggagagtcacatgcaggacttcagggctggcaaagtcctatatcttgacttatgtgatgattacagggatgtttacaaaaatcaaactataagtttgttttgtgccatgttttgtattgtgtgtgtgtgttttgtttttcaacttaaaaatacataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcagaaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacagggtgcttgactggaggagggctggcagcagaagtgcagctgaccgggttgcgttttcgtacggctgactaaagcggataccggtggcgactcatttctcgttttatttttcaacgatttggcggagaagctcctcttgtgaatggactttggatttcttggagctgcgctgcgggtcccacagtgtggctttcggcccgtgctgtgctggcgcctgcacttcctctggcggggcacggggtggcgctccctggtaaagcagcggccagggggagccgtgagtgaggcgctgcctctcccgctgaagcgggttccaaggccaccgtgagggggaccatccatccaggagagtactgggcaggctgcaaatgtctgtgttaaaacagctctgctgggctaagacaggacagaagcagacagcaggtggatgagacacaatttcctatccagcagaacctgcagcaagctccacagcaccctccatgggctcagtcttgctcccgggaagatggttaattccatcagctccttctggccggcagcaggaagagtggccctgtgtgtgccaggccctgcagtctctcctctcagctggtgtctccagtgagggacctgagtcatcgcacacatgagcctgtgctcagcctgcacatctcccgcctcccaccagctgctcctcaactgccagggccagactgtggcaaaatctcactcctctgccgatgctggggtttccctcgtgtctgggaggtggtgtgcttggtggcctgagcactgcagtgaatccatgtttccctcccagcaccctgttctgtcctccaacttggccgacagctctggccagggacgcagcccagctggtgcccaccccgcactctgtccatttcataagagcccttggtttcctcacttccctcagattttgccaagagaatggtcctggtgtggcccagaaaggccagcggggtgcagcctgggactgaaagcagaggcggctctggtggggaaaaagtagctctcccagcctagccctactggtgggcggcacctcctggctccaggccatcttttgtcccagtcctaggtaagaaaaacacaaacaaaagccagtcccatggcactcgagaagcaggaggccgttccctgacagcaacatgctgtgtgcacagacacacgggtggacaggaggcagagctcggggttgctgcggagcgggcaggacactggagcggcaggcagtgcggacccgccgggcagccgtgcacggttgtcgtcctcagcggcaggagccagtttgttgctcagggccttgtctttttacaaagagccccaggccccgggggcttctctgggtgcctctttgctgccatgtctgcacgcgggcggagagcagaccaggctaccgaccctctcgctttgctgtcttcacgtggaaaagccagtgtcgtagccccaaaggaggggaaactgtattgatttggggagcctctatgttgatttcaaaacagattgtctcctgtgttctcaaagactggaagcgaaccccacaaccgccttaggccacaaaagctttatcctttctaattagcatccctgtgacctgctctgcgccctgcagatattttgctcagccagccagaaggagggaggccagacaccagcccccacagacctgcggctgcgaccccctgcctggggacgatggggtcggggtccagtagctgccccagaaacaagtggggctgcaggaggctgatggtgagcttggaggttggcagaattctaaatctgggcactgcagggtccccacaggtcacgaccctactctgctccacccaggctccggaggacctgagcaggaacctctgcagggggggcccggggctccctgtcctctcagcagccggcagtgctccctgacagcccgggcctctccctccagtagttcggtagtttgctgtcaccaacatggctgggcctgggacaggctcctcctctccctccagaagccaggcagtccctcctgcctcagtttctcagactaggccgcctctcccatcgcgagacactgaagaccctcagctgtttccatctgcccagtctgactgctggatcgccctctgtgtgcgttggtttgctgtgttcttgctactcgcccttggataagatttcttctctactcatgaagctgcgtgtcctggagggcagggccgcacctcacatgcatgttgcccacatagctcagcaacagatgctctcacgcttgttaaaagtaaaaccgggccaggcgcagtggctcacgcctgtaatcccagcactttgggaggccgaggtgggtggatcacctgaagtcaggagtttgagactagcctgaccaacatggagaaatcccgtctctactaaaaatacaaaaaattagctgggcgtggtggcacatgcctgtaatcccagctactcggaggcaggagaattgcttgaacccaggaggcggaggttgcggtgagccaagatcacgccatagcaattgcactccggcctgggcaacaagagcaaaactctgtcaaaaag

SEQ ID NO: 113 - DNA, 8445 bp, Homo sapiens
accctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaaggcaggagggccccagcggtgggggcgggggttgcgcgccggggagggcggcctcaggctgggagcctggcagatcgtctgactctccccgagccccatcccaggccgagccaggacccctctgatgcacaggcgtctcaggagcccgtttctttcttgaatccggggcccagtgcggcttgaacctagcccccgacctcctcctcgccctctcagagtccgctggggtgggcgctgaaggagcccgggtcggagaggagccctccccttctctcctgcgtggaagccctgcagcctccgtttcttttgggactggggtccggggccttctgcctgacccggggtgagaaagggagccctgatcaggacccggtgagagggcgctggagcccgggagcggcaggagccttgagcggcagcccgggaagaggatggggtcaccttctgccccaggtcccccactgccaggatctctgtcaccttctgggggtcctgtcccctggggtcccaccccccgggctgcctgtgggtatctctcatctggaactggaaataaccctcttcatagtacggcttagcaaatatttattcgcccatgcaccccccttttttttccttcatagtgttctttttgtcttggatcatttgtgtttttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcattgatgtttgttatctttattattgccttcatcctgtattctttgcacttgatttttctttcttgattcttgagaaaaaagttgaggtgccgggcacgttggcttacgcctgtaatcccaacactttgggatgccaaggtgggtggtcaggagttccagaccagcctggccaacatagtgaaacccccatctatactaaaaatacaaaaattagcagggcgtggtggcagacacctgtaatcccagctactcgggaggctgaggcatgagaatcgcttgaacctgggaggtagaggttgcagtgagccgagatcgccccattgcactccagcctgggcaaccgaacaaaacttcttctcaagaaaaaaaaaagaagttgaggtgattgattttcagtgtttctggactcctgccctgcagagatcctcttgctgtaacctgtttcatgtgaggtagagtttagaaaatatttattggcctctgtgccttacttttcttcatatactcttcttattttgttgatttatctttagggatttttttccttatgttaaattgaaggacttattgttaaaatctgtaagttagccctttattggcttatttttgtcataggttcttgttctctagtttgatttttgttgtttcatttctttgtgttcatagttgtatatagtaatctggttgataatgatcttgtatgcagtagctttgcttaatttatttattaattgtaacactttatgtcatgttaggctgtgctgagtgcttctgggagcagccaggtttccatgaactcccagtttactctaaatactctagcagcccacatgtgcacacactggataatggtcatgcatgtagagcaatgatgctggggaggcaccgactctgtcattctgtgaatccaccgcacaatcacaaacattagcattaaaataaaatggactgttaggcaactgcaaaggactaatgcacctatgtggcacaaatgtgtctttccgtattcaaagtacttgtaagagcttcaagttcctcatactcagccactgacctcagggttcttggtacacaggcatacatgtgcagacacacatacaggcacacatatacacatgaatgcacatatgtgcacacatatttacaggcacatgcagatgtgcacacacagacctgggtgagaaagtcagatgtacatggaacagcccctgctttgtaagctgtctggctttgtagggagaaagaggtgaaacaacacacttgttatcttggaagaggagatgaagggagctgagctggatatgtccagtggggagaaagccaggagccactccaccgaaaatcgaggtctccacatggatgatacccacaaaacattggcaggaaggacacagccagcaccacatcagtggtgactttcatgagtgtcaactgtggccatccaaattaaaggcctggcaatgggataagttagcaactgaactttctgtatgttaccttattaactttctgtatattagcttattaactttctgcaatcaaatgctgattaagcattttctgagccaaaagctttgtgtaatttgaatctagtgaaaaaatgttatgcgtttaacactataacttgagatctaaaaacaaaaaaacaattgcataagaattggtcagataccttgtctttgaaacatactgaagtcttcaaaattaatctgatagctctgcagttggtatgtggcataagaaaatatttggcatgaaggggagtaacacaccacatgaattcattcattatgaagaaattcattatgaatatatgtgggcaaattattaacaaccctcccaaaagcagaaagctcagactcaggaagatccatttaaatggagtgatttgggagatgatttcaagcgcaactctgcattgactcagcatttattaagtcatacagcaggctactggaggcctcactgcagcctgggctggtattcagtgtcctcctccttccttctcagtagacttccttggccttgataataatacgtgttaacaaacacaaatctcaaaatacacataatgtttcttcccccacaagccagggtatcagctctgcaaatcagatgaccccaaggtcagtggggttgaccagggacaccattctgcattcctcctcagcttccagatcctgaggagctctggggccttccttctggacagggaacatgtctgcctggcttcctcagccaggtacgggaggctttggggacctgtgtctgtctctgggaaggaggaaggagcctgtggcatcttccttaagcaaaagcacatccagcccatggccaaacttcagagtggggcgaggggcccagcacagctcctccgttcctgcagcagagcccagaaaacacatctgatgttgtggctgcctcaaacctacaaacaccatgggtttgaagtgtcctgttgacatggccatggccactttccccgtggaccgtggcaagtttttgtttttggtttttgttgtttgtttgagacaaggtctcactttgtggcccaggctagagtgcagtggtgcaaactcggctcattacagcctccacctcctgggctcaagcaatccttccacctcagcctcccaaagtgctagaattccgggcttgagccaccgtgccaggccttgtgtagaagtattatacattatctttaaaatgtagtttagtgctaataatctaaaattgtgttgccatttactattaatatgccctttgtggtgcatctaataaaatgctttgcttcataacctgaaacaaaaaaactttcactatatttacttgatcagatcaacaactatagaagtcttagaataatgatattcttactcaaaagaaaagcaacaactcatctttaatgaaactgtttctgtgttttattagtggttgagaaataacacattccttcagcagtggcagcagtcagataccatatgaattttttatttttttttactttgataaatcctgaggctctgttgaggaagaagcttccacagtaggccctaggagagctgcagccaccatgtccacactgtgttatgcacaaatgggaatgtagtttcccagagaaaacaacttctgtgggtagatttgtgatcgaagtttgtgaatagctttaaaaaatccttatgaaggccaggcacagtggctcacgcctgtaatctcagcactttgggaggctgaggcaggcagatcacctgaggtcagttcgagaccagcttgaccaacatggagaaaccccatctctactaaaaatacaaaaattaaccaggcatagtggcacatgcctggaatcccagctacttgggaggcagaggcaggagaattgcttgaacctgggaggcagaggttgcagtgagctgagatcgcaccattgcacacaagcctgggcaacaacagcgaaactctatcttaaaaaaaaaaaagaaaagaaaagaaaaaaaaaggctgggcatgatgactcatgcctgtaatcccagcactttgggaggctgaagcgagcagatcacctgaggttgggagttcaagaccagcctgatcaatgtggagaaaccccgtctccactaaaaatacaaacaattagttgggcgtcgtggcacatgcctgtaatcccagctactcaggaggctgaggcatgagaatcgcttgaatctggcaggcggaagttgcggtgagccaagatcgcgttactgcgctccagcctgggcaacaaaagtgaaactccatctcaaaaaaaaaaaaaaaaaatcctcaggaagattatttacttataatctcctccttccttaattagcagtctcagcatttctgcaataaccaagtctcagcatccagtgaagcagcctgcaacatgcgggagctcagggcattgccactgcacatggggcacctggtgggactttggcaaggattttgtcattaacactgagcaaaactctacgaagacagaggcattcttttagattaaaaactaacaacataaggcgggacatggtggctcacacttgtaatcccaacacttcgggaggtcaagggggacagatcacttgagctgaggagctcaacaccatcctggacaacatggcgaaacccgtctctactaaaaatacaaaaattagctgagcgtcatggtgcacacctataatcccagctattcaggaggctgaggtgggagaatcgcttgaacccaagagcagaggtagcagtgagctgagattgtgccaccacactccagcctgggcaacagagtgagacgcttacagaaaatctttaatttctatagaaaatcttcagtcttctatagaagaaaattaaatattacaaaattgaagattagaaaattacatagagagccgggcatggtggctcacacctgtattcccagcactttgggaggccagggtgggtggatcacccaaggtcaggcgttcgtgaccagcctggccaacatggtgaagccccgtctctattaaaaatacaaaaaattagccaggtgtagtggcgggtgcctgtaatcccagctactcaggagactgaggcaggagaatcacttgaacccaggatgcggaggttgcagagagcagagattgcgccactgcactccaggctgggtgacaagagctaaactctatctcaaaattagagagaaagagagagagagacagagagaaagaaaagaaaagaaaaagagagaaagaaaagaaaaaagaaaagaatgattgattccatagagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcagacagggaccttgagtggtggggggctgagagtgctgagtgcacctccccgggcagacaagaagaaacttgcaagtgcaggcacaagatgaggaatcacagtgaaacttaccacaacattcagcctctattcaggagatacttcacaacacttgccaggtacttttctaggcactggacataccgcaaataataaagccataaaaaaaaatatgtccctgtggaacttgcaattttgtgcagaagagcaaatagttcactaaagaactaagcacaactggccatgcatggtggctcacacctgtaatcccagcacttagggaggctgaattgggtgaatcatgaggtcagtagatcaagaccatcctggctaccatggtgaaaccccgtctctactaaaaaatacaaaaaaattagctgggcgtggtggcggg

SEQ ID NO: 114 - DNA, 9184 bp, Homo sapiens
ctctctctttgcctactgccatccaggaagacgtgacttgcttcttcttgccttccactatgattgtgggaaggcctccccagtcatgtggaactgtaagtccattaaacctctttttcttcccagtctcaggtatgtctttatcagcagcatgaaaatggactaatacagtaaattggtaccagtagaggggggtgctgctggaaagatacctgaaaatgtggaagcaactttggaactgggtaacaggcagagattggaacagtttggagggttcagaagaagacaggaatatgtggaaaagtttggaacttcctagaggcttgttgaatggctttgctcaaaatgctgatagtgatatggacaataaagtccagactgaggtggtttcagatggaaatgaggaacttgttggaaactggagcaaaggtgactctcattatgttttagcaaagagactggtggcattttgcccctgctctagagacttgtggaactttgaacttgagagagatgatttagggaatctggtggaagaaatttctaagcagtaaagcattcaaaaggtgacttgggtgctgttaaaggcattcaggtttataagggaagcagagcataaaagtttggaaaatttgcagcctgacaatgtgatagaaaacaaaatcccatttttctgagaagaaattcaagctggttgcagaaatttgcataagtaatgagaagtcgaatgttaatcctcaagacaatggggaaaatgtcctcagggcatgtcagagttcttcacagcagcccctcccatcacaggcccagaggcctaggaggaaaaagtggttttgttggctgggtccagggtccccatgctgtgtgcagcctagggacttggtgccctgcatcccagctgcttcagccatggctgaaaggggcgaatgtagaacgtgggttgtggcttcagagggtgcaagccttggcagcttccacatggtattaagcctgccagtccacagaagtcaggaattagagtttggaaacctctgcctagatttcaaaggatgtatggaaatgcctggatgtccaggcaaaagtttgcagcaggggcagggatctcatggagaccctctgctagagcagtgcagaagggaaatctggggtcagagctcccacacagagtccctgctggcgcactgcctagtggagtgggcactgtgagcagagggccactatcttccagaccccagaatggtagatccactgacagcttgcaccatgtgactggaaaagccacagactatcaacgccagcctgtgaaagcagctgggagagaggctgtaccctgcaaaaccacaggggcggagctacccaagaccatgggaacccatctcttgcatcagtgtgacctggaaatgagacacagactcaaaggagatcattttggagaattaagatttgagtgaccagctggatttcaggtttgcatggggcctgtagcccctttgtttgggccaatttctcccagttggaatatctgtatttaaccaatacctgtaccctcattgtatctaggaagtaactaagttgcttttggttctacaggctcataggtggaagggacttgccttgtcttgagtgagacattggactgtcgactcttaagttaatgctgacatgagttaagactttgggagactgttgggaaggcatgattggttttgaaatgtgaggacatgagatttggaggggacaggggtggaattatatggtttggctgtgtcctcacccaaatctcatcttgaattcccacatgttgtgggagtgacccagtgggaggtaattgaatcatgggactgggtctttcccgtgctgttcttgtgatagtgaataagtctcatgagatctgacagttttaaaaatgggagtttcccctgcacaagctctctcttctctttgcctgctgccatccatgtaagatgggacttgctcttccttgccttccaccatgattgtgagtcctgcccagccatgtggatccatgaatccatcaaacctctttttcttcccagtcttgggtatgtctttatcagcagcatgaaaactactattatttacctatttttcagactcaaagtctaaaatgtaaagatattcttgaaaatttgccatccattattgcaagacttttaatttctttcctgccactacttaactgtagaaacttgagaaaattacatgacatttctataggtctcagtctctcaactgtgccatgaaagagttggcttagattacctctaggcctccttgagattaaagatggttttgcattattaaaaacattatataaatcaaatgattttttttttttttgaaatgaagtctctctcttgtcgcccagtctggaatgcagtggcacgatcttggtttaatgccagctccatttcctgggttcaagcaattctcctgcctcagcctcccgagtagctgggattacaggagcctgtgttgtaaactctttatttaagtagaattgccccctctatttttaaatcaaattgtcatttttaaaaaatctatgtggtttgctttaaacatgatatacgttttcttacatagataaaggtagatttcagatgttgggaaaaatgtgtgtggcagacactattagctgctctccttctgtctgtccatttcctctcaatctcattaatagaaactaatttagttcagcatggccatgtgcccagctgaaaattatagcttcatcatcacacatcagaaagatgagcatgtggcacagtcctggccagtgaaatataaagtgacagcttctgggaagtgattgctttcctgatttcaataccaccccttcctccctgcccactgttccttcttcctccctggacaaatggtttaggggaccggctgccatcttgtaacaaagcagacaaaagctacacgcaaaggatggcagagcagaaagaagaccttgatggtatcactgacagtctggagagtctacttctagatttttctgtcatgattgaataaactgccatattttctgtcaccagtaggggttttgttaccaatatgttcataactgattcagcaggtattgattttagtccacaacagtagagtgagataaaagcacatttccctttttgttctcaatcaaatttaatcttcctgactgtccacatatttggttggtgggacattcatcctctgtcattcctgtgcttttctgtcttctcaagatttctagatttgggggtgggggaggttgcttaaaaacacaataatggagaaaatgccagatatttggttcacagtggctgcactcactcaacatttatttatgaattttccaggggcagtataaagaatgggaatacacaatgaaaatacctttagctccaagtgtgtggtcaaggcttgttcctctggctttggttgggctgcagacaaactcagacacgacccaccagggccatcagctccatcaactacaaacctacccctggaattctaggcccccgggttcctaaccagagtcccaggttcaggcaccctgtagtctcccatctgggtaccacttggtctctcctactggtggaaacctgcaaaatcccatccctactcttggtcttaggactcttaactttccctggggtccaggagcgcctgctttatctactttgaacagtccctgcaactcctccctttacgaagggatctgtcttacttttcaagatcacagccagtacttttattctatctcagttatacagatgagaaaactgaggcacagagaccaagggtaaagtcacccagctagtaagtagcagagacaggatttgggtgcagatgtcttggctccagacccagttgctaaccactgtattgtgctactctcttcctgcaacacaaaagctccttactttctgcttgggtatgggtaaacacatcgcaacttataaaaatacagtgctgacctttttctgggtgagacgtgggaaggggtgttaactcccagttggtactttccttgataactcactctgttttgtatccaattaagaaaaatacgttgcttttaaacaatgcactaacttaagcttcctatgtctcagttttctcatattaaattgggaatagacatttctatgatgacttttcctctgtattttacctcatcaagattcagtgataggaaaaatagggtattaactaagaaggtttttgaaatcttcaggtaaaaaaaatgtggtattttaacaagaaaattgatacaacagcagatactacaactggtaaaatgaattttaactttggtgtccctagatgctccctattcagttcttagtaaatatatttcaatctagaagaaaattgggaccctgccaactagtattaatgcttgcttgcctattaattgaagcacacttttggaaaatgttgtatgtatctggggaaatataatgcattcagcataagaataaatcttttttttgagagagctagacctagagattttcctcacttttcagtcatgccacaatctttctggtttatcagcaactttttctctgctaagcagtgatggtaatgcatacatttgcctttttcagtaaatcatccttttataatttggctttctttcaatcttagattcccatcagaagggttttacctcaaggcatattgcaaccaatttcccccataattaatgccatatctgcctcagagtccatttcaattcccaaatgaaaattgatgaggcagccaaccacaaataaggatcacatagcactgattaaactatcagactagtttccaggctatcatgttacagtgctgaatcataagcagagggtgagttttctggtcttttgcaatgtatattgctcatagtaagtgtccataaatggctcttagcagatgaagagaagcattttatatggcccctatcaaattctaccagaaagactaatgattaaagaggtttgtgttacaggaaccaagacttcatagcacatgaaagaaaattgtatctagacttgataaaaatgagccacaaactgctacaaaaatcaccaggacaagaaaaactcacttaggtgtttttatcccatccacatggagtgtgaatggttaagtcaggtgctgtgtgaagaatggaaacatgcaacaataaagacaccagtcctggtggacctgatggcctatgtctggtgtggcgggggacagataagtaaacagatcgtcctatacggggtagccaacgctatcatctgatagaagtaagcatgaggtaccagtcaagtatgcaagtatctgtgcatgagatgctagtcaagtatttgtgtgtgcatgtttgaaggcttcctggaagagatcactgaaactctaagagtaggtagccaggttaagaatgggggcagagcaggatatctgaggcagtggaagcaatttgagcaatgtgtggagtggagagagaacctgacttgtttgataagcttggaaggttaagcatagctagaacagggtattggaagagttttatagaggaaaagatgactagaggtaggctgccagatgttctctcccaaaatatttgaccatcagtgtagcagggcagatattagtgtgattatgaaaacatatatgtgtgtgtgtatatacatatgtatgtatatttaaatgcattacatatttcaatcagtgatatgtgtttttctaggtatctttttggcatatttttaagaaacacatttcgaaaattaaatgtaggtgtgaacccttcgccacacccaaagaaccattcttgacactcatgcagaacattttatgccccagtttgaatatctgactttggtttatctcactgatacctgtagcccctccaaagtagtggtagacagagctgagacaagaaatttcacagctttttcctattgtggaacaaacaatctgagtttaaaacatattgacttactgaattaaagtaagtcactccacctcttaaagactcagtcacacatccaattttccaggggcctgtggccactgagtgtcacagagtgtggaaggctgtaggggccagtccagaggagagaccacatggcctgattgcccagtagaaattgatattcacaaaagaatgctggctcaaaaaaataaattgaaaaaaaaaaaaaaaccccagcaacacagtgaacaggtggcttagtatggctggccgtgcttgcactttttaatgacctgatttgtttccaaaatttgttttaggtaatgtattagtctgttctcatgctgctgtaaagaactacccaagactgggtaatttataaagaaaagaggtttgattgactcacagttccacaggctgtacaggaggcatggcttgggaagcctcgagaaatttacaatcatggcggaaggcaaaggggaagccagcatgtctcacatggcaggagcaggaggaatagagagcaggaggaggtgctacacatttcaaaaagccagatctcatgagaactcactcactatcatgagaacagcaagggggaagtccgcccccatgatccagtcacctcccaccagacccctcctccaacactgggattacaatttgacatgtgatttgggtggggacacagggtcaaaccatatcaggtaacaaaactccagtctcaaaaatggtaagtcaattttattgctattataattcttaaaactggtgttgatgatgatgatgatagcagttatttgtacagtaacatgcccaagacaaatcccaagagaggaacataaacaaaatcaagtggggagatttgactttgcccaagttcttctcaactagaaatttctaaaggtgttttgtgtggagtgctgcgctatgtgcagttttcagctattcaacctcaaggatgtcaaattgttggaagagattcaaagaaggataatcaaacttggatggagctgacttaaagaaatgggctaacctccagaaagaatgccattgaatccagagagaggtgccgttgaatcagcccttgctgatgaagcctcttcactgtactgctcagacctctccatcctggtggcaagggcttagaccattattcatggtctgactggcctcgaggtggctgtctcgcctttgaaaaagggcagacacagagcatgttcagagcacggagccatactgtgcgatttcttcaaagagagcttaaccacagaatttggattaatgaatgacgtaactgcttcagggcaacacaccctcactgcagctgcttagcccaggaagcagcaaggtcaatacaaggagagccacaggcctggggagatgcatgccttccttcctggccacgtggatctcactacttagcccagatggcctgcgagaaggacaaagccaagcacttcacaacactgtcagttgctgtcctgaagaaggtggccaggagctctagaaggattcaaagccccagggatttttggtttttatgtatacacttctctttacatacttgttcctcaacatccaatcagccttgcaggtttgtccccgctcctagcattcagaaacactcaagagcagggtgggtcagagctctccaccacatacgcagcagagtgaaagaagctgccctgcaggacagctccaggctcatggccacccctcctcacatgcatacctcctcctcttccaccaaacaacaacaaactccttcatgtagcattcacgccctcctcttgtggcctctacctgccatcccacaccaatccctttttatgtccccacaggtacccaggagtctcccctaactaaattccccactgcttctccaaatcaccccaatcctacttcccactgaaactaacaagaagggaaggaaggtgttaacaaatgaagtcttcgaaggaagtcaccccaagaatctgggcctactagtcattccctaaggctcagctcttggcatttgcttcgttccctgggccattattttcatactgtgaagaaatttcaccctagtcccattttggagagcaagtgttggtacagtgctgggtaaagaccctgacaccaggtcctggtccctggcccagagcaggggatatgaagggaagccccactcactgtgtgctccctcactgactcctcaaaggaattccaggaagggtgctttagtgaccctttggctcacagagttagagtgacctgcccaaggccacccagagaatgaatggtgggactgagatcacacctgggcctgcctggctgccaagccttttgctattttcattattccacatttctttccaaggatacagaaagcagggataggaagtgctgtggaaacaagcaaaaagccttatccatagtcagcatccaaaaagtactataccttctctgacccctgctttatttatttgtttattttcagggatgatgtaatagccagaaaaataagtgaacagaagattccgggttctactttatgccaatttttcttaaatatctcagtcactagaaaaagatctatttgaaaatcttgctctgagcagtttctgtcttgggcccagttgtttgaggagcctgttgaatttttaaatttattagtgttcccatgcttcattcattggcatatatgtatattctctatactttataattacaagtaagctcttgataataaaaagtaactgtcattctgtgaagctctttaatgcagccaaagataatttcagggggcaattggcagtctaagtccttgctttctctcattttaaaggagaaccaaatcaacttagagtgaatttgttcaaatgtgggtaagatttaacaggcacttcagctgcccagggtacttttccatgtctctccaaccaaccccacccaaatagcttaggattggcattttctgatgagcacagggatagagaatgagaacggagtcaggtcctcaggtattcaaggttagaattccttcttaaccttgcccactatgccctatgtggggacatgctacagcagagatcacttgagaattatcctgtggctcacactgccataattagttatctgttcggcacctctcaactaatcagaacaatggcacatccaaaagtaaaaggagaagaaaggagacaagaatacagcgactgaataataaaa

SEQ ID NO: 115 - DNA, 2012 bp, Homo sapiens
gtacacaagaagaaatgaaaagaagtctgctaggaatccttgcagactaaaaggagatacatgagagagactttctttctgtctctggacattgtcatctgtctggagtacctagaactgcagcagtcttcatagaatcatgagagtaagcttttgtgttttagataaagtggcagatctgatttgttgatagcaattccctggagtgttgcattgagaagattctgaggccttggtctactatctgtgactgccatggaatcctgagtggagcgaaattaagttcccagacttgttataccctcctgacttgttctccccttccttgggaagggcatctgttccaggcaggtaacacctgtcatcctggctggtctagctgtgttctcgtcacccatgccggcacagtaccttacacgtaagaagagctcagaaattctttgctgaattcattcattttgaggcataaaatccaatcttcctgaagataagtcctttccactgaactggtggggtgtggggaaaggggttgctggtacttcatctggggaccccgaagggaccaggatatgagttggctagaaaaggggcaggtaagtatggggctttcccacccacagtagtcctgcttcatgttcttctttcacaattatttgacagggcaccccatgaaatcaagtggctaagtcagatttaggaagtggttttgaaattgatgggtgcagggaagtacccttgagtcaaaatcagaagaaatgggggaatgccgaagaaacactcagagttaatgagatgaatccccctacatgagcattgtgggatgtctgcccaacccacacagccaagatatgctccttcaggtgtgtcctgcccaccgaccacagctgactgaaccacagaatttccttttaccccgggctgctcccctttttgtgttcagcccagcagtctgccttcattccctcaaggaagagctgacataaaagaaagcaaaggggtggcaaaaaaaagaagttaatgattaaccttgagcttcaagagcttaagcataggcaaataggaaggcttcgtgcacatacaacatatttgagagaatatgagtggagtaaagatctctgccaaatgtaaacatgagcatcgccgctctgtgtaagactcttcagtgactcccccttgccttccagataaagtccatgtttcttaacatggttccaaggccttgcttgatccagtgactatgcatccattacaggctgaattgtgtcccataaaattcatacattgaagccccagcctccagtaattcagaacatgactgtatttgtagatagagtctttaacgaggtaattaagttaaaatgaggtcatgtgtgggggcccttaattcaatatgcctgacgtctttatacaaaaaggagataaggacacagacacgaacagagggaagcccatgtgaaggcaaagaggaaaatggccattaccacccaaggagagaggcctcaggagaaaccaacccagctaacacctggatctcaaacttcctgcctccagaatgatgagaacatacatttctgttgttttaaccacccagtcggtgatactttgctctggcagccctagcatctctctccttcacctccctaaaccgccctccccaggttatgacactctagctgtgtgctcaatgccctctccactccaggctggccccactctcacctgggcatctacattgctcccaccactcttcatccagctaactccttcctccatgaagccatccctgacctttaagtatctcctaagatacccgcttccttcccctctcagagccccatgttacgactacccatttactctgtgtcaataccacactgtgtgctacattagaacaggggccatatgtatcttgctcacatctgtgcctagaacagtgtctggtacctacaagtgctcaataaattcttttggatgactggcaattaatgaaaataaatcaaataattcaaagc

SEQ ID NO: 116 - DNA, 7000 bp, Homo sapiens
agtctctctccgttccttcttctccttccctttcctgacacatcccagcgtccagccagcaaacccttgagtccaggctcggggctcaccgggtgcgggagggagtgggagtgagacccgctgcctcctggggtgctcctctaggggcgtagggggactgggtgggagaggatcactttcagtggaaggaggagaccagtgattgcatcccaactctcccaagtgctccctgcctagaccacctctctccgggtctgggatgcaagaaggtctggagctggccgttactaactttctgttgtcaagacccaggggtacgtgcgaaggatagagaagagcccccgattaaccgctgtgtggccaggaagagggactgggagtgggggtgggtgcccagagcttgcacagatccccatgtcaagcggacacccgcctggctcttcagtaaaagagtgaagaaaggccgagcacagcgcgaaggaaacctgaggtctccggcaaggcaggagaggagaccaagtgactccccgaaacccaccctccagcccttcgagaggcccagagtccagccggagcaagcgtaacgctacagtccctggcgcgcatccctgcagaccccagctcgccccggggtcccgccgccgccgccgccaccgcctgcgactgcgagggtcctggcccgagggtgcaccagcacctccttccactaccggccctttatctgacaaaagagccggagcccatgactctccgactgtgagcagtgtggcctttccaagcctccagaactttctcattacaacttttccggggtcgcactactccctgggccgcgcgggctcgggcacgaggacctggccagggcgcagcgccggcacgaaggcgcgcgccgcagaactgtttcctcagccgcgtgccggggaactaactgtttcctcagccgcgtccagcctcgcagcactgctcttctgcttgctactccagcgaagggacatgcctgctggccaggacgcttagtgggcctcgtaacctggcgagtgtgtgcccgcgcgtgtccaccctgcccccggccggtgcgccccgcgcgcccaaacccggccggcgaccactgcgcgccgggcgcttccaaactgctcctgtccagaggcatccctctttcggctttctccatcccgcgtccgcttccgcacccgagagcgacaagcaaaaaagattcagtgcaactcaaggactggccatttgcagccccacctgcgagagcgaattcggggaactgcgcctgggcaacctctttccctttctgctgggtgccctcccctcccccatctccccgtctggctggagttggccggactcggggagcctcggtgcccgcagactcgcttacctcgcatggtgtggccgctctcccgctccgcgtagtcatgaagctgctcccagcccgaaccccggagagcccaaaaatcccgctcagcacgagtgaagaaggtggtcggcgaagagctgctctgccgagaaaaccatccctttaggcggacgccgtggctgcagggtgacgtttgccgccgccgccgctatgttaacagttttgatgttggtggtgactgttttgatgattgtttgtttgtttgtttgttttcaggaagggtgaaaaaaaaatgttctggctgtctggtgcctgggttttgttttggttttgtttttctttttctttctctccaatgtgcttgctttttaaaaaatgccaccgcctccggctcagaagatttcttttgtgatcacttggactgaggaggaggaggaagggcagcagcaggaggaggagttggtggtggttttgttagttacaaagaagagggagaaggaacaagggggaaaaaaggaaacagaaagaaaagaaagaaaggcggtgtggatggcagagcatgtgcgttttcacatgacatctgtgcctgttagcggatccacaatgtgaattttcactgttcagttacagggaggaagggagcagcgagagagaaagagaggggagagatggagagagagcgctgagaggggcttatacgcgagggcgggcttggccgcgacttccaggccccgcctgctgtcagcgcagccgccaatcagagcccagcagcgcctggagaggctgggaccgcggggaggggacgtggtggaggcggggggtggggcgggggctggggaccagggagtccgaggtggccggggctgcgacggggaattcgagactgtccgaactgggcagagaagaagggccgaccgggagagtcgggcagatccgcaggtgacaggcacttccgactccagcagagaaggggacactgatcacggaaaaccttcggaggcaagagacgcggggctccccgggtttcacgttcggtccctgtctcgcaacccccgcgggcccggcagagttagttttgaatttatggcagcgctttgccgagcgctatttgggtaaacttcggtctccggcgggggtttccgtgggcaggtggtttgggtgttggtggtagaataatgcaaacccactttcatcacttttagcacaactaaaatgcagtcccatggaagtagctgtccccttcctttaaaaacgtccgtcagatgctccctgaccctcttctaaaaaaaaaaaaaaaagaaagaaagaaagaaaaaaacgtgtatatgttcttttgtctgggaaattgatttttattagcatttggagactcccctggcgatggactacaggactgaaggagaacagctcaaattggcggtgtagccaccttactaattcaagagaaatggctgttgctagaaggtgtgattgcagggtgctctttagaaaggttttagaaggaagacattgttaactttagttagaggcgattggtaactgaacatagataaacttacttgtattccttaggtgaaaattgtcatctatgaccatttatttgtattttgataaaaatctaatacatatatccaaactgttcctttgcaagtttttccaactcagttgacaaaataagcatatagatgattacatctacttccttcccaatagtagggaacttcttaaatacttgagttaattgaacaccctaaaagattgggaggtgaaaatatttgcctcattcactcagtcttgaggctgggagatgtctactcattagcatacctgttggcacagcaggcctcatcatcatttaagtatccaaataatttgatttttgactggtatttattcatgatatgtcatgtaacacaaagtacaatgtagaattggcagttatttagttaattaggtcgctctacactgccaagtagttttttccttcctgattaaatgaaaaatgaattatctgctgaattttcaccagtattaaattgacgtagccctgctatatgccatcccatttgcaaaccaatgtgtaatttaggaaaattttagtattaagagtgaaagttgattgagtcattaattaaatgaaatgaacaaaaggaagttactgtttagaatagttattcctttataaatatctttctcctagatttgtaattgacacagtagttaatcttttaagataatatttaaggctccctggttttatcatttttaatcaagtaaaatatattcatcataactatgttaaagctgtacaaagttatgcctaatttagttgcttcattaaaaattactgaatataaaatagtcaagaaacaaattgtgactatatcattttaattttgttgcttcaagcagagacacaagaatattgaaaattccaaaggctttgtaaacattgtctaattattattgttgttgttatcattttagatttctatttctctttagagtgaacaggaatttcaaaatccaaaaatttaaacatttatgtaattttaactttctaaacatttattgaattctgaatttttttttaatgctgcaatatctgtaatccttgaaaaaggtagtcaacacgtgtataaaaagtatttacccccccatacatttttatattctctttattttgtggtttcagcaaggcataattttgcttagaacatatttcttaattccttctgagtatttttggagaaattattaattagaagactatattatttcatttttcaaaactatgtatataatctctatatatggtgatacaaaagtatgtattttctctttaaatgctaatcattggttataatgtggcggcctgggacattttggatctttctaaaaatttaaaaactggtttgttgaatatttctaataattttcacatttatttcactgaatggagcccatttatttaaaataaatattaagaatttgaatgaaagaagtcagtattttctaagaactcacaaagcacatatatataatctgatggttttgtaacctatctgccagcaaataatcatatttcaagtggcataataataatacattactgtaatgtcctagctcatatgaagtacggtatcagtaattttatttgaatgattatgtctggtttcctataagcttgaaactctgcttttcactctgggcctgaaggattttctaagttgacagttgcatgttgattaatttaaatgacaatcagtcacatagcactgtcctcaatctcaagaattgacatcagattccacttaggcttgcctgcttacctgtttttctgacacattagcacccctcaggttgagctgtaccacagaataggaatgacaacaaatatcctgaaagaggcaaagttttaatataagccaaccaggtagggtgaccatggcatttaggattatttcaatcctaaaaggcttaaacaggaagtcatagttcatgttattctgagctgataagtcagaatattcactggtcagggaatattttaaataattaagactcttgaatggacattagcaatactgataacaatgttacttttaggaatgactgaaagattggttatgtttaactctatttagggagctgtgtggctgtgaaaattgggaaagagatataaagctgctattaaatattagaaaagccagaaaaatgtaagaacttttaacattcaaaccttttacaagtgggaagggaagtactgagttccctgttgctgaaggcatccaaaaaagggttgaatgaaaggttctgttagagatgctctagtatacagatttctatactagggtagaaattgtctagattacctccaagatcctctgtagctctaagtgtacagttggcctttatgtccatgggttccacaactgtggattcaaccaagagcagagcaaaaataaattgtgtctgtactgaacatgtacagatatttttcttgtcattgttccctaaacaatacagtataataattatttatatagtgttgacattggcattataagtaatctagagatgatgcaaagtatataggaagatgtgcataggttacatgcaaatactacacaccattttatagcagaaacttgaatatctgtgggttttggtatcggtgggaggtcctggaaccaatcccccgtgcataccaagggatgcctgcattcacatggactaaaggttgctaccactgccccagcaggcatcagagccacatttcctacctgagaatgcaaaattcatgacaacaggagccaggatttccctagagtttgtaagagctcctggtactttatgggtgcttgatcattattggtggagtgaatgctttctaacctttcagccactgaatatgaatcacaaatggagtgaagacctgaataagatccttctttctcagtttctattgaatgggaagaggagagtggggagaatctgcattttaaactctcctaatttggggaagcaaaaaataatggttgagattggttatatagtcataaaaggaagctaaaatttagttattttcatatttattactattcttaattaatttatttattctttgaaaggaagtctcgctggaggctggagtgcagtggcacagtctcagctcactgcagcctctacctcttgggttcaagtgattctcctgcctcagcctcctgagtagctgggattacaggtgaccaccaccatgcttggctaatttttgtattttagtagagacggggtttcaccatgttggccacactgttctcaaactcctgacctcaagtgatctgcctgcctcagcctccgaaagtgctgagatgacagacgtgagccaccacacccagccctattctcaattttattcccaggtactgagtcttcttcataatctttgagttctttaagttctgcttcattttaaagtgtagatgcaagttcaataagttttcaaaataaaaaaaagaaagcaaatattaaaatagagcatgtaattttgaaataaattggaaaaggtgataagggccaaagcatgaattaaccccagtatgtgggagaggtaaggctagctttggaacaaagacaaaacatacaggtcagaaaaaacaagagccaacatttattggatgaatcacatgatttctcaacctatctaatttctatttcttacaagagtctacatgttatacattatatctcttcctcctccccatcttttaaaaaattattttatggctaaaagaacagaggcttaaaaaagttaactcacctaagatcacaaatcgtaaaatgctggatccaagattcaaacccaggtgtagccactaaaacgtgtttcgtgagtgcaggaactttcttcattttattttattttttcagtgctcaatccacagaatctagagtctcttgcctgataaatagtagatgtttaaaatacacttgtgaataaataaatggacatttaaaccctcgtccaccacacagtattacatatgtacattctcatcactaaatgacattaaataaagaagagtgaattttgactttaaaaataaaaggacattgtgaaaaatttatgaa

SEQ ID NO: 117 - DNA, 1254 bp, Homo sapiens
gccttcgccagtgtgggagcctcgtctcactggagagtccgttcaggctctgtcactatttcccattggccaaacgctactggaagtggaaggctaagaagcccgatggtgcaatccatacacgtcagcctctggggccagagtgggatgaaaaaaggctcatgatggagcccgagttatatggcaggagatgatttccacggtctgtgaacactgaagatgagactggcttggggccacgtgccaaactgcacagccagtaagacctgcttccatcgacccacagcagctctgactttttttttttaacaatagagaagaaactaccacagggaagagagagaacaatggcattttgacaaatggaacaaagatagagtgtgactgacaattcaggtcagaaggaaaattaaagcacaggaagactgatgttggtcggcctccttgccaagaagcaaaaactcagggggaggcatccagccacatgcgaactggctcaacactggccattttgtttgagcaattttgttggatgttttctacaaaagagcactttttctcggacttcaaacattcttatatgcaggatcgacaccacacactgccatcatcccctggagtagtatccttgagacctgaggaggggaaaactggagggacgttgtgggactccattgagaaatgtggtcctttgtctccctggagatctttgaggacggttcagataaagttgctgccagtggaagcagctaggctcagaaacctccagttgccctttctagacttgtaatcctctgaaaaatggaaattaggaagcgttcatttatgaccttgaaaaaaatcgtttacaaaagtatattatatcactaaaatgagctggaaaaagggtttatgtgaaagttcatgtgagaaacacagctattagcacgcatgccattccccaccttgacctcagcaggaatgtgtaaattgtaacatatggaatgtaagccctgtcgagatgtttcataaatctgcctggcaatgagcatcacaaggccctgcatgagaacaggccccagaaatggagagacaaataaagaaacatcagaaatattaaaatgaggaccaaaaggagtcccagagatggggtttcaccgtgttagccaggatagtctcaatctcctgacctcatgatccgcctgccttggcctcccaaagtgctgggattacaggtgtgagccaccatgcccagccaaattttcaaataaataa

SEQ ID NO: 118 - DNA, 5435 bp, Homo sapiens
atcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtactttttgttgttgttgttttgttttttttttttttttttgagatggagtctcactctgtcacccaggctggagtgcaagggtacaatctcagctcactgcaggctccacctaccgggttcaagtgatcctcctgcctcagcctcccaagtagctggcgctcaccactactggtgcccaccacaatgcccggctaatttttgtacttttagtagaaacagggtttctgttggccaggttggtctcgaactcctgacctcatgtgatgcgcctgccttggcctcccaaagtgctgggattacaggcgtgagccaccgtacccagcctagcattaggtactttgttttgttttgttttgtttttgttttttttgagatggagttttgctcttgttgcccaggctggagtgccatggcaacacagcctccacttcctgtgttcaagcaattctcctgcctcagcctcctgagtagctgggattacaggcgtctgccaccacgcttagctgattttttgtatttttagtggagatggggtttcgccatgcttgccaggctggtctcgaactcctgacctcaggtgatctgcctgccttggccttccaaagtgctgggattacaggcgtgagccgctgcgcccagcgcactaaatactattaaaaggaattaagcaaaatgctacgtaccaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctct

SEQ ID NO: 119 - DNA, 11132 bp, Homo sapiens
cccctcaccgtggccttggccgtgagcaccaacgcctcctggttgatgctggacacctcgggggagctcttcatgatgacccggatgcgggatagaggcagcgagatgagccgctgctccccgcccttgtctttacccacgaccacgtccgccatcttcccgcccgtcgcgcgggtgcccgcagccggcgggcccgaccgcgaagtggctgccctgcccggccagctggtgggtacggggagccgcgcccgctgccccgtgggagttgtagtgtggggaggcgaggccgcgaggccgggagcggcccgtccgggaaactacgagctccgtgaggcctcgcgcccccgatctgcgcatgcgccgacgctcggacaccgcccccgagtgcgaggcccggcgcggaaccggcagccgagagcctggcgggggcggggcgcaccgcgccgctcccgggagtctccgggctgcggtcgcggaatacgactttgatccgcgggtgagggctctgtgaatgggcaagcaaagccctctgactccgggcctcgtggctgggtgctgtgtgttaagcgcctgcgctgtactaggaccgggcgtgccgccgtcggcaaaaagtgacgctttcttgaagcacaaagtccaggggggacgaccaagcggacagcggatgcgtcctgcgccggtagccaggcgaccggtggaagagcagagtccagcgcgggcgatgcggcggggccaggcttgctgcgccgcggggtgattgggagaagagccttcctgcggggtggaggacgaagagctgccctgaggaggtcccggagtctggtgggaacggcctcttcgggactgctccgagagacggtgtgcagagcctggcgtgctcgccgaggtctgacaggcagcccggggctaggtcctgttggatttttttttctaaggaaaatgggaagtggtggtagggtttgagcagtggagtcccgggcagttttaaaaggatccctgcagctgccggctgggagggcgtgggtgcgcgtaaggccggaatcacagagaccaggtagaagatgattacgagaacccaggaacgtggccctcaggaggccggcagtaccaaggggacagcagctgggaggagagaggcaggagatggtcaggggccagaccagggaaggccgcggagaccgcagaattcgctctgaatgagtggggaggcccttggaagagtaaggggtccaacttaacttttttttttttttttttttttgacacagagtctcgctctgtcgccaggctggagtgcagtgcgatctcggctcactgcaacctccaacaccccgattcaagcaattctcctgcctcagcctcctgagtagctgggattataggcacgcgccacccagctaattttttgtatttttagtagagacgggttttcaccatgttggccaggatggtctcgatctcctgacctcgtgatccgcccgcctcggcctaccagagtgctgcgattacaggcgtaagccaccgcgcctggccaccaacttaacttctgccaggatcatgggaagtggtagggtttggggtctgatttcaagagggagctgctgtggagtatcagcacagcttactgagatatcagaaaggccttggtaaagagccctttactgagacagggagcacattttggcagaggtttgaattggagcgtgttaagtgtagtgtcttcttcaccactgtgacgtgaggtcctggcgcaaataattgagcacagaaatacatgtcaggcattgctaggcacaagggtacagccagtgagcagggctgccatggtccctgccctcttagagctgaccttcaggtctgagggagactgaaaaataagtaagaatacctccagccgggcgctttggctcacgcctgtaatcccagcactttgggaggccaaggtgggtggatcacctgaggtcaagagttcgagaccagcccaaccaatatagtcaaaccccatctctactgaaattattaaaattagctgggcgtggtggtgggcacctgtaatgccagctactcgggaggctgaggcaggagaatcgctggaacccaggaggcagaggttacagtgatccgggatcgcgccactgcactccagcagcctgggcgacagagggagactccatctcaaaaaaaaaaaaaaaaaaaaaatacacctccaatgctgaaagctacgaaggaaacaaaaccatgtgcgagtgatagggcagcccctctgggaagtgacatttgtgcccagatctgaagaaagaaaaggagccactcatacagaaagactgagacaagatgagctttcgggacaagtcaggctctagggagaacacctgacgaggaaaatgcctgggcagtttgaggaactgaaaagccagtgtgtctggagcttagtgagggaggcagagagcacgggaggtgtggttaccaaggtaggtgggaccggctctggccctgggtaaaaagtttgactttcattccaagagtaatggaaaataatgaagaattttgaactcgaggtggtgcatgcctgtaatcccagcactttgggaggccgagggggggcagatctcctgaggtcaggagttcgagaccagcctgaccaacatggcgaaaccccgtctctactaaaaatacaaaaaattagccgggcatggtggcacgcgcctgtaatcccagctacttaggaggctgaggcaggagaatcgcttgaacccgggaggcggaggttgcagtgagccaagatcacgccacttgcactccagcctgggcaacaagagagaaactccatctcaaaaacaaacaaatccagaccagcctggctaacatggcaaaaccccctctctactaaaaatagaaaaattggctgggcatggtggtaagcacctgtaatctcagctgcattggcggctgaggcaggagaatcacttgaactcagaaggtggaggttgcagtgagcacagatcacaccactgcactccagcctgggcaacagagcaagactctcaaaaaaaaaaagttttgaagggagcagatccactttaaaagctcacactggttcttgagtgatgaccaaatggcactgtgccttatgcagagccgactcctggcagtttgcacaggctggaggtggagctgcagactccctctccctctcggccttgcctctgtaaatgggaaagccgttgacattcacaaaagaggggcagggaactgctacacaagagcagctacacaagagggtcctttggtccacacaggaaacaagccatagtgatgacatattttgaagctgttagatgttttgtttccctagctggctattatttttgtatggcttgtctttctcttttgagtatgtgtgagaacaggatggggatgagaagctcagcttgtagaattggcaggtgatgtttgcagtcattaatcatttgagaagtagagagagaagccaagcaggaaatcttcatactggaaaagaagtgctcaccattaaaaaaaaaaaaaaaaaaaatccagtgtggttcacagctgtaatcccatcacttggaggctgaggcaggagaaatacgtgaagccaggagtttgagaccagcctgggcaatataacaagacccacatctctacaaagagaaaaaaaatgtaaaaaaaagaagctttaaacctaagacggcagaattcaagactgttgtccttgagaacttcctggctctggaaaaagctcagtgagttagtctcatcctgtcgttagctctgttttttaggggctcactttgtcttcacgacagtaccttgcaccattctcatgggtatcccagggtggtgcaaggcagttttctgcacttcccagaatgccctgtcagctggcttctgggtaggttctgcaaattggaggcccctgtgaaagatcgctgtggggtgggaggaagaagctttatctgcctgctggctgcagggtagaggactgcagtggggttatagggatcaccacctgcacatgtggagctttgagcggcttcactctaagtttctgctcaacagtggcagccctggagtccttcgggggcgagtgtgggctcctgggctccaggccaggggcagtcccagcttcctgatctcgaggtagcgtctcctcccttttgctccatagcacctcgcccttctcagtgacgtgcctccttctcagtcatgcgcctccagctctaacaatgtccttgaaaacaattcttgaccatgcgccgtggctcacgcctgtaatcccaacactttgggagtctgaggcaggcggatcacttgaggtcaggagtttgagaccagcctggccaacatgtaatcccagctactccctccacttgatttgtgttccttgaagaaatttgcataatccctgtatctggttggcagatagcagagatgtagcctcagtctttcctttaaaaattttgctttaggcagggcgcggtggctcacacctataatcccagcacgttgggaggccaaggtgggcagatcatgagagcaggaatttgagatcggcctagccaatatggtgaaaccccgtctctactaaaaatataaaaattagctgggcgtggtggcacaagcctgtaatcccagctatttgggaggctgaggcaggagaatcgcttgaatccaggaggcagaggttgagatgagccgagatcacgctattgcactccagcctgggcaacagagggatactccatctcaaaaaaaattttttgctttagggccaatcgtggtgacacacgcttgtaattctggcactttgagaggccgaggcaggtggataatttgaggtcaggggttcgagagcagactggccatgatggtgaaatcccatctctactaaaaatacaaaaaaagccaggtatggtggcatacgcctgtaatcccagctactcgggaggctgaagcaggagaatcacttgaacccgggaggtttaggtggcattgagccgagattgcaccactgcactccagcctgggtgacagagcgagactccatctcaaaaaaaaaaaaaagggccggacgcggtggctcacgcctttaatcccagcactttggaaggccgaggcgggtggatcacctgaggtcaggagttcaagaccagcctggtcaacatggtgaaaccccgtctctactaaaaacattaaaaaattagccgggcatggtagtgggcgcctgtaataccagctactgaggaggctgaggcaggagaattgcttgaacccaggagacagaggttgcagtgacctgagattgtgccactacactccagcctgggcaacaaagcaagactctgtcttaaacaaacaaaaagcccagtgtggtggtgtatatttgtggtcctagctactttgaaggctgaggtgggaggattgcttgagtacaacatgtagaggctgcagtgagctgtgattgtgccactgcaccccagtgtgggtgacagagcaagaccctgtctcaaaataataaaattaacattcattaacaataatgttaatatatatgttaatgtatatgttaatcgtaatgtttatattttaccatgataaaaacattttaaaatcatatatcaactcttgccgttctcctgttgaaaactctccaatgacttcccactccatcatcctgtgggatgggtccaccatgctggaccacaaggctctgcacaatgcggctcccaccagcctctccccttggcccagattgcttcctcctacccctttctctagctgccaggccccccaacccccgcatggagcccttcagcagctctgtgagctccctgcctgttggcagccatcacagcaacgggctctggtgtgccccttgttatccctgtattcaggccattatctgtaatgacagcctggcataattttattttcacaatttgtataattatattctattgagctaaatgatcattataatcattattaaatatttattaagcacttctagctgtgcaaacataataagatgtggcctcagctcttaaaatctttcttcctaattccaacccaaattcatttcaacttaaccaatcttccttcttggagaaggagggaacttcggcgttttgtctgggtttccatgcccgagcttataggagcttcttagcaatgctgtggagcagatgctattgacttcagtttacagataaggaaacaatcagactgaggaagctagtattaataagtagcagagattaagatttgcctgtggttcttttttacacaaagcctctcccactcctttcatgcactgttagccaagtttactagaataggcaacttcctttttaaaaaatcctgtttacattttaggtgccaaacactgtgctaatccagtgggggaaacatatgctcaaaaagatcactctgagaccaggcatggtggctcatgcctgtaatcccaagcctttgggaggatgaggtctgaggactgcttgaggccaggagtttgagatgagcctgggcaacatagtaaggccccttctgtacaaaaaatttaaaaactagccaggcctggtggcatgtgactacaggctgcagtaagctatgatcgtgccactgcactccagcctgggtgacagaatgagaccctgtctctaaaaacaaaacaaaactcaagcagtatcctaagtcagggtccaagcagtaatggaaatgggtgaagctgacaggcgagtgatagagaatggaggggtctgtagcaaacgtgacgactctggcttacctaagagggcagccaattttgccatgaggcaatgtgggatcagtgagtgctgttccagtcttcaatttcgatttataagtaaaatctccaatattttatatgttggcaactttggcattcctttccttaaacctcactgccaccccgcaccccaattcatttcagtagggatcagatagccaacatccttataaaatcaaaagtatacaggccgggtgcagtggctcacacctataatcccagcactttgggaggccgaggcaggcggatcacgaggtcaggagatcgagaccatcctggctaacatggtgaaaccccgtctctactaaaaatacaaaaaaaaaattagccgggcgtggtggcaggcgcctgtagtcttagctacttgggaggctgaggcaggagaatgttgtgaacccgggaggcggagcttgcagtgagctgagatcacgccactgcactccagcctgggtgacagagcgagactccatatcccaaaagaaaaaaaaaaaaaagatacaaatcttaattggcataaaccagtcctagtaatatcatgccctttggccagtcgttggtcacagggtgagctaatgacccaactctgacaaattacatgtaagaggaatactgctaaaaagatattttcggccaggcgtgggggctcacacctgtaatcccagtactttgggaggccgaggcgggcagatcacttgaggtcaggagtttgagaccagccttggcaacatggtgaaaccccatttctactaaaaatacaaaaattagccgggcatgctggtgggtacctgtaatctcagctactcgggaggctgaggcacaagagtcacttgaacccaagaggcacaggttgcagtgaaccaagatcatgccacggcactccagcctgggcgatacagtgagactcagtctcaaaaaaaaaaaaaaaaaaaagagtatcttttcttcagtaaaaagacaaagctgtttgggtgcagtggctcacacctgtaaggagaattgcttgaacccaggaggtagaggttgtagtgagctgaaatcataccactgcactccagcctgggcgacagagcaagacactgtctcaaaaaaaaaaaaaaaaaaaaaagacaaagccttgagggctgaggaagaaatgtggaaactgccctttccctttgttcttgtctaatgcagtcacaaagtctggagcagtagcagccatttttcaaccatgaggcagtaagcatgaagcctaaaaccagcatgccaagaaggacaaagcagaaagactgaaatctctaaggcccttgcagacacccttactgcatcagttccagacttggctcccatagctccagatgtggccatggccactgtatatgtaagcttgatggaataagcactaatgcggcaccttagagctgctggaaaagagaccaatggacatgtacgaatgggggatcctgccatttgccgagtaaaggcctcctgtgtagaaggtgtcctttgataagcattcacatggaatacaaatctccactcatctctccccaatccaaaaggttcatccacaccccctctccagaccttcttgtctttctgtctccaaacatgttctttccaagtttctgaaccttcaaagtgttagtgactgtccgtgaactggagtagacccaacccttctggctttcttgcttgctttttttttttttttttttttgagatggagttttgttcttgttgctcaggctggagtgcaatggcgcgatctcggctcaccacaacctccgcctcccgagttcaagcaattctcctgcctcagcctcctgaatagctgggatcacaggcgtgcgccaccacgcccggctaattttgtatttttagtagagacggggtttctccatgttggtcaggctggtctcaaactcctgacctcaggtgatccacctgcctcggcctcccaaagtgctgggattacaggtgtgagccaccgcacccagcccacttccctgttgattctgtctctctggaagaaccctcactaataaactttacttgaccttcaaaataataatgctcaaaagacaccctcatttggggtgccagagtctggcatttgttctctaccagtgcctggtagcaaatctgaagctgtgtaatgcttaaatggagaatagtcattttcagaggagggtatatctttgctctaaaccccttggagtctgtgctgtgacttttattttttatttttttttttgagacagagtcttgctcttgttgcccaggctggagtgcaatggcgtgatctcggctcactgcaacctccgcctcttgggttcaagtggttctcctgccccagcctcctgagtagctgggattataggcacccaccaccacacgcagctaattttttgtattttttagtaaagactttaaagacatttcaatttcaccatgctggccaggctggtcttcaactcctgaccttaggtgatccaccgcaccttggcctcccaaagtgctgggattacaggagtgagccactgcacccagcctgtgctgtgactcttatactggtccctgccagaacttacaggagcatgacctgtcacggacaacctgagcaccactggatctgcagggttatctgtcaaatgggtcggagcagcatactcaaatgtggtcgctattatctctaaaagtcaaggaaagccagcagtgcaggacactcaaatccagacgtcattccactagctaagctaagcaaacagttggagctatcccagctgtcgaagctaacacgctgcatttagactctcttgcaagtcagctgtgttggtaactagaggctctggattgacacattagaatccactcccatacattccccaggttttggctggtaaaaattgattgatatcccataattccttcagcatgtgaacttctcccaaatcaggtgttttgttttgttttgttttgttttgttttgttttgttttgttttgttttgtttggagacagagtctcactcagtagcccaggctggaatcgcaccattgcacttcagcctgggtgacaagagcaaaactccatctcaaaaacaaaaaaagaatgacgccttagtttggggttagagcaaatggtgctgcctatttctgggatggggaagacaagaaggaatagagttggggacagaggtatcaagagttatttgagggcacagaagtccaagatggctataagacagtcaggtgggaaggtcagtggaggctcaggggggacatgcaggctgggatagaaatgtgagcatccccagataggtggcctgtagggccatgagcctggtagggtgactgagcgaggagaatagccggagaaggggaggtccaaggacccagacccacctggttatttcacatttggggccagactggctttgtttaccattgatctgagcatgaaaatcaagtgaaaatcaaaaggaagccaggagccacgcctcctccgtgactgcggatcctgggccaatgtttcgctgctgcagtgagacccctgactttgtgtgggcagtgggaccaactgggcatgtgcagtgatcagttgctaaatattggcactctcattagccttgggatctggaaacctccatccaccagacacagcccatttccagctcacccgctctccacactaggactctgaacaccctttcttcatgcctcttctccttcctaactgcctgcctgctccagcaggcctcaggccacttcttttttgtgtgccaccacacccagtggtgtatttaaaataacaaaagctggaggaacatggtggcacctacctataatcccaacactttgggagtctgaggcaggaggatcacttaagcccagaagttcaagaccagcctgggaaacatgttgagacctcaactctaaaaagtttttaaaattagccagatgtggccagcatcatcctgataccaaagccgggcagagacacaaccaaacaagagaactttagaccaatatccttgatgaacattgatgcaaaaatcctcaataaaatactggcaaacagaatccagcagcacatcaaaagcttatccactatgatcaagtgggcttcatccctgggatgcaaggctggttcaatatatgcaaatcaataaatgtaatccagaatataaacagaaccaaagacaaaaaccacatgattatctcaatagatgcagaaaaggcctttgacaaaattcaacaacccttcatgctaaaaactctcaataaattaggtattgatgggacgtatctcaaaataataag

SEQ ID NO: 120 - DNA, 5134 bp, Homo sapiens
attattacttcgctaaaggatgcatgatcacaaatatttgtaatgaagatagtgactccttttttctcaaaataattttaaattaacttaaacatgcctgattttcagaaagaaagtattaaaagtaaaaccatacctttaatttaggactgacttctgcatttcaactgtagattattctagtatgaagagtgctatttgcatgttggaatgaatatcttttaattcttaatttgtaagttacaaagaaataggagactgaaatactttttatcttacaaaattccaaacaccttttcaagcaatttatatcttatttctgtaatagttttatcaccagccaatgggtatgcactgtatgtcataatatggaaagaaattctttattatttcagatattaaggatttcagattttaaaagagttatcagtgaaaccatgttacaagaatatttccttcctgagacatctcagtattataggtggcttcagactcacaggcacagaatacgatagtgggaagcatctgattcgctttactctacttggtacctttaggacgttcagccagaggtgattggagggatttgcacgtctaccactcgtgtgtgtatctgtgaaccatatctcctttagtgcctgcttttgaacgttatataaacagaatgatgctgcctgtttatttctataattttcttcttttccttagcatgtgctgttcttggcagcttgcttctccatgtgaattttggaaaagcttctgaagttccctttagtaaacaccaagagaactattgctgggtcgtatcgtagttgcatgttcagttctctaaggcactaccaatctgttttcttttcttttttgtttttttttgagacagggtctcactctgtcacctaggctgaagtgcagtggtgtgatcatggctcactgcagctttgaccttcctgggatcaggtgatcctctcagctcagcctcccgagtagctaggactataggcatgcaccaccacgcccatctaatttattgtatttttagtagagaccatggatttcgccatgcttcccaggctagtcttgaactcctggggtcaagtgatcctccctcctcggcctccaagtgctgggattacaggtatgagccactgcatccagcccaacctgttttctagagtgactgttttatagttttaaagtccctcatccattttgagctatgtttttggtgtaatttatgtggtttaggtcaatgtccagttgctccagcaccatttgttgtaattgtgtaaaaaatcagatgagcatttttttgttgctctatttctgggttctctattctgctccaatcatctttgcatccatgcctctgccaatataatatggtctaatgactacagctattattgtaagccttaaggaaaaaataaaacagtccctattttcagatggcaagatggtttacacagaaaaccccaaggtatctccaaaaaagagctcctagaactggtaagtgagttcagcaaggttgctggattcaagagtaatacacaaatgtcaatcacattttgcatattaacgatgaacatatggaaagcaaaatttaaaacacaatgtcatttataattaattgctccaaataaaatgaaatgcctagaatatacacttaataaaacatgaatagaatttgtatgttgaaaattacaaaatgctgatgaaagaaatcaaagaagaactaaataaatggagagacatactgtacttatgaattggaagattcagtatagtaaagatgtcatttctccccaacttgataatagttgtaatgaaattgaattaatgaatcaaatagagtgatttctcccactttcttcttcttcatccagattgttttagctattcttgggcctgcgcttttttcatataaattttacaataaacttacctttgtctataaaaaaaccttgttgggattttgataggaatttcattacatctgtagatcaatttgggaagaaatgacatgcttactatactgaatcttccaattcatgaattagtatgtctctccatttatataggtcatttcttataggttgattataggtatataggttgatttcttttgtcagcatttttttattttgttgtgttatgtccatgggttttagttgtaaaggagaggacctgggggaaaaggagctacttcatcttggtggaattggaagtcctattacagttgtctcctcttatccatgcttttgcttggaaagttagtttcagttacttgtggtcaacagtggtctgaaaatattaaatggaaaattccataaataaagaattcataagttttaaattttgcactgttctgagtagcatgatgaaatcttgcccctttctgctccatcccacccaggacgtgaatcatttctttatccagcatatctactcagcatatgctgcctgaccactagttacttggtagtcctcttggttatcagaccaaaaaactagtatatatagcgtttggtactatgtgtggtttcaggcatcctctgggggtcttggaatgtatctcttgcaggtaaggaggactctctattggcttttgaactcttcaaggtcagagattttgtctgctttttttctgcaacatgaagtctagcatgctgtctgtcacagtagatggtttaatacatgtcggattaataaacaagtaattgatatttgttgagaaaataattttgtgttggatgcagagaatatgtatgaggtattttttctacccttagagaacaaactatatgactgtgaaaacttaatgtgaaacttacacgtttagttttgtgtaatgtggttttgtttagtgggtattagaatgaaatttgaaatccagtggtcctggatatgaatctggcctccattaatttactagctatatgaccttgggaaagttccttaacttctctgacactaggattttctcatttaaaaaattgggtgctggctgtagtcacctgtcagggtttttataaggttaaatggtataatacatgaaaagtacttgactctgtgcttgacatgtaggaagccctcaaaactggtagtgactaaagaaaatgataagcagcattacagcacaggtaagtgataactgggttacacaaagtataacaggaacgcctatggaaacctaaagttgtagggaaagactttatggaggaagcaggacttgatctagcccttaaaaaagaacaacgctagctgggcacagtggctcatgcctgtaatcccagcactctgggaggccgaggtgggcggatcacctgaggtcgggcgttcgagaccagcctgaccaacatggagaaaccctgtctctactaaaaatacaaaatcagccgggtacagtggcacatgcctgtaatcccagctactcgggaggctgaggcaggagaatcgcttgaaaccaggaggtggaggttgtggtgagtcgagatcgtgccattgcactccaacctgggcaacaagagtgaaactccatctcaaaaaaaacaaaacaaaacaacaatgcttagacaagcttcgaggtgagagtgagtgaacatggttatggcattccaaagagacaagacataatgagctatggttaggaagctgcaatgtgtatggcaggctcgcaaaacaaaaagattacttggatgatccaagaaatcttgtacagaagtaatagcaataaggtagactagatgtcctgaaaatcattcctctacaaaatccctaaaaatgcttattttttaaagactttatagttacattttcaaaaagtaagggaaatcctcaaattccaaaaaagtacttaaaagcatgaattcaagcatcagagttaaactacatagcagaccaaataggcctaagcgacatttacagaccatttcacccaaatgctgcagaatacacgttattttcatcaggacatggaacattctccagaacagatcatatcttaggccatgtgacaagtctcaacagattttttaaaaatataaatcatatcaagtgtcttttctaacaaaaatggaataaaactagaaatcagtagcaagaagaaccttgaaaaccacaaaacacatggaaactaaacaacatgctcttgaacaacctatgggtgagaaaagaaataaagaagaaaattaaaaaatttattgaactacatcacaaaggaaatacaacataccaaatctattgaatatagcaaaagcagtactaagagggaagtttatagcaataaatatctatatcaaaaaagtagaaagactttaaataaacaacctaaaatgtgccataaggaactagaaaaaaagaaaaaaccaaaccctaaattagtagaaggaaataaataataaagatcagagcagaaatatatgaaactgagacttaaaaatacagatcaataaaatgaaaagttggttttttgaaaaaataaacaaaatcaacaaacccttagctagattaagaaaaaaagagagaagacccaaataaaattagaaacaaagaaggagacacaactgagaccacagaaatagaatcattagagactgttatgaacaactacatgccaacaaatttttaaaaattctagggaacttagaaaaatggataaattcctggacacatacaacttaccaaaattgaacaatgaagaaatagaaaacatccacaaaccaataatgaatcaggagatcaaagccgtaataaaatgtctctcatcaaagaaaagcccaggacctgatgactttagtgctgaattctaaaccaaactctaaccaaactcctaaaaaaaaaaaaaaaaaaaaaaaaaaaaaaaaaaaattggacaggagggaataactgcaaactcactctgtaaggtcaacattaccctgataccaaaaccagaccaaaaaagaaaactacaagccaatatcactgatgaacatggttgggaaatcctcaacaaaccaaagcaatcctgggcaaaaagaacaaaggaagcatcacactacctccgttaaaatggcttttatcaaaagggcagggaataacagatgctggtgaggatgcagagaaaggtgaacctttgtaccctgttggtgggaat

SEQ ID NO: 121 - DNA, 1835 bp, Homo sapiens
gtgtatgctgcgaattaatacgtgaatgaacaaatgactacaggcattatccgaatgatatgatcttccttccccatctttctgggtgtcggccttcattcaccatgaagttgtaaacacaacattgattttggagtcagacaacctaagttcaaatctagcctttgctaattactggctgaaatcattgagaaatctacttaacctgcctgagacctcagtttccttatttgtaaatggaatagtagtgcctcaagtgagataaggaagaaggatgcctggagtgggataaagaaaatatagaaaaggaagggagtgtcttcacatcccagcagggcacatggaggaggaggaggaggtgctgactatggacagcaagaagcaacatcaccatcacaaaacacccacccagggcaggggccctttcaacaaggagcataagagactgtttctgcctctgatggaagcccagcattttgtttttctccacatattttaatcaatatttaccaagccataacaatctggctttcactgtcaccctagggttgagtttcatgagtaactaccttttccactggctgcagaaataatgactccatgtatgattggcagaaggtcattcatttgagcataggaaaacaagcagtttcaagaaaagagctggcatctctgcatgagtgaatcagtgcacatctaaaatgcagttactgaaattatagaagcctctcctcggccaattggcctcctttggaagatatggcctcacaccattccatgtgcatgtgaaatgtctagacgtgattatagagttttcttgagagctgatgcatccaaggaacatttaaagtaagaagcaaagtaatgaaaaacgtttctcagaaaataaaaattgttaatatggtcttaccacattttctaatgaaagcatgttgtgaatgctcaggaagaagaaggtacagtaatgggactagaaatctgcagcttggatgggagcccagtcaccaattaccaagtgctacaagcctgaggctacttctcattgaaagggcctcccaggcattgagggtgtccacagttcagtgagacctcagaagcctgcacgtagttcatgctcagttcttaggataatcctgtctctccacaattccttcaggcttgcaacactctcttaccccaaatcagctcttcccctacatttcccctttctatcaatggcactagaattctcccaaattgatcaatgtcaacatctcattgtttactcacccttcatgtactcacctcccattataatgtctagattacagatagcctttattttacctcacggcatgtccagaaagaatctgtcttaactacctacttacaccaaggcatcagcaattcatttatttattcattcatctgttattgtatgaagtattggctaagagatctatagtgaagtggggagagatagtcatttaaagtaactgtcatataagaatgagtaagcattcacaccgttgcttccaccagaactcacactttcttccttatatttttccatctttaaacacaagttaggagacactacctcctggaagcctcccctgaatccaccctcagctgactaaaatgtctctccaatgggcttttacaagtgcatatctagttcattgcactgaaatttcactgattagctattcatgtgcctgcctgctccccccaattagactgtcctattcaaaaacagggactgtgtcatattcatctctgtattcctgatacttaacatagagcccagctcattgtgtgcattgcatatttttaaatgaacacatgaatgaatg

SEQ ID NO: 122 - DNA, 1919 bp, Homo sapiens
tggcgtatggaccaccttggtgtctccagcacccacctcaggctttcatgcatagtaggcacccggggtagggttgtagcctatatttgctcacattaaaaaattagagaccagcaagatatatgcaagttgccgcctctaacctcgccaccccatggagtttctttttagcagttgttgaccaagtgtcagcagaggttgcattggggtgttggtgttcaggagcccgagccagtcggggctcaccatggtggcagcaggctttatgacttggtcttttcctctttccttttcctctcaggtcatggtcaccccgctgctggctaactgcagctacttctgccagccagtggactacagatggagaaagcatggaatgagggtatggcagggagcaggaagcaagcctggagagggttaggaggaacaacttcataacaatcggaggtcaaggaggtatcacctgagccttttgatgagaggcaggggactagctagttttggagtcagataacatcaatttggatctcagctctgccagttacttgctgtgtgactctgggtggcacacctaactcttctgggactcaattttcttatctataagattgagataataatacctattttataaagcgaaatgattgaaggaagacggaatcagataatatatgatagataatatatgaaagtgtttagcacaggggccggcacacactgagcggtagctaggtggtagtgatttcatcactgttagctgttctctgtttcaactggaagcagaacaaaagactctagctgaagcctgtctccaggtagctaaggcttctcaccagctgatatggatgttgagtcactggatgttggtgatgggctcatgtcctgtgactcaaagtatgatccttgggccagcagcatcatttgggagcttgttggaaatgcagaatctgtgctccaccccaggcacactgattaagaatcttcttttcaacgaacaagatgcccacatgctcattagattccaaggttctgggctggggcacatttggagagtccttctgtggtcactccagtagcttctccccttctttcctgtgcgaacaggcatcttcctggagacaggaaggtaggcactgtggaatcagcggtgcgtagaacagtgaggatttggggctgaacccagcccaggtgggccaagccgtggcaccagccggactgcagtctgatggaacttccccttcctgcccagcagatggcgagcgtgtgctgctggtgcctctttccaaaggacgttgaattgcttgacaggtgttctttactttatgaatgaagccagagcagcccaccttcctgcatctctaccaccatggcaccatgccctgtgatgggtgggctggagtcaaatatgtagcaggcagccagggtcagtttgtggccactgctgccccctcttcctacagtctcctcactgagtgccccttccctgttgggttcaacacatctgtgctcctgtaagccctcagcctcctcgttctcttcctcaacttctaccaccagacacatctgagaagcaagcaagagaggctgaactaggagcaggacccagggactgaaaccagcacagcatccccacagagaattgggtggaaggcagcatggcttccagcttactggtgctgagcagattgctctgggtctccattgtatcctctgaaggaaggaggaggattgccttctgtccagatctcaggatcaaacaaataggtccaatttcctgtgctcacttcagttagagcacttctcatgtgactttgtagctttgtgtgcatctccttcctctactagacctaagcccctcacgggagggactctcttattcttgatgttccccacacctggaatttcaataaacatctcaa

SEQ ID NO: 123 - DNA, 2338 bp, Homo sapiens
tgacttcctgagtgtctgcttccacccctataaccacaacctggattttgtgtataccattctcatgaatcaattttgctatgcatgtgtcccttagaacctgtgagtgtagtgaatttcataaataattttagaacattgccagtcatgcatccctgggataaaactaacttgatcatattgtattttataggagtctcatgtatatgttcactgaatcaagtttatcatactattcaaatatggttaaaaacatgtgttgacttgagctactaactactgagagagggatgtcaaaaatttcccagtgtgttgtgtctttgtcaatttatccttgttggtctgtcaaatttcactttatatattttgagactatattattaggtatattaatgtttataatgattatctctttctagtaaattgaagattttaccattatatcttgattattttcatctttaaaaaacataaatattaatgtagctataccagcttggttatggttattttacctggcaaatatctttttccattcttttattttttaccttttcatgtcctttgacttcaatgtagctcttgcaggcagaatatgtattgatttttccttgtttaattgaggtataatgagttttaaaatttaatgtgataattctatcttgtaactagaacttggtaattttatgttgtgattgtagatatttacatagaataatttctccagtgatatttatattataaagcacatttaccatgtgctttatagttaccttgcttttactattttcatttttttaagtttatagtttttttaaagaaactgatttgttatgaaaaaacatttatctagagttgtttttctatcaattgcactttagtattttcttctatcagatccaaataacattaaatgttttgataaatacttgtgtgtacatatatgtatccacactatttatatctttttttcttacaatgaacatattttacttctgtattctaaaaattgtttggagatagtttaatatatagatgaacaaataaataatacttacatggaaattatgttattgttacaaccaggtggacttaccaacagccatacagtggaagtggtctgaaggcatggcagaatatccccaacctgcctcgcctaaatatttttacctatgatgagcaaatagctgccaagcaagaatggatgctggcaagactgtctgagctgagcctctatggtagggttgccagatttagcaaataaaattatcatatgggatatacttaaaaattttgcattgtttatccaagttatatatagttaaatataactgggtgtactgcattttatttgaccctaccctatgggtaagaccccattcatttcactggagagtgccaggaagcaaggtggctcttccttgcaagtccctgacctctcttgctgaatgtgcctgagaagggttagaaatgcgtgctctccttttagacacccagctcatcattccttttttgcaagcactttctcagggcctctttcagcatttaatctagggaatgagggcactgttgccatgtggttttcaaactaatagagctgacatcctagaactcccacctggtcccttgccaacattgtcacacaacccgccctgccccttcagtacagctctgactgggaaaagcatgggctctgaccctaactggcttttggcgttgaggtctagaactatcatttacctgctgtgtaacattaaccaattcactgagtttctctgaaacttctatgcctcatttataaaatgggactattaaaagtaattcctttgaaccagaccttattctataagaaaccattcaaactaatggggggaaaaatgcaaacttcatatttgaaccagatcttacccttttagagccataaagattaaaggacaaaaactgtgtctgctcaagctacaaacttcttttgcagcagaactagggactaataagccagattacaacactcgcatgcagtggaatgctatgcaggcattaaaaatgagcatgtttcttaatcctcgtgattataagagctagactttattttagtgagaaaagaaagatgggaaacagtatgtataacatgctaccttttgtataagaaagggagaatataaaagtatttttaattgcttattttacataaacaatacacaagaacttaataaaagggattacccctggtgtgaggatgggagttgttgctagcaaaatgtagtggtttagggcaggtctggaaattagatttttcactatataccattttgtatcgttttgattttagaaccatgtg

SEQ ID NO: 124 - DNA, 4313 bp, Homo sapiens
gttaaagaagttgtcttatatacatagaaatggtataataagctactttaaacaaccctggatatgtttcttttcccttcctgtcactgtcctctttcttcccttttcccttttgattaagaagttccatcagaaaagtcataaaatctaactcctgtttattctcgagctatcagctaaaatgtcactttctcaggaaatcctgcctgacccccctttcccctttgttctggcacccattcccctggcctttaaatgctttcatagcagtgtgtacctatctatcattttttacagtttgtaattacggctttttttttttttttttttttgagatggagtctcgctttgtcgcccaggctggagtgcgtggtgcgatcttggcttactacaacctctgcctcccaggttcaagcaattttcctgcctcagcccccccaagtagctgggactacaggtgcgcaccaccacgcctggctaatttttgtatttttagtagaggcggagtttcatcatgttggccaggctggtctcaaactcctgacctcaggtgacccacctgccttggcctcccaaagtgctgggattacaggcgtgagccaccgtgcccggcttcctgtaattatgtattaaaatgtataattacttgattaatagctatcttcccaactagaccaaaaactccatagaatgtatggaattttcctccatcatccttgtagtccaagcataatatttattaaatgagtaaatgagtgaattaactagccattttgattaattttctctttttagtgcagttttggtttaggactgtaaggagtcatactggccatattcagaatgtcacattagtgttttaagtccattctgtatttttttcaatgagtttcagcaaaatctgagagtgtcttaagtgaaattggttatatctagggtggaggtattatatttggaaagacttgtaacagtagaaagctttttatttaaatctttgagttttaaaatatttttattatgaagttatttatgattttataggtaatatttttaatgagaccttgaaaaatttatagagtgcagtttattacagaatctgagttgcctaatagtttttaatagtttttgagtatcagtattttgattaattttaagttagggatcatttcctctaattctttgaacataattatttgttggttgatttttttttttaatgtaacagtgtttttgagatgtaatttatgtaccatacggttcttctactttagggtattagattcatggattttttgtacattcacagatgtgaccgtcattgcagtcaattttagaacattttcataatctcaaaaggaaaactgtagcctttggctattatccacttattcttccatccctgagcaaccactaaactacttttggtgtgtatagatttgcctatttaagacattttctataaatggaatcatataatttatggccttttgtgattggcttccatttaggatgttgttttcaaagtttatattgtatcatgtatcagtactacatccttcttattgctggtaagtattctgttgtatcgatataccacattatgtttagccgtttattagtacagtggtccccaacctttttggcaccaaggactgactttgtgcaaggcagtttttccatggatggggtgtgatgggggaggatggtttcagaatgaaattgttccatttcagatcatcaggcattagattcttataaggaacaaaaccaaaacagcaacaacaacagtgattctcataaggagcacccaacctagatcccttgcatgtgcagttcatagtaggttggtgctcctatgagagtctaatgcctatgctgatctgacaggaggcagagctcaggcagtaatgcttgctaacccaccgccactcacctcctgctgtgcatctcagttccttacaggaaccagtactggtctgtggcctgggggtttgggatccctgcattagttgatagacatttggattatatccacttattggctattatgaataatgctgctataataaacattcatacaagttttttgtggacatggtttcatttcttgggtatatgtccagcagtggaatttctgggtcatttgctaactatgatttcgttattggagaaactgccagattttttgttgatttttttttttttctgttattatgtagtgtcaagaaaccgtttaatgcatatgaattgaagccctgtaaggaaagtgatcatttgggattagatcgcaaattgcttgacttcaaatgtattactttgagaattttctgtgacagtttagctagtcctttatcttccttatttttcttgagaatacatgaattagctccctgccttcatatttgaagatacatacctatcagtgtacagacatgtacacacataggtacacatataatactttgctaagcagtttgtgctggggacaatagttgaaactcggtgttttttcctaaaatttatatcgtttgtttatatatgaaatatcaaatgggagatatttttggaagcagtgaaacttgtttatgaattctttccttacacaaaagaagacaggttttttaaaaacaaattaatctttttctctttgtttctttcagcattgatgactgggaagtgagagacatagatttttgaaaagctgaaaataacttctagtttaacaaaatagtttcttccagagcttagaatttcagatgattggaaaattcatacatctaggtctgaaagtttaagtctttcgcatctatggagatctctattttctacaacctaaaatgctatgatgggtgacaggttaaagacaaacctttttaaaaaatgtatatttttattgctatatagtggtattatggcttttgaaattcctatttttaccataaacagattattaggtgcttactgattccagataatagcctaatctattagaaggtagaagagagaatctctggtgatacactgtccatacatggttcaataggaggtagcaaaggctaagtatgagtaagtgacaaaagcagtaaatgctgcagaactgaaattcagagaattgcgcttccactgttgggtaaggcttaaggggagactttgaaagaggaagatgagctatgccttcctttgggtactgatttaatttcttttgccatttttttgcatttcttgaatgtaggaatttatccttacccatgtgcatattcatcagctccaatttaggagattgactagtgtagcacgtcataaccagaaagatacttggaggtagacttttccctaaagtttatacaagacacttaatgggctgggtccttgatcatgtacttctttcttagactttgtgtatatgaagtggtgttcttatccttatttctttccacattcaccctttttaatgcttttagtaagtcttttcagtttttgttaagatttattttatagttacactattgtatttattgaaggtagcttggctgatactgttccaaagtcacttgccactttcctctctgcataattaacatttattctcctcattatttgtcaatgaattcccttctgtttatttatagtttctttatgattctgcatatcagaagataacaagcacttatcacaaatgcatttaggggatgtactactctgtaaaaaatttaaatatattgaaaatagaactctttgaattttattttactcttttgaggaaatgaagatatcttgattttttttatggtattctaacctgcttttccggggcatacagggcagcacttatttttatataaatctgagaatgtgtgaattgcaaattaatcttctggcagatatctaatgctgttgatagagatgtgttgccctaagatttattggatttaatgagacagtcttttgatatatccttgaattatgatgggatattgggttgccacatgtaagttttagaatattttttaatgatatagagaaaatgcttcagatacaatggcatgtaaaagagaaaacagcaaaaaaaccctgattttaaaacggtttgattcaatttatattttaaaaacacagacacatgatttgtatgcctgtgtatatagaaaagattgcaaggatatttaccaaaatattaagtgattatctctgggttgtagtaattggggtgatttttattttttaagtgccttttctttgggtattgcctgaaatgttaaatattatctcattttagcaaataataaatactacttttaactaagaaaaaatag

SEQ ID NO: 125 - DNA, 10342 bp, Homo sapiens
gttctccagccgaggctcgggactgctgcagggtggaaaatgaaagttctgagagcaccttccgcccctccgcttctgcacagccggggctgcggtgcgaggagcttggccgcggggcccgaacgaggcgaaggggccggggcccttggggaacccccttctctcttccactctcccttaggtaaaacccgtgttcctctcacgctcgacccagcgcctttccagctgcggtcgatttgcttctccgcgtgtaagtacagccaccctcaaggtcattgaaaaagtttgctttaaatgagcgtctgcggaactcgtcctgaggctctcactgttacagattagagatgggggcgctttctagtggaggattttgcttttgctcttctacttttgcaagaagctttttgtcctgaaaagtggacagtcatctccatttatagcttggaatgaaaatttgactatggaagttgcagtcgctacttgagaaatatttcctccttctttttttttttttttttttatttttgacacggagttttgctgttgttgcccaagctggagagcagtgcgcgatctcggctcactgcaacctccgccttccggtttcaagcgattctcctgcctcagcctcccgagtaggcgggattacaggtatgtgccaccatgcccggctaatttttgtatttttagtagacacggggtttcaccatgttggccaggctggtctcgaactcctgacctcgtgatccacccgcttcggcctcccaggtcctccttccgttttaaaggataaaccttgaaatgcttttaaaatatgcagcgtgtagaatttggttagttggttggttggggttttttagagaaaatgagaggtagaatggactctaagttaaaccctgggggacagtgtcactctggccgctggcctggctgggaaaggcgatgagaccctgagcaggttaaaacccgtgtcctgaaggtgtcctgtaaagggaaataggcccgttgcctccttcgtaggtgccctgagactccgacaaggcaggaatgccaaggtatttcgtacctgctcagccctggcatgtcaggttgctgagaccgagcagtgtggggctgaggtggaagcggaccttctggggcgtggaaagcgcaccaggagaccccggctccttctcagccagcactgcctcatcctcagaacaaatttaagtcaattcagcatttattcaatgcctgttgcatgcaagtgacaacctaaataacagagaggatctctaaaagaaacagatatttattttgcaatagagctttgcagtagaaatatgcatgccatggtaaacttgtgcatattcagagaggcaaggaaagcaaaggctttaaaaaaaatgaggcggattgcacaattgtttgaaaataattatctgtggctacaaagatccataacgaaggcgatgccagttcaaagtaggacagccagtggctgggccatgtccttgcaggactagttttttgtgggagattgcagtggcctttgtgcaaggttgcggtttttccagagagtcctttttgttatcaggcatgcacgcgcaagaaccctctcttcatggccttccccggctctgtttgtcagggttttcttaacattagcggctccatttcgattctgacaattttcacacaagctacagtgcctggcctgggacgacacaaacatgagtcaggtttggtgcctgttggccaggcgcagtggcacacacctgtaatcccaccactctgagaggccgaggcagatggatcctttgagcccaggagttcaagattagcctggcaacatagggagacccccgtctctatgaaaattacagaaaaaatttgccatgcatggtggtgtgcacctaccccagtgactggcacctggaattcaccgagcaagttggttgaaaaagttaaaggaattttccagcactttgaaaactaaaccaagagaatgtctccatatcaaatttcagccactccttataaaaatgtcttaaaggctgtaaatcaccgtattcacctgcaggaagcagtgttgaggaaggaggtagtatagggttaagggtctatttaaaccagctgcttagggccaagttagatgtttattctgtctagtttaaaccactggcttaacagggtacttaattttccagtttcatcaaagaaatgtgctgtgaggccaagaaaattatgtagttcatttttttaaaagagatgcaaactgagaaattctgtgaccattaacagtctcattaaagaaataagaaaatatgattgtttctcttagattttgcaaaatggctaaggagcatttttagacactttgttgtagaacaactctcttttaagctactttcctcctttcttaaaaacaaaatataggccgggtgtggtggctcacacttgcaatcccagcactttgggaggctgaggcagatggatcacctgaggtcaggagttcgagaccagcctggccaacatggtgaaaccccatctctactaaaagtacaaaaattagctgggcgtgatggtaggcacctgtaatcccagctacttgggaggctgaggcacgagaatcgcttgaatccaggaggcagaggttacagtgagccgaggtcatgccactgcactccagcctggtggtcagagcgagactttggctcaaaaaaaaaaaaaatgtattatccatttattatgtactcattcagcagataggagcaaaagcgcccattctactcttaagtcccaacccagaaatagagcagtgagggaaactgacagcatcctgggcctcagcacctgctgggagaaagagccaacaaaatacacagcaacacacaggatatagcacccttggtgttgattaaacgctagatgaagaaaagggaggaggagacgggaggaatgcaggctgaggcggtggcagggggctccattttaaacaggatgtcgacaaagatagaatttcagcgagtgctagaatgaggtaaggacttacatcaacaatctgcccgcaccatttcttcttagatttcagaaactgttttcgtttgattcaatactggtgccttccttcggttcattttctgtttatcataaaaattatcctaggtcttcaaaactaatttaatggaattgtatagaaatggaaataaaagtgactacaagcttcaaaaaggtagattttgggtataaagacaatcttatatatttttttctttttcaagacaaagtctcacgttgtcatccaggttagagtgtagtggcacgatctaggctcactgcaacttctgcctccccgattcaagcgattcttgtgtgtcagcctcctgagtagctgggaccacgagcgtgcaccaccacgcctggctaatttttgtatttttagtagagatggggttttgccatgttggccaagctggtctcaaactcctggccccaagtgatacacctgtcttggcctcccaaagtgctgggattacaggcgtgagccaccatgcctggccaaagtggtgaattttatattagtgtggttttgcagtggctaggtctgtgcaaacctatccccaaaggccaaggaaactgacaggctgaataaagaggctgacatacccagtttcctagaaagaaacatttagggccaggcgggaagactcacgcctgtatcccagcactttgggaggctgaggtgggtggatcacctgaagtcaggagttcgagaccagcctggccaacatggtgaaaccccatctctactaaaaatacaaaaattagctgggcctggtggtgcacacctgtaatcccagctactcaggaggctgaggcaggagaatcgcttgaacctgggaggtggaggttgcagtgagcccagattgcaccattgcacttcagcctgggcaacaagagtgaaactccatctcaaaaaaaaaacaaacaagaaagaaaagaaaagaaacatttaataaagattggcgaacagaagccgtgtctgtgtcttgggcacccttacctgccagacgcaggccttctgtactacagcaaaagggtgactcagaggggatgtgcaagggaattgaaggacgataacatcaaggttgtttcaacctaaggacaggatttacaatgaggacctgctcttactcaaggaacaataaactggaaatcctagaggccttcccagaactggggttagtcagaagtgaacccggcagatcgcgtcccaggtggagctgctttagcctccgtatgtatatttcacccccaagaaaggttaaaccgaactgacaacagagacattcctctctgtacctctattcaataatgaggcacagcaaactgtagaacgcatgacaaccacagataaggaaagcactcgcacggtcctgacgccattgcccaccctgacattcgttcatggaggtcgcctgcacattccatcttattcaaaggggtggtggaatggggtggggggagagcatctgctattatctccggtcgagtgctagaggcttgagcccacatctggggtctgagagaggatcctgcactaggaactgggacttgataatggcctcgaggacagcttggagcgtagaaaatatttttgggttcactgacattttaactataattttatataagaacttaaatcatcaaaatgggggatccaggactctgtcctctttatggggctgctgggcaaactgactcgcagagagatgatgagccataaacatccactcacaagcgggagaaagtcaatggagaccgtgtggaaaccacttcccctgcttaaaaatcaccaaagccgtaatgatggacagtgagacagcagtgaccctcagtatttcaatgggacgtgaataatgtttaattgtatgttcatatattgcttaacagttttagaaaatctgttcttctgcagcactagcctgctctgcccatcccaaaagtgagtggtgcctgaaggaattctgagcccctctgtgagaggaagcgcgtctgtcttttctttacgaccccggcactgagcacagggcttggaatactataagaaataaacacatcttttaaaaatagtgaaaaacggagagaacataatcaaatgcccatgttattattcacggcacgagtgtcttagagaatacaggtgtttagggctgaagtgagtccccctgagattcatgctgaatctctaaccctcagcaccacacactgagcctgagcttgaagagggggccttgaaagggtgattaagttaaaattaggtcactggagagagtcctaatctaatgtgactggtgtctttataagaagtaattaggacacagacacatggaccaaggggcagccatgtgaggcctcacatgggtgggaaggtgaacccagcccggccgacaccttgatcttggacttccagcctccagaacggtgagaaaacaaacatctgttgttgaagctgatataagagttaagaagaaatcacttaggcagatagtaagggtgtgagtgtcctcaataaggcttttatttttcatgaaaagcagccccagatcattttctaacaaagagcatcctgtaaagtggagctgcagacatggacaagcaggctgggagcttgcacgggtgaatgccagcgggaactagggtctagaaacgttcaagatggcggctgcatcttcccttctctgccagccacgtgtaatgtaaggagcagaaaaaatggcaccgatggcccatcaactcaaaagcccatttgcataataagattagggtggggtgaccagccttcctggtatgctatgtaaacgccatacgtgatcaaaccaatttgtgagtcctatgtaaatcagacactgcctcctcaaactggactataaaaccgggcgcattcaccaccagccagtcttttccgattggagacccctttctctatggagagagctgtttctctttctcttctcttctgcctattaaacctcccctcctaaactcctcgtgtgcgtccgtgtcctaaactttcctggtgcgcgacaacgaaccccagggtatataccccgacaacgtagctgcttcaaagccaccaggtctggatgctttgttgtggcagcacaggaggactagggggaaaagaggcctctgttcttgttcccaaggaacaagaatggatggaatggccatccgtttgtggggaatcaaacataaagacccacatgcatcatgagacagatgtgtggacaagcctcgagacataataggcattgcgtgtggtccacactgccaagggctggagtcagggaaaagggagagggggtggacaacgttctcagcacccagttatgctcaataaatatctgtagcctgaatgagtctgaaaacttgagctggagtcagtgaggaatacaaaatcaagagatgtaaagaggaagaagtgttcgagcaccttggctcacgcctgtaatcccagtacttgggaaggccgaggctggtggatcatctgatgtcaggagatcaagaccagcctggccaacatggtgaaaccctctctctactaaaagtacaaaaattagctgggcatggttgtgggtgcctgtagtcccagctactcaggaggctgagacaggagaatcgcttgaaccagggaggcggagactgagtaagctgagatcgcgctactgcattccagcctgggtgaggcagagttagactccgtctcaaaaaaaaaagtaagaagtgaaatatttcaaggcgggcacatccacaaaacaccagaaaaggcaatgctttcacagagaagacaaaccatcttcttttctctcctcggtcagagaccatctgatgctctagacagtggctgcagtactggcaagacaggcaagtcaaggaggtaacatggacgaatttgcacaacttagaaaagacctgtaggtataatgttaaaaacattcagcccggcgtggcggcctgagctactctggaggctgaggtgaaaggattgcttgagcccaggagttcagctgcagtgagttatgatcatgccaatgaatagccactgcactccagcctgggcaacatagtgagactgcagctctaaatagttttttttaaacttttttttttttttttttggagacaaggtctggctctattgcccaggctggagtgcagaggcatgatctctgctcactgaaacctctgcctcccaggctgaaaccatcccccacctcagcctcacaagtagtgtggactacaggtgtacaccacacctggctaatttttgttttttgttttttggtttttgttttgtagagacgggatttcttcatgttgcccaggctggtcttgaactcctgggctcgagagatcttcctgcctccgtctcccaaagtgctgggattacaggtttgcaccactgtgtccggccagcaagtactttggaatagttccttattccgtctgcaaaggacggttcctagggcttagcaaggggaatttgaactgttaaaggaaaaacctaagcctaaagtattaaactatggggaagggccaggtgcagtggctcacacctgtaatcctagaactttgggaggccgaggcgggcggattaccaaggtgtgcctataatcccagctactctgcaggctgcggcaggagaatcgcttggatccgggaggcagaggttgcagttagcaggccgttaggaaaggtatttgagtcctgtgactttccactatccagcaaatcacatctggtagctgttattctccttattaaacacagatatccatgtagataagcataatcttcccttcatgcttttcctttccttcattcatttccttcattcagagccgagatcgtgccactgcactccaggctgggtggcagagcaagactccgactaaaaaaaaaatgaaaataataataaactatggggaagaataaagaaggaattgcctacatttagagggaggtagaagaacaaaaagaggaaaatatataactattttaaaacctttttaacataagtctttcaaatcctagaaacttgggacttgtgtgaggggaggacccttctctcactctgttatactttctgaatgttttcaaaagcactgtagacacggtgatgcttagaactgggggaggccaggcctcctggaagaagtttgctgagggcctgtggatagagaagcagaaacaggaacacagcctggggcaaacatcgtgcggatgatgggcatctcaaacactggaaataaatgaggctgcgggagcaaaattgctggttcccctgctgagcacacctgccctgcttggaacaagagcaaagatgtctggtgggggagccgatgtgagatggatggatagacagggcccccagcctgggggatgggaccagggaccatttgtgagataaacccaggtattagcccagggcagaggctcccagctgaccttaaaacagaggcagcccagctccacccagcacttcttcagcaggcctgggctgggggtcagagaactcgcatttctaagatgttctcagactgagggacccagtggaaaagcgtcctgattactgggttataaacacctgaagagttctgaaagaaatgggccacaccctcaggatccaaagtcttaaaggaaagctgaagaggtgtcctgtgagttcaggggcaccccggtgaagcctggggcttagaaagaaaagaagtgtttataccaggagagcagagagcaaggagcagggaggggccagggcagcccccaaaccggagcccgaggccggaccctgcctctgacgaggagcatgcccggccaccatgctgacccctgcatccttctttctttgtcccttgaagcccctcaaagtccttcctgagacacatcccctcccaaggcacaccctggagggtctcaagacttgaaaatcagtcaagaagcaggcaaggagtgagctgatcactgtagttaaagagacggcaccaaagacattgtacaaaagagggcaggaagatgtccatgtgtctgcaccagaccttctgcgccagtgagggatgctgcaggcaaaggcagggcagatggcaagagggtccctacccagccgcagcacccggcaatgcccaccagagccgaccccctgcccgtgttctgtgagtccacgtcgtctgcatcagggtgctgatggcaaagcctccgggtgtccctccgttgcagggtctactcctgcagtgtggacagcagagacggaggaagttctcccaagtgcggggaggtaggctctgtgggaagcccttcactcaaaggcacactcatggttttgttaccagagcagctgaagaattcaaagtagcttctgagaactctaactgtctggaccatgctatagtaagggctaagctaacttaagagccatccaaaaaaaaaaaaaaaagaagaagtgaaaaggtgattgatgtcagatgtaaacccaagagggtaacacagcaatgctgagacatccgaaacaacttcctattagctgtccaggaccttaacccaggtcttaagggatcctgtcttttttagtctaaggcagttgaatactaaattattaaaacaggtcttattttatgaccctaatcatcgacaagaggcgccttttgttgttgttgacacagagtctggctctgtagcccaggctggagtgcaggggcgcatctcggctcactgcaacctccacctcccaggttcaagtgattctcctgcctcagcctccagagtagctggggttacaggcacacgccaccatgcccagctaatttttgtatttttagtagagacggggctccatcacattggccaggctggtctcgaaccctgaccttaagtaatccatccacctcggtctcccaaagttctgggattacaggtgtgagccaccgtgcctggccgacgaggcacttttccctcaagttaacaaaaggaaaagagaaaagagaaaccttctgaagacaaacaatagataattgggtgaaagatggatgaattctccccacgtctgtaactcctaagaaacagaggccctatgttctgcatgaggacatatccgttgttcacaatccccacactcagctgaaaaccacaaacccacccagagggattgcctttcttcttctccatttgggtacttgctctccagctgaattccactttaatttcatcagtgaaggtcagttcaattggatagactgcaagctcttttcagaatgtaagggaggattactctgtgagagatctaatcatttatttttaaaataca

SEQ ID NO: 126 - DNA, 2679 bp, Homo sapiens
gtaagtcgtggtgttccgtattgctttggatgtgtagcccaggaataagatggcagcactgcaggattccggagccacccacagcaccgactgctgctggagatacacaatcatgggcactcgtgaagctgcagaaactcacggggaccctgacaccagctgctccttggacagagggaggcccgtcatctgggtctgaaggaggctcccaagactctgacacagaacactaaactccagggtgttctaggacagtgacaggcaaggctgttctcaatcatctcctgtctgacacggacatcgagctaagctatgagcaagggcgaacaatgcctctcagcagctcctcctccttgaccaggctcccgaccacggagcatttcagtcaaggtctagggatttgagggtggaaggagagaatttcatcactggggaggaactcccctcacagaccccccagggccactcagcttcaatcagctgtaacccagccccaacatctgcaggccactgcgcagggagtccacggtcagcagccacctcagcacacctcctcctgtggccacatcttcactggtttctggaatccaacctggggccttcctgaagccaagtgagaaactcaggacaaggcttctcttctttgaaagccacatcaagtagcacaaaggactgaggtttgcagctattttatttacaagtatacatttaacacaatgaaataaacactgatatactgaagcctagttaatagtagtgtaacaatatgcatcattttgatgattacattattttaaacaacaaactacactgaaaaattaatgccgataaaattcttggtcataatattaagaaatacaatatataaattgaaaatatgattgcttaaaatttgaaaatggaagtgaactcatttggacagactcagagttaacataatctgaagggaggggagctctgacccaaatgatatctttcaggttaacagaagaaaaaagaagcatagtttatcttcaaggagaacgggcagtttgcttcttcaggtagaatatattcccagtgtcctcaggctttgcagcagaatcacatcaccgagcatgaagacttgccttgtgaagctgccccgtccattttttctgcctccaaaattatccttcgaaaaacatccacagcagtctgaaaagagaaagaaacccaatcacagtgttagtgtgaagccgaactccgagagtattttacggactgaggagggcgtgccgcctgccctgccctcctactggtggaggaggaggggttctggtgagccccagaacttcagggccccccgacgcccagtaaggccactgtccacccctcctgacccagaccataaccagcctccgattgtgcttttgaccctgtttccttcaggcaccaggagacgcccgaagagtcctcactcccagactcaccaccatctcctgtcccactccaccccatgacccccaccccagtgtcctctgacctcagggtccctcttcacttctggcactatctttcctcctttcctacgggacatactctcccagcagcccttgcctctcacatccttgacactaagaggcctgaagtggggaaggcaccctccgtgctcctgagatgccacgatgccagcctccaacacctctgtggcgtaattctcggtcatttcaatccacaaactgccctccctatctcctggcctctcctctcctgcccgtcttcctgccctcagcctcagcccagggtcaaccccaccagtccttcaccacagacaggaatcatggccacttggagcaggaactcttcctacactgagtggggaggagaactgtcagaccctgtcctttatttttccttttttgttatacagattggaggtttctatgttgcccaggctggcctcgaaagcctagcctcgcctccttatgcaccaggacaacaggcctgagccaccgtgactcccagaccctgtccttgaaatgcagtcctgtggtcatgaaaaactgcccctgttctcagaagccccacaggaagtaccctgttctcctaatcaccaagaatccccctcccccatcactccagtgacttccactatcccacgaaaccagaacacaccaactgccagcgtcccaccacaccaccttcccagctctttctctagctatcctgaagcaacaattctcagccccacaaggggcctgatttgttgaccctattattacatctcccctgtcccttaaccacttcttgctgctcctttccctctcggtcagctcagactcagcaggccaccatggcgccactgtacttcaactcccttccctaccaactgtcgctggcacggtgcccgcggccacaccgtaaacgctgcccagggaaaacacacaccgctcactgctgacctcacacccatgaccaggaacctggcgcagacacttggtgctgcctagccacccgcctgcatccctggatctgggcactccccagagaaagcatccacgccttgtcccttctcctcaaatgttccccgtgcttacgctcagctgaaaaccttgttttacacacttcactggaaaacagaagccacattcatgaaagaactccacatcctccatccaccaagctgacccacccacttgaatgtgggctcccatcctc

SEQ ID NO: 127 - DNA, 7063 bp, Homo sapiens
caggagcgggagccgagcctcgcggcccggggcacggcgccgcctgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttatcctggcccagacgcggctggggcggacgggacctctcgcgctctgcctcctcctcttgcttcatggagccatgcgcctgggtgggggctcccgagagaagctggcctgcgggcgggccggacgcgctgcgcggacgggacggggcgaaggaggccggcaggcggaggaggaagcggcggggcggcggcggcggcggcggccgggaagaactagaggtattccccgggcggctggaggactgagtcgagccgggacccgagtcctccggtatcccagcagccaccggaggcagtgaggtaatggaggaagaatgtagggagtcctccggtggaccacactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagatatcgggggaaagccgcgagaaggccagcgtccctcgctgggagcagagctagccgagtagggcgcccggctgtcaaactggccggcgcagtgcacgctgggccgccccggagcgatcgcagagcccgtcgggagtcgtagtcccggacgggcccgcggcatcgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctgaccggccgcagccttggataccagccttaaatcgagccgactacggcccagccccgcccgcggcgaggtgcgcggggttcggtgcgagcccctcgcccctggccgggccagcctcttgatgcaccggggacgggcgcgcccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaacttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacagccccatgctcacaaaaaaaaaaaaaaaaaattttggagtgtaaacatatacatcatcttaatttgagtccttatgtgttgacggtgtgcagggaagaatgggaaagtaactgtaagtggagcccagaaagaactaacaaattcatgaaaaagtgacattattgctggtctattttttttttaattttctgcttcctcacactctcccatactaaatgaattatttagtggttttttttttgtttttttttttttgtttttttttgtgatacggagttttgctattgttgcccaggctggcacgatcttggctcaccgcaacctccgcctcccaagttcaagtgattctcctacctcagcctcccaagtagctgggattacaggcatgcaccaccgcgcccggctaattttttgtgtttttattagagacggggtttctccatggtggtcaggctggtcgcaaactcccgaccttaggtgatacgcccacctcggcctcccaaagtgctgggattacaggcgtgagccaccgtgcccggccgacaggtgttttttatgagttacagactatgtgctttcagaatgaggcaactgatttaaggatgtaagcataatttaaggatattgaaaatgatataggaataaatttgtttagtcattcatggatttattcattttcagatgactatgtgtgtgaatatttaagaattctaaaaccgcatgggattacttataactgtataggagcctaacacgataatggaatcagaatatactttgctgaaggtatgaggcttttaactgaaagtcttctctctacgtttttatgtctgtaacaagaatccactgaagacctacatttcccggaaggttaacagcccccttctcagttttcctggtaaagtgtttttatattggtagaataccttctgtcacactctatatttttcttatctcaagtagaaaaaatttttgcccttttgcttgggactgttaacagccctggtagtggaaaagtagaaggaaatgattctgtgaattttctgttatataaattttagccagtttaggacttttgaatgaggggccatacagccaaggatttaggatttcagctcaggaaagaaaactacataggtgtttaatcgtgtcctagccacttattagctgggtaactttgagcaagttttatacatatccttcccatgagtttttcatttctaatactggctgtgtaatacagtatgtttcataggcttgctgtaataatcgatgggatgtatctaatagtgtttattttactgtaactgggccacagttaggaagttctcaattaaaattagctgtcattattcctagtattaatatggtgatgaacagctaaagagcatttaaataattatcattaatatggataaattttgaccatacctgaataaatatttataatataactgttgagagtatacaagtttaatattttagggaaatacaatgtcaaattctatcaagctctattctcaaactaaaacaatagcagtttgctttcagatattttgaatattattgtgacatttcccccttctacctttctgggaccttggacacaggaaccatgtaagggtaaatagtctaggtcttcgttgtgggacaggggtgatatactacagttccacaggggctgagccaggtttcaagggtgagatagagagctgatggtaaaaataacaatgagagcaaaggccaaaatgtatggagtatttattatgtgtcagacatttttcactaagcattctagtacaatatttcttcagatctatgaagatcttaatcttaagtagtaaatggttttattataaccactatacaaaatagaaacactaacataaaaaggttaaataatctgtttaaattatcttggattatcaacccaatcagctgtgtcctcagaacagaagctggtagcactacactgaactataccacacttgcaagccttcagaggaaaattccctaagagaaaatggtatctatgactcaatatttcttcccataccctcagtgacttacggtatttatttactaaatgccaaagcagatagtccaataggaaatacgtagctaaatggcctgcgaagagaagggaatgtcaaataacaggcaaaatagaatctgacaccctaggtctcagcaagtgttttgaatggacaataaagaaagtgactagaatgtaacctctgaaaaaatgttgtgaagcaccaatggccttgaaaaaatctagggagctgatgtaaaggacatccacttcataatgacaattattgaacaaattacttgttggagatggagttgcagacaaaacaaatatttaccactgctttaaaatacatttattgtactcaggagaagagtctggaactgtggtttcagaatgagcttatccaaaagtaagaagaggactggggcataccttttaaaataataatgatatatttataatcatcctagtatgatttatttaccttttagtaaatcaagttctcagaaaactaaagtaaaaaaatcttaacattacatatgcaggacttaatctgaataatcataaattttcataaacttaatttacataccacaccatagtagctgtgatatagtaaattaataagttttttgtactatggtgtagctctttcatcctaagaataaaaaagattctattatgtcaaaagacatgcatctggatggttaaaaaaatccaatcatacataactgaagaaaatgtaggtattttagtggaataagaatgtgatatatgaaaacagaaaaataaatatcttcaatgttacttaaagaaacagaattaacaaagatgtatcatggaagagaggatagttctgtaaaaacacgtaaaataactttcaaagatgaaaattttacatatgtaaaaacatttgtcaatgaaagtaataataattccattcatgcatttgttcatgtataaccaataacttacttgtgatgccatagaaaaaattcaagcatcaaactgaaaagcaaattttaataggtaagaaactagtggcctttaagctgacaatatatttgtttgaataaaaaatattattattttaaaataatcaaattagcaaaatacaaaaaaaagaacatttcacatgaacatcttaatttttggtatgtgtttaaatatcaggacatttactcatattcttcataaacagagttcataagtcttagtagatgctgccatgtgtaggcgggttgtcttctctaattatcctcagtccccaccattccatagtgcccccagtagagatattactgacatttttcatttattgccataatttagctgttgtttttcacagtcagcttgccttctttattttaatatttatataccacgtaggcatctcagtgtttcactcttgctatgagacagccatagatctcttttgacctagagttttttattctctttgtttttcaaaattattttccctaaaagcatggaacctatgagcctccaaatagtgcatttaaactcaatcacctctagaaaacaatgctaaactattcagaaagaatgaagagaataagtgaattctccaaacccagagctaatgagtgccagctctgaaaatgaggtccttgattcttgacatctggcctagtgtgcctaggaagtataatcagttactctgactcagtcattttaataattgaagtaaactacttaacagttaaacattatatacttaaaatacttaaattagcttagatataatcgaagaatttcactttttaactccaaataatgaagtgtttggttgtagggtattagatctttcatggaagaaagtagtcccgtaagtctaagtacaaatttcaaatgtaaaataaaactgatcaagccagagaccaggtttggcaaaaagtatcatttgatatgacttgtaaaatgtcaattattgtgaacaattttaaaaagacctcatcagaccatattgcatgttctcgtaaaggggaaaagaagtatataacagcatgtactgaatactttatacccattatacatcgggctttttagattcattctaccatttaatttttatggacatgctggggatacagtattgttatcatccttattctttagtgagaactgagatttacaaaagaataagtaaattttccaaaattaattactgataatgtgtacacagaccatttccaaattcatgagataattgctgttttagttactttgggctgttaaaacaaattaccgtagactgggtgacttaatcacaaaacgcgtgttctcacagttctggaggctggaaaatttaagataaaggtgcttgcacatccagtgactgatgagggcctgtttctttgtttgcacatggccattttctcattgtatactgacatggcagagactgagagagagaaagagattatctctttgatgtctcttcctataagagtattaatctcattcaccaactaattacttcccaagggcccaccactgaatactatcacactggggactagggtttcaccatacgaattttgaaggcacatagacattcagttttagcaactgctaacaatattactcttacacaaccatttttctcacttaaatattttcaattatttaataaatggaagcagtgggattaccttggtatggccataagaatttatctgggagatgtctatgtgtgtgtgcatgtgtgtgtgtatgtttatcgtggggaagaagtttgtgagtagaagcagcggattgagaatctggataataagaaaatattctattgatcctggtgatttgaatgtacgataggagctggttgtcaactgatttaatcagtgggtatttcagtatgaggcatagttggtgactgagctttcatgtggtaatctgaggtgaatattgacatagaattagaattataactcacataaattcacacaaaaacatttttacattgcctactgatttttatacatataaccaagaaataaagtatatgggggccacctttctccagggatttatagggtaattagatgaactctaccaataattataaaaataagaactgaaataacaaatgcatattctgaattacaaaaatcattcaaagtaacaaaaagcctatatctttgatcccaataacctattttaattttctttttaaaataaaagtgttagaggcaaaaaacagccataactaaaccaagtacagataaaggaaataagaatgagaaacagtgtatgtgtgtgtgtatgtgtgtgtgtgtatatgtgggcatgcctataggtatagttgtgtgtgaatttaagtgaacacacttactaattgaataaaatacagtaagtgt

SEQ ID NO: 128 - DNA, 2850 bp, Homo sapiens
aaaggtaacatctacctccagaggtaagcataatttggcaaatatggaattgcctatacaactgctatgaataattcttagatgatggccaggaaagtttcctaaaaatagtttctggatgggagtcagcctcccaaagtcctaggattacaggtgtgagccactgagcctggcccaaaatgttttttaaaaaacaatgtatgattaaggatcagccatttgtttttaatgccttttaagtttctaaatctataataaatagtgcctccttgagtgtgtgtatgtgtgtgtgcctgcatgcacatatatgacactaatttttcaaataaattgggctatgtccagatgtggaatctcactcatataatcccagtattttgggagtctgaagcaggaggattacttcaggccaggaattcaagaccagcctcagcaacacagccagacctcatctctacaaaaaataaaagaaatattagctgggtatggtgatatgcacctatagccctagctactcgggagcctgaggcaggaggaatgcttgagcccaggagttcaaggctgcattgagcttagaaggcatcactgcaccccagcctgggcgacctcatctctttaaaagagcaagatcttatctcttaaaaaaaaaaaaagaaaaaagaaaacaaattgtgctagtagtcttgtagaacgtctcaattctgttttctttctttttcctttactctctgtatttccaataaattagaaattagagctaaagggtgattaggtccaggttgaacatttttggcaagaaaacttcctagatgatactgggcctgatcacttggctaaggtgacaacagccagacccctccaatggaagggaatgctccctctgccacagtgaatagtctatggacataccctctgaagcagcggaaaacctagtttcccatcaacctttcacctaatggttttagtatttactggagatccttgtctgaatcaatgatttcattagggactgcaaaatgatgatttttgaatcccatcattccttttgcatacatcagctgacatactctgtaaagagctttctctcatcaaatggggttatttggttatcttgagctcctattaaaaaaggcagaataatacttctctcattttaaaattctgatattcagaataaggagtattacaataggagattttattttgctttgcctttttatatttcctcattatcacccaatgacagtttctataaaaaaattgcaaactcattaagctaggcatctgaaagttagtcatttacccaccagcttctaacacgaaaacacattccttataatgttctcatgatggctggaagaaacagtgggaaggagagacccccaaaattgtttatattggctatagccacactgagtttccatggctaacaaaagctcaagataaagtgcttgaaataaccttgacacaattggtactgatagccatgttgaaccctttaaatgtaaaacaattctatttatataataggggtttatgtcaatttataaaaacagtgcttactttgcaggcttaatgcgggatcagaaatgttattttgagaaaagaaaaacagatgataagtttgcttaagtggctttgtttaaaaaggggatgaaaacagttctgtatacttgattttaaaaacagaaaaccattttaacagaaacccacaacaaaactggctataaagatagattccaatataattatggaaattcatttgaagagattgtttctaaaagcagcccatactgtcctcatttgtagcaaacagaagaacatcaatttcaaaagacaagtaaaattaatgaaaggaaaccagataagaaaaattgactgattcttatatttctgggaaaacggtgttataatttttttttgaggaaaatgtatgactagaaattaatctcaattggagagctttaaaaaggcttttcttctccgttctagaagaccaaatttgcatgtttctctataattctgggacacagatttgaaggcagtgcaaagccccagaatgtaaataagaattctgtcctccgatcagttttgcaggagggcagaggctggggagatttggtctgatgagaagcaacccctgcatgagggttaaagcctggaatctgtgccaggcccacagacggtggagttgctagattttagtttctctgacatttgaaaaataatactgaagctcttgaaatattattgtacttttaaactattttctatatagaagtgagctatcttttgagtgaaagagacaaacaaaagatctatttttccaagccaatgtgaacaagtcaacaggagcaaagaaattgcactctggcaactaaacaaactgagtcacagtccatgtgggagaagaaagagagtcagcattgtttgtgcatcagtatcactagttttcagctaaatatactagctggacattaacaagtatattcttacactttttggaaatatctaacaataaccgttagactcagctacttgctaatgaaatggctcattgatgtagctaagagaagctttagatcatctgactgagtataagaccagctgactggctgggcgcggtggctcacgcctgtaatcccagcactttgggaggctgaggtaggcagatcatctgaagtcaggagtttgagactagcctggccaacatggtgaaccctcatctctactaaaaatataaaaattagccaggcctggtggcgggtgtctgtaatcccagctactcaggaggctgaggcaggagaatcgcttgaacccgggaggaggttgcggtcagccgagatcgcg

SEQ ID NO: 129 - DNA, 2296 bp, Homo sapiens
gacaggatccagagacactctcagtcttggaaatcctaccaacaaggattcaggaaggattcgccctcaggctgattctggaccaaaacaaacagaacattccacctggcagcagccaagtccccagcactattgtgccaaggagactctttgatttgcctcaagcccagagaataaactacgattccaggggacagctgactccagcccatctaccatgctccagtagagaccttcaggtgacccaggtcaacaccaagccaccctctggaggatctgatgctgcctcagaaacaacacctcatgcctcatcagatactaatggaaatgttgaaaggcttttataaaactccagggaagtggtttgaggaacattgagaaagaacatattgttccagcaggaaactgagtgcaaggcagacactatggcaaaattccagttacaccagaattatcctcacagtactttacaaaatcctgtctgggaatctccactctttcctcactgtcgcccatgcaactataccatcatctagatgacttagggagattctccacgtggtagagactaatctggaggcaagaagtccaggatcaaggttctggccaattcggtgtctgggagggctctcctcctggctttcagaaggctgtcttcccactgtgtccttacacggcagagaaagtgtgagctctctggtatctcttcttttaaagacactaattgtatcacatcaaggacccacctttaagatctcatttagccttaataacttccttaaaggccccatctgtaaattctgctgcattggtgactggggcttcaacctaagagttttggtgggacataaaatctcagtccataacacctggcaaactctcttaatcttctaagatataattcaaaccttgtttcctttggaaagcctccctagcccctaaactataattagatgttttctcctcaatcttcatattagttcctatcatgcagtattaattacattgaacaataattaagtacatgtttgttcccctcattagactacaggacatttgcattactctgttttcacattgctgataaagacatacctgacactgggtaatttataaagaaaaataggtttaatggactcacaattccacgttattggggaggcctcaatcatggcagaagatgaaaggcacgttcttacatggcagcaggcaagagagagaatgagaaccaagtgaaaggggtttctccttgtaaaaccatcagatctcttgagacttattcactaccatgagaacagtatagaggaaaccgcccccatgattcaattatctcccaccaggtccctcccccaacacataggaattatggaagctacaattcaagatgagatttggatggggacacagccaaaccataacaacattgaaaatcagggacagtagtttgtttgctttttatccctaacacctaggacagtgcctggcacaaagttggtgtttaacaaatacttaaggaaagaggaaaagaaacattacacctctagaagaaagtgtaaattttccaaacaattgaattacaaatgaatgccagaatatccatcatccactgaatttgtgtcaatgatatataaattcaacttccagatgtagtggttaagagtgtctgggttaatagaatactatgcagtcataaaaataatgaactcatgttgtatgcagcaacaaggatgcagttggaggctgttttcctaagtgaataaacacataaacagaaaaccaaataccacgtgttctcactaataagtgggagctaaacattggatacacatgaacataaagatgagaataatagacactgggaatggcaaaaaagggaagggggagtccaagggttgaaaaactacctattgggtagtatgttcactatctgggtgacaggatcaatagaagcccaaacctcagcatcatgcaacatacccttgtaataaacctgcacatgtacctcttgaatctaaaataaaataaactgggggggaaggggaagaggagaggtggggatggttaatgggtacaaaaaaatagaaagaatgaataagacctactatttgatagcacaatggggtgactgtagtcaataataacttaattgtacatttaaaaataactaaaacagtataattggattgttcataatacaaaggataagtgcttgagggaatggataacccattcattctccatgatgtgattattatgcattgcatgcctgtatcaaaacatcacatgtacgtcataa

SEQ ID NO: 130 - DNA, 1963 bp, Homo sapiens
tacaattttgagtaataagaacagaaatcaaaagtaactgttgtatgttatattttagtagaggaacactgaagaagaatgaaaacaagaaataatattaaatatgaacatatggagaacagaataatatttctaaaatttttagtttctaagcttatctgaaattttaattttgttttcttatgtaataccagagttattaggaaggtattatctactaacactattttcagtgatattttaagtagttgtcctagttaaatttctattttttaaaaatgtatatttaaaaatacattaaatgtgtatatacatcaatcatatgtatcgatttctgtttttcttgaattgcaaatgaaatttgtatttttgtgttcctggaataaaataaacttgaatggattgtaatattttattcatgctgtaattcaatgtatttgaattctttaagaatgttacatttacagttaacagatactgacctataaattttctgtcatataatgatgctgtgagacaatctaagaagaattaaaatttaaattcatgtattcttacttttttctctgttctctaactgtaatatattttaattacagatggaggaacagacagatgttagataaatagatatataatatatagatcatccaaaattcttattcttatggttttatgtagtcagtatttacctctatttttctacatgtttatccttccaatttagttcattatttcctgcacctttgatttcatatatataaacaggaaataacacatggtggccgttatgtagagagagccacaggacttgtgaataaaatccacaggcaaggacgtggcgattcgttttgcaatattggagggaatgccaaaccctatgtttgctgtggaaaagagtatggtagttcctcaaaacatcaaaatggtattgccttacgattcagcagccccacatctcaagacagcaaaagaattgaaagcagagtcttgaaaaaatatttgcacatccatgtttgcagcagcattattggcaatagctaaaacgtagaagcaattgaagtgtccaacaacagatgaatggatatgcaaaacatgatatatacatacaatggtaaatcattcagccttaaacatgagggaaatattcagacatatgttgcatcttggatgaaacttgaggatattatgccaagtgaaataagttagtcagtgaaggacaaatacagtacaattccatttgtataagagacttaaactggacagaatcatagagatagtacaatgatgaatgccagaagctggggggaggaagacatgggaaagtactgtttaatgggtatagagtttcagtttcacaagatgaaacgagttatggagatggatggtagggacggctgcacaatgttatgactatatttagtaccactgaactgtacatttaaaatggttaacagagtacattttatgttatgtgtattttaccacaataaaaaaataaaataccttaggaacattttcctgaaagagtccacataaaattcattttaatgcatgtgtttatgcatagctttctatttttctcttttctatttatattccaaattagaatataatgctaatcaagcatagtggctgtgtttcttgcttcctctagtctgcaggtagcatacaaatgtaagaaactactaattaatgtcacatctatttattttctgctttataccaagcttgtgggattctcttaaatacaacatttttatacttacacctatgaaatacccattaacatcgccttcctaaatcagtggaaattgagtctctgtaaggtgcagtaacttactaagatacaaaactcagcatttaagtctgtatacttcaatatcctgccctcttctcatttgtctttactgccttttatgtatgtgttagatgttcaataaattctcttttttaaactgaa

SEQ ID NO: 131 - DNA, 3928 bp, Homo sapiens
atttattttatttatttatttttattttttatttttttagataaggtcttgctcttgcccaggctggaatgtaatggcatggtcgcagctcactgcagcctccgtcttctgggctcaagcaatcctccttcctcagcctcctgagtagctgggactacaggtgtgtgccaccactcccagctaatttttaaattttgtgtagagatggggtctccctgcattgcccaggttggtctctcaaactcctgggttcaagcagtcctcccaccttggcctcccaaagtgttgggattataggcgtaagccactgtgcccggctgttttttgttttgttttgttttgtgttttaattgaacggactgaagtttactttctaactaggttagccctccattcatacaaaattatgagcccaaatgtcttggggagagtacaggagaggccagatcttaaaagccaggagtggaattaggtttgagcatatgtagcaatatggaaacaaagagtgagtcaatttataagcataccaatcttcttggagacaaaagtttgaattgctcacgtgtccattttttttctggaatccctgaagaaattttgagatactgagtactagaaaaccctctttgatgagggttgtatactttatttttaaacagtatcaacaccgttgaggcccttcaagtctttgcagtcaaaagccatacactttttctttgagtgagcctttactttaaggtatgtagtagaataatataggtatctgaaaaagaacttggttcatgacatccactcattcatttatgcacttagcaaatattcattgattgccaaatacgcatcagacactgagctaggtgctaggtactaggtaaacaaaattccctgccttcatggagcttagcttgtggtggtggaaagaagccctcagcctgaatactcaacttatgtctgccgtttattccttaacacattaaactataggtaatagcatatgttagtctaatctttgtttagcaaagctatttcttgttctggaatataagtacagttacagcagaataagtaccaaggcaagattggagaatgaccggttgtgaacagggacttaggaatatgtgtagcataggattttattttagagttgttaaaatcagatcaacagagcatgtttttatgggccatctgacaagactagaggtagctttggaacctcttattccctggaatgcaaacatgtatttgcatttcatccactgtcagtatgaggagacaaaaacgaagtcaggattttggagctggaatggatcttaaatactatgtagtccaaacgtttggttttacagatgcactttttccagagtgctgtcatctcatatacttttttcttcatacaggtttttaatgtaactcactcagatcgttggtgatagactctctcttaaaacttatttatcctaatcttttttttttttttttttttaagagacagggttttgctctgctgtccaggcacacaatagctcactgtaacctccaactcctggagtcaagtgatcctcctgcctcagcctctcaggtagctgggactgcactactagtgcactaagctaatttttaaattttttttgtagagacagggtcttgctgtgttgcccgggctgctctcttaactcctggcctcaagtaatcctcttgccttggcttcccaaagtgctgggattacaggcgtgagccaccatgcttagctgatttgccctaatcctctgctgacattctgatatcggacaactaaaattataacattgggcagctattttgtatgatatatagggtagtggttcttaagcttattggtgagtaaccttcacttgggaagcttatttttaaaaatgtagaccttcattactttcctcctgagattttgaatcagtacctttgagagagggtccagtaaatctttgttttgaatgaactgatggttttgaagcaggtgacctggaggactgcatgtagaacacagtgatgtcaaggagtaaaggagagaacagaagtgagattagcactaatcacctctaatgccttatttccagtaaagtttagagaagaggaaaagctacttggcttgctcctttgaaggttttgtttccctcttaacacagaaattaaaaggtagaggagagatgctgaatgatgctttttttcttcttaatcttggggggtcattatgattaagttattgaatccatatcaccgtatgacagcacatgatgaaagaaaatcaaatgtttgtttcaatcaaagtgaaacaaaatgagaataactatttgggcaaaacacttttatcactgctaagatattactagaactgagcagagaaatactcagagagagccatggcatagtactaattaataatggggtaccatttagcaactggaatattctccgatgatgcctgtttaattacccataggtgctaagtgaatgttaaaaattacggtgctggttgagtaggccgagtagaatttgtgttagggcacatcccatggagatcttttttactgcttaattttttggagttacctcagtaacttaacaggcaggaatatggttttaatggaaaggaaaccatttgcctttaacagcattagtcccgctaagagaaagtttttgcttgtctagtttattacaggtctttgactttgtcagtatatggcaaatttagtataaaagatgattaattatcaaggctgatgaaatataggcagctgaaaagaaaattcttagcaattcataccttagaaggaaccctgaaggacaggacgccatagaaatcctgtttttttaaaaaagtaatttcaagtaagtttgcaaatgcaatgctagtaaaaagtatatagaggtatgtctttcacactatcttgttactattagaatttttgtagccatgtgcagaggagagaaaaggtgttggattttctgcagttctgattcagttctaagaatttggtgtgaaaagaatgtttgcaaaggagcaggcacaaaggtgagaacaggaatacgaaacacaacatctgtaaatgactaaattcagagggaatttagtggggcatatctcttaaatggttttgaataatttggtgttttaaccaatgacttaatttaacttagtgggtatactgttcccagtcccattactgatttttattcctctgtgataacatacacccaaataaagactgctatgtatttgactttaaaactataaagatgtaaaaaaggttcactaagccaaacaccttagaaaatagcctcagctatttgctatgtttatattatacctgcataaaagtatttatgtatagatgtacttaccttacacagtaagtacctaaaatttgtaaattgaatacttttgaatgtaagcagttgaagtaaaacctgtagtgagttcttcagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcagttaacttaaaaaatatattgtgaccatttttataaaatacatgttcataaaacagatcaacatatttagcttatacagaaataaaattaagtcaatccactcacaaagaatttctattttgtaaaaatgtagcttgtatttcagtataataaaatctgatgtaagaaactgt

SEQ ID NO: 132 - DNA, 1590 bp, Homo sapiens
ttaacattttgattacaattccacatgagtttctgtagggatacacaaccaaatcttattattctctccctgcctccccaaatctcatgtccttctcactttgcaaaatacagtgatgccttacctgccatttccccaagccactatgctttttttacagcctgcagaaccatgagccaattaaactcctttttgttatgatcatacagaaaattagtactgtgaagtgaagctatgaaatgccttcagtgacttttccccatcgtcttggctaagacccccaaggtcttaactcattccagcatttactcaaatgtctgaagcccaaagtctcatctgagacaaagctgcagtctcttctgcccctgagcctctgaaatacaaagtaagttaactacttccaaggtacaactgtccaggcattgagtaagaatccccagccaaaaggaagattttcaccagatagaagaataaaatacaagtgggacttacaggtcccatgaaaatccaaaacccagcaggccagtttttcaaacctacagctccaaagtcatcctttttaaatccttgtcccacatccagggcacaagggtgtgagggctgggctcccaaggccttgggcagctctgcacctgtggctttgcagtgttcagcccccgcagctgccctcatgggctgtgctggtgttgagtgcctggagtttttaacccatggagggtatgaaacttttgttgggtctatgaatctgggatctgcacgatggtggcctccagtgtgggggctccaacctcatattttctttctgcactgccctagtagaggtttcccatgagactctgcctcttgggcagccttctgtctggacacccaggcattttcatacatcttccgaaatctatatggaggctcccaagtctctggactagtgctccgtgcacccactggcttaacactatatagaagtcaccaaggcctatagcttgcaccctctgaagcagtgacccaagctgtacctgtacatctttcagccaaggtcagagcaggagctggggctgctgggatgcaggcagcagtgtcctgaggctgcacacagcagcagggccatggggctggcccaggaaaccattcttctctcctaagtcccagggcttgtgacagcaagggctgctgcaaacatctctgaaatgcctccaaggcttttccccacattgtcttggctattagcactggcctccattttatgcaaatttctggaggcttcatgaattttccccctgaaaatcagcttttctctttgaccacttggccaggctgcaaatgttccaaacttttgagctctgcttgccatttaaatagaaattccaacttgaggtcatttcctcagtcacacataagagcacaggctgtttgatgcagacaggatccctcttgtgctatggtgcctagaagttcattccaccagatatgcactaaattatcaccctcaagttcaaagtttcacagatcttaagggcaagatcgccctgcagccacgttctttgctacagcaaaacaaaagtaaccttggctcctgttcccagtaagttcctc

SEQ ID NO: 133 - DNA, 2047 bp, Homo sapiens
cagagtttcactcttgtcatccaggctggagtgcaatcttggctcactgcaacctccgcctcccgggttcaaacaattctcctgcctcagcctcccaagtagctgggattacaggcgctcgccaccatgcctggctaatttttgtatttttagtagagatggagtttcaccatgttggccaggctggtctcgaactcctgacctcaggtgatccgccctcctcagcctcccaaagtgctgggattataggtgtgagccactgcgtccggccaagacctaacttttaatttcattgattttctgtgtcatttttatattctctatttcattaatttccactctaatccttctttgggtttactttgctcttcttttttcaatgtcttaaggtagaaatttaggttattgatttgagatcattcttcttttcctttatttatttatttagagacagggtcttgctctgtcacccaggctggagtgcagtggtgtgattgtagctcactgcagtcttgaactcctgggctctggcaaccctcctgccttggcctcccaagtagctgggactacaggtacacgccactgtgcctggttaattttttaatttttattttgtagtgacgggatctcactatgttccccaagctggtcaggaactcctgggctcaagtgatcctccagccttggcctcccaaagtgctgggattacaggcgtcagccactgtgcctggcctcattcttctttttaaatgtagacatttacaactttaaatttccctctaagcattgttttacttgcataccgtaagttttcatatgttatatcttcattttcgttcatctaaaaatattctgatttcccctctgatttcatctttgacccattggttatttaggagtgtttgtttttcacatatttgtgactttcccagattagttattaacttttactctagtgtgatcagagaacgtactttgtacgatttcaattcttttaaatttatggaagctatttttttttaattgaggcttttttttttaaagatggagtcttgctctgttgctcaggctggagtgcagtggcaccatctcggctcactgcaacctccgccgcccgacttcaagtgattctcctgcctcaacctcctgagtagctgggacctggtaccggtgtgcattaccacatctggctaatttataaattttttggtagagacagggtttcaccatgtttgtgaggctggtcttgaactcctgacctcaagtgatccacctgcctcagcctcccaagtgctaggattataggcatgaaccactgtgcccagccctaattaaggcttttttatttttatttatttttaattcatttattattattactttttgagatggagtctcactctgttgccgaggctggagtgcagtggcgtgatctccactcattgcaacttctgcctcccaggttcaagtgattctcctgcctcagcctcccaggtaactgggattacaggtgtgtgccaccatgcctggctaaattttgtatttttggtagagacagggtttctccatgtttgccaggctggtcttgaactcctgacctcaggtgatccacctgcctcagcctcccaaagtgctgggattacaggtgtgaatatatatatgtatatatgatggtatactactcaaccataaaaaggaatgtattaacagcatttgcagtgacctggatgaaactggagactattattctaagggaagtaactcaggaatggaaaactaaacattgtatgttctcactgatatgtgggagctaagctatgaggacgcaaaggcgtaagaatgatacaatggactttggggacttggaaggaagagtgggaggggggtgagggataaaagactccaaatatggtgcaatgtacactgcttgggtgatgggtgcaccaaagtctcccaaatcaccactaaaaaatgtactcatgtaaccaaacaccacctgttccccaataacttatggaaaaataaagtaataaaaattaaaaacaaa

SEQ ID NO: 134 - DNA, 2918 bp, Homo sapiens
ttacaagtgagtggataaatggtgagaatttatcacccctttgaatatcaggaagaagacaacgatgcccactctgttaccacctctaatcagcactgcactaggggttccgaccagtgtagaaaagcaaaaaacaaaacaaaaataaaaacataaagtaaaaatccagaacaacaggaatgggaaagaaaacccattactcatagaaaacatgactgtgtgcctaaaaatgaggaaacagctacaggcaaatgattaaaattactagactgccggatacaaattaatacacaaaaatgaatttccatgaaatggcaacacataattaggaaaatgaaatccaagcacatttttaaaaacagcatcgcaaaataacaaggacctaggattaaatgtaacaaaagacatacaagaccactgtgaaaagtatcaggctgtatgaacacccgctgaaggagccctaacatttggagagacagataccatgttcagagcttgtaaaacccagtactgcaagtacgtcaatgattcccaagttgatctacaggttcaacacaatcccaaacaaaatcccaactcgaccggctagttctaaaatgtatgaaacacaaagggtcaaaaacagccaagacatcctaacataagatggaggtacgcgccccagagtgtgtggtattggcagagacagacaaggagatgcagaaacggacacagagatcatcctgacaaaggaatcttcagcagccgggactgggaaaactgggcttatgtctgcaacacaatgaaactggatccttaagcttcacaacaggcgcaaaaatcaattctgggtagaatctatatctaaaatccaaaatatacaaaactataaaatcctttggaaggtaacagagtatctttatgatcaaggcaaagtaaagattattaaaaattaggatccaaaatgctttaatcataaaagaaaatattgatacattgggccatattaaagtttaaaatttctcttaaaagacaccattgaagtaaaaagacaagaaaagctatttgcaaatgtaattcacaaagcactactacccagaatcataaataacacctgcaaataaatgagacagaccatccaatagaaaagtagggaaaatacttgaataggtactttacaaacaggaaatcccaatgagccgcagacacatgagaaggtgctgaacaaggagaagccaatgaaaccagaaagaggtctaccccacacgttccaccaccccgcgccctccgccaccccgcgccctccaccaccccactccctccactaccccacacccaccggagtgaaggtgctaacacttcaggcaatgggtgctgaaaacatggaccggcagacgtggtcatacacaactagcagtcgggcctgcgggtaccaccactttggaacagttgggaatttctagtaaacctgttaaaaacatggttaagcagttaatggaaacgtgaacataatgggatataaaactaatgaaaaaaatcaaatggagtttttttgttttttttttgagacggagtcttgctctgtcgtctaggctggagtgcagtgctgcaatcttggctcactgcaacctccgcctcccaggttcaaacgattctcctgcctcagccccccaagaagctgggactacaggtgcccaccaccatgcccagctaattttcatttttagcagagatggagtttcgccatgttggccaggctggtctcaaactcctggcctcaagtgatcctcctgcctcagcctcccaaagtgctgggattacggtgtgagccaccccgcctagcctcaaatggaattttagaacaaaaatatacctaatttctgatataaaaaattcactatacaagcttaacatcaaattaggcaagtggaagaaaagattagtaagcctcgcaacaggacaataaaaccacctaaaggaaaggatgagagaacaaggatgaaaaagcatcacgtttagtgacctgagagacagtatcacagtctaacagaaagctaactagagtcccagatggggacagggaggaagaagtgagagacggggtcagacaagaaatatgagtagtggctgcaactttgccaaatctggtgaaaaatatgaactcacaggtccaagaagctcaatgaaacccaaacgaggtaagcatctataagcttaaagtggattaatattaacatcttctaatactcttacatacataaattacgtgatgacaaattaaccccatcccaaccctacagaaaataaatttggtatgacacattttcctgttaggaccacaactggacagagaggtgacacaagagggcagcctgaagcctagcaagtcctcttcggggaagagacagcagagtcccacctctgatttccccagggatacaatccacacgcacacacacacacacacagaagcacacacacacacagctagcagacacacacagctagcacacaagcacacacatagcaagtgcacacacacagcaagggcacacacacacacagagctagcacagagcattttcttcttaggcctgctcattcttcccaaatcagttgaacgtcatttaaaaaatgaccttgtcttaccaatcacagcaagtatgacataagatatgaagtttccaaactaaaaatctagttttgtgtcctattatgacataattttcagaactacactgcaaacaagagagcgagccagggcttgggtagatgtttccgctgtgatatgttaatatcataagacaatatttttaaggttttttcccccacatctataagtgtcacttgtgttaagtctttgaacttaattattcccactcacctatcatggtgcacagcttgttctataaaaaactcaatgacaaactcagttataa

SEQ ID NO: 135 - DNA, 1836 bp, Homo sapiens
gactgatcaggaaacttcctgacttgccaaaacaattgaatctgactctgctgcccgacacgatggctgtgcaaacataagtcatttcccctccccatttatccaaaggtcaatcgaccatgaaaaatacactggaagataactaagaagaatttaatcagaaaactgtgaatttggaactgaatgtagtaactgaaaacatcttgaagttgtctgtctttgaggaaggagtgggtacattttcatttatatatgggatagttctctttcttaagaaagtaatatttctggaatttatgaaaataagggttcaggaatgcacagggcagccaaggggtggaatgtagtggtgagagcacatctattttctttgggtctactaattcccctccccatttctatgtgttcacactgggattgtccatcatgatggaccatcatgatgatggaccatcccaatgtgattgtccgccctcattagttacaaggtgtttcagttatccattgctgtgtaacagatgacaccaaaacttagtggcttaaaacaaccataacgcattatatcccatgatttgtgggttggctggattagcttggccctgctgctgttctgtgtgattgttgtggtacattctgcaggtaactcatctgctgggatatatccaggatggccccgaaagactaaaaatgaaagctgcaaggtctctgacgacataatcccaaaagttatacagtgccacttccaccacattctattggtcaaaatgaatcaaaaggccagctcagattcaagaggagaaacatagactgtgcctccctcttaaggagaggagcagtacgcatagacaaggatgagagaatgttggtagatctctttgctgatgatgtattacacttcaccctggctacaaatatttatgtctctcatgtgtacaaaatactctcagacccttgcaagatccctgaagtctcatccaatcatggcataaggctgctccaagtccaaaatctcatcatgtaatgaggtctaggtgcagattaaacttcttaggtgtgatttcttgaatgtaatgccttgggtgcaacaccacttgatccagtggcctgggcactaaaaaaaaaaaatgatcctctgcataaacactcaatatgcaatgataagacaggaccaaagagctgcatttgatacttgtgtttatgaatgggaaaggaggaagaatgggaagcacaaagccatcattagccactctgaaatttagccaggcatatgtaacttgtaccctaaacttagttgcttaaaagagaaaactataacaatttattctttgttgatgattctatacattggctgggttttgctggatggttctgctccatgagccgttggctggtgtcactcagatagctgcaggactagcttcatgagcatgtgaccagggcattttaagggccctgtacttaaagggcctcaagattgaggtttaaagctttgtggtcactatcttaaaatagtgatcacatttatctttgaatttgtgtttcgtaaataataggacaactgaatattcacagagggcttggaacatgtggccctgcttcccactgtatcactcctgtctccccaccacatccccagacaggatttttagccaccttctccatgtaccttgatgtcctgggctccacctagcattcctctcttggcttctgccccatgaccactgttgccctccacctgggatggtgaccaggttgggtcagcaaggggaaagtctgttttctgccaccaccctctactctctagtgttggagggacccaggcacagggtgttggga

SEQ ID NO: 136 - DNA, 10782 bp, Homo sapiens
gatgggtcttgggggagaccaagggtgccctgctcaatgtcagccctgactctgtgccacgtgcactcagctctgccacggaggtgcatggctctgtagacgtggacggtgagctggggaggaaggtggtcttggagagaaatgccccatggggagctgagacctgtgtgtcatgggatcatcctggatttggcttaaaatccacgtggctgtggaaatcccagggtgcaccgaggatctgtgggggagcaggggtctcttaaattaccacggtgccagctacatggcccgggtgggtggttccccacactgcctaccccttcatacctcgccccattacaccctcctggaatcattctcactggaggctgcaccgtttcctgctgcccacgatgaacaaagcaggaaactgtcttttccagacttccccacgaagtgaggttttgacgacctcattctccaagagcaaacccagcccctggagtccgttctttccctgcgcgcgtggacacccctgcagcagtggctccttttggtggccgctcttcagacacgtgctagagagcaatcattgatgacaacgttttctttcaaaaggcccagaaaacaaaattaaatcttgggactcgaagcttcctgggcctgtgccacgaaggcccatgcttagccggtctggtgccaggctctgtgacgtgtggaaaccaggcccaccgaccacacagcagtggctgaggatggctccctcctcggctactctctgaaatggtagaggccactctcatggctgagtggtctccgccgttctgcagaggtgtggataagaacaggagttcctgcttgtctcctaggggtccgtattgaacgttggcaatcagtggaaatcctgtctcaggccctctcggggccccacactgatcattgtatttaaatcctcccagtgtcctgcagacacctacctcccagaccaaagagggaccttgctggtggccaggaaacaagctgaagcacagagaggagagaaagagacagagttgggtcctcgggtcaccttaaaaggctgtgagactttttgccagggcagggcctggcgggtggtggagatgcaggatgaaggacttaaggagggatcttttactttcagtgtgaaagtgacctgtgtttttatgagggggctagagaaatactcagaatctgagagcaggcagttggagtgggatctcagcaaacttccgtgtctgcatggtcctgcaaccatcgccctggacagaggtctcagctgggtagagatggacggttgtcagggcacagcctgtccttagggggtgctaggaatggggattggggtgaagaggagttcaggaaagaggggtgaggcatggggaacctgctggcttagaggatgcaaaggggcaggttttatggacgctttatgcaggtccctttcataaagatacttgcccagcctgagcagaaacccacaccctagagtttgtttcttccctgtgggcaccccccgcccccgcagcagcggcttctttcagtggcagaggctgactctttttgcagcttctccagcacttgcaaatgcaacttccttgcacccacttcagacactttacagctggaaccccttccttcaaggttaggggcccaggcccacagcccctacctccaagtttccacgtttgaagaatcccaaccttttccctttgcctcctcagcctcaggggtgacacctcagagctcctgtttacctctttagccaccaggttagtaattttacacccatgcaagtgtgtacaggaatcttccggatccaagtggctggtgtgggcgttgtcttctgtctgaaccctggcccttgtctgtgcagattcctcccctcctgtccgggagagaagagacagtttcgatgtcatgtggagacaggaggctgtggtcaacgaggggaggctgtggtcaacgaggggaggctgtggtggggggtggcgttctgagtcacttggctggcttgggaatgtgagctgggccaggtgcaccttagagagcctgggtggtgctggggaccttcaggctctggagtcctgggtgaccctgacaggtgcatgtacccacatctccttggcccctgtctctgttgctaatgtccctgcacagaccccccccagccgtcatttacagattcccagcagtgaagcacacgggcttaggttaaaatcactgagccccttgcacagcggccttctggtcccctctgctgtaaggcaggaccacctgtcagcccctgtcttctggggaccccactaggcctaagagatgaggctgtggggttctgtcttctggaggccccactaggcctaagagatgaggccggcggcggaggtctggcctggaagagaaatgtggtgagtcaccccaggcctgacagattcactcagacctggtccttctgctcctaggctgagccatctctcagggaccctcctgccctccttcacctctcacctggcctgccccaaccagttctccaggcaagcccaaaccagttccacctggtttgtgactgtgtttggaaagagggtctttgccgaggtaattaagttaaaatgaggtcatgtgagtgggccctgagccagtctgatgggtgtccttacaggaagacattaggactcccagagggtgactccaggggcaggtggcttggaggactggccgtgcaaggaggcagcaaaggggcggccatctgcaagctgagggcagaggccttggaggaagcagccctgccagtgctggtaactgggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaaggccattagggaggaaataagggaaacggggtgtgcgaagctctgagctttttctgcccggtttggctgaggacacgccacgggtgagcatctgcgcgaggggagcttggtgggtgaggaaggaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 137 - DNA, 2593 bp, Homo sapiens
gctggctgacattttcctgcccggaaggatgcatggcccggggtctcctgcacctgaggggaagaattggaggcgagtcacagagcgcagtgaaggaagcaagtttattggaatctactccgttagagagtgcaagtcctcagactgcaggaggaggaactcccgtccttcggtagtgtcactacttagaggcagctgtgaggagctgtgattaatcgtggaatgtgctgatgtgcccactaaagagctttgcccttggagtccaggctggagtgcaatgatgaaatctcagctgactgcaacttctgcctcccgggttcaagtgattctcctgcctcagcctcccaagtaactgagattacaggtgcccacacccgggtaatttttgtatttttagtagagacagggtttctccatgtcggtcaggctggtctcgaactcctgacctcaggtgatccacctacctcagcctcccaaagtgctggggttacaggcatgagccaccgtgcccggccaccattctaatttcttaatcttgtcttctttctctggcttcagtggtagatatttattaaccagtttaaacatgagtcattatttatatcaaatgtttggatgtataacgtaaaatgaaccttaatctctgtcaaaaaagatactactgggagcatcgtttggctgggagtcaagatgagattgagctactttatgggtgtggaatgccaagtcagagagatttgaataagtaacacttcagcaatatgagatctggacagcatccaggagccaaggtccaagatgctaataggagtgatgtagctgtccctgaacaaaggtttgccacagtttacgagcctcagaggttaagatgcaaaccagaacaatgctattggatgtgcaatccatgatgtttcatggggaggtgggtagatttgggcaaccttgccttcagtttactcctactagcatcaggctctgtccacctgatcagcagaggctatatggttctattttgtgaaaagatcaagttggaaatggaggagtagaggagaaggttggaaatcagaatcctcccacatgtattcttccctccattgagacattttatttgtatatatttattcctgaaaaaaaaaaaaaaaaaagagtcccaggattttttctcctgtgtttttgtcttgtttcttctcggtccatgatgccagttgaggtcatcagtacagcgaaaccaaactggtgagatgggaacaaattattctgtcacttttctagatctttttatttatttttttatttattttttgagatggagtctcgctcttgttgcccagtctggagtgcaatggcgagcctgggttcaagaccagcctgggtaacatggcgaaaccccttctctaccaaaaaaatacagtatttagctgggcctggtgcatgcctgtagtcccagctacctgagaggctgaggtgggaagatcgcttgagcccaggaggtcaaggctgcaatgggctgagatcacgccactccagcctaggcaacagagtgaggccttgtcaaaaaaaaaaaagagagagagagagatacaagccttcagagaccctcatattaacttcatggtaaatctgcctctgctcacccctcccacctgtagcaactaatatcttcatttccagatttactctgaaaaaactgtgcaactgcttcacatgtttcctcttgattcactaatttgtaactcacttactgaaactctgatgaaagaattgagtcaaaaaataaatagacctccttcccagccctggcttgttcagagcatctactacagaggagtcttaagggttttgtatgcttagagttgagagaccaaatagctcctgaaaactgtagctagaggaaatgccatatggagacaggccacaaggagaactcaagcccctgtaaaccaaaaatgaaatattctaagcccccaatttactaaacagattcaacctcccacttcagcctcccaaatagctgggattacaggcgcatgcaaccatgcccggcaaatttttgtgttttttgtagagatggggtttcgccatgttggccaggctggtcttgaactcctgacttcaagtgatctgtccacctcaccctcccaaagtgctgggattagtgagccactgcaacagccctctaacacttatttctgaagttttttttcttccctccttctcggaagccccttcctccctctcttgttgccttaaggtaccttcaccctggctaggccctattgttcttttatcggttttttgtttgtttctttagcctacatatgctcttccacctgggttatacaaatgcaaagtacaccctagttccatgctgggccttattattaacaagaactttctgaatctcttaagatgtagtgaaagcagatatacataaactatgttgaactaaactgtattttcttttttttatttcactttaaaaatttattttcataccaaaaaaatcattcaaagacagtattaaaaaggatgacaaaatacataaaattggcagatgtcttacactaaaataaagttggttttcccagatctg

SEQ ID NO: 138 - DNA, 4821 bp, Homo sapiens
tcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtgtccactagcttctggaacatggcagagaagaaatgggccagtttatttacgagatttgattgggaggatggttgccaactacaccctttctcctatcagaaggataagaaacaggtgtttcgaaagttgaacatgatggaacataactttggatgttagcagtaacagtctttggaatcacctgtagccatgccccaaaacatgatagcatgttgcaaaacctctagtgcccatggccataagggagaaagagcaccagaccatctgaataacgtgaaagtggacacaggaaacaccagacacccagagaaatggagtccaaatagaaactcagaccattcttgctggagatacatcaagtgaatacctttgtagatctggacctgacccaaggaagcctggatgatttgcaaaagttttccttccatacctctacaccacagatggattgaga

SEQ ID NO: 139 - DNA, 59461 bp, Homo sapiens
atccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgactaagaaataagtagaaaatgtgaatggatctgtaataagttaaagagattgaattagttatgagaacactagttgaaaagaaaagcccaagagggccagatgagtgaatctaacaaatatctaaagaatatcaattctttatgacctcttccaacaacaaaaaaatagaagagaaggaaaatttttccaatacattctttcagtccagtatcaccctgacaccaaaaccagacaaaaacatgaaaagagaacttataaaatttattttacccattttaggtatatagttctgtggcattaggtaaatccacgctattgtgctttatgctttcttgatgttgtaaatagaattgttttcttattttcagattgtttttgacagtgtataggaatactattgatttttgtatttcattacaataactgtgatgaaaatgatgtaaaaccctcaaaaccctcaacaaaatactagcaagtaaaatcaagcaatgtttaaaaaggattatacattataaccaaatgggacttatttcaggaatgcaaggttgaattaacatctgaaaatcaattaatgtaatacaccattatcaacagaataaaagacaaaacaccacgatttctgtcagtctgttcagactgttataacaaagtatcacgaactggtggcttataaacacagaaatttattttttgcaattttacaggcttggaagtccaaggtcaaggcactggcagattcagcatctggagaggactcgctttctggttcatgaacagttgtcttcttgtgtcctcatatgacggaagaaaaaaaggagctcactgaggtctcttttacaagggcactaatccattccatgaggtctccaccctcatgacctaaccacttcccaaaggcctcacctcctaataccaacattgggggttaggatttcaacatatacattttgaggaaacacacacattcagtctatagcaattaatgatagaataaaagacacagaaaagcatttgggtgataaaattcaacacccttccatgatgggagaaaaagccctactcaatatactaggaatagaaaggaacatcctcaacctgataaagggcatctattaaaaatcacagttggccgggtgcagtggttcacacctgtaatcccagcactttgggaggccgaggcgggtggatcacgaggtcaggagatcgagaccatactggctaatatggtgaaaccccgtctttactaaaaatacaaaaaaattagccaggcatggcagcatgcgcctgtagtcccagctactcgggaggctgaggcagaagaatggcgtgaacctgggaggtggagcttgcagtgagccgtgatcacaccactgcattccagcctgggtgacagagcgagactctgtctcaaaaaaaaaaaaaaaaaaaaaaaaaaaatcacagataatatcatacttaacagtgaatgactgaatgtttccccgttaagatcaggaatgagacaaagagatctgctctttccacttctattcaacatttattgagtgttccatccaggataatttgggaagaaaaagaatccagactgaaagaaagaagtagaactatttggagatgacataaatttgtgctggtccagttttgtgttactataaaggaacacccgaggctgggtaatttataaagaagattttaattggctcacagttcttcaggctatacaggaaatatggcaccagcacctgctcctggtgagggcctcaagaagcttacaatcatggcgaaaggcagaggggcaggcatatcacatggcaagagcaggagcaaggtggagggaggtagcagattctttaaacaaccagctcttagcataaactaccagagtaagaattcgctcattaccacggggatggtaccaagccattcacgagggctccgtccatgatccagacaccccccaccagaccccacctccaacattgggaatcattttaatgagatttggagggaccaaacatccaaaccgtatcaatgttgtatacagaaaaccccaaggaatccattgtgaaacaattacaacgaatgagttcagtaaggctgcaggagacaaaatcagtatataaaaatcaattgtatttctacacactgtcaaaaaacaatctgaaaatataattaagaaaacaattccatgtataacatcaaaaaagaataaagcacaacagtgcgaatttacctaatgccacataactatatacttaaaatgagtaaaatagtagattttatgtatatttttaccataataaagaaaaaataaaataccttgggaataagtttaacaagtacaaaacttatcctctgaaaattacaaaacattgttgaaagaaaagaagatacaaataaatggacagacattacatgctcatagactggaagacttaatattgttaagatggcaacactcccggaatcgtgctgatctacaaactcaacacaatccttaccagaatctcagctggtttctttgtagaataataagctgatgttcaacttcatatgaaaatgcaaaggacccagaatagcaacaattttgaaaaagaaaagttggaggcttcatacttcctgatctccaaattgactacaaagtaacagtattcgagaaaatgtgatactggcatgagatagatatgtagatcaagggaatagaatcagagtgtaaaaacggagccatatatctatggtcaattgatttttgacaaggatgccaagaatgttcaatgcggaaagaatagtcttttgaacaaatagtgttgaaacaactgatatccacatgagaaaaatcaattggtccactccacatcatatataaaaattaactcaaagtggatcaaagacataaatacgtaacagataaagctataaaattcttagggtaaacataagggtaaatctttatgaccttggatttggcagaggtttcttagatataacaccaaagaacaaggaacaaaagaaaaaaagtagatatattggacttcataaaaattaaaagcttttgtgcttcaaaagacaccttaaagaaagtgaaaagacaacctacagatgggagaaaatatttgcaaataatctatctgataggggacttgttactggatatataaataactccttcaactcaaaaacaaaaagacaaatatcccaacttaaagaatggatgaaaaatcggaatagaaatttcttcagggttgacatatagttaataaacacatgaaaagatgctcaacgtgagtagtcacagggaaatgcaaatcacacccaaaaggagatactgcttaacaaccactaagatggctataattgaaaaaagataatagcaagtgttggtgaggatatggagaacttgcgcagtgctcatatgctggtggtgagaatgtaaaatgaggcacccactttggaaataattggtcagttcttcaaaaagatagttatcggccaggtgctgtggctcacacctgtaatcccagcactttgggaggccaaggcgggtggatcacgaggtcaggagatcgagaccatctcggccaacatggtaaaaccctgtctctactaaaatacaaaaaattagctgggcatggtggcatgtgcctgtaatcccagctacttgggaggctgaggcagaggaatcgcttgaacctgggaggtagaggttgcagtgagctcagatcgcgccactgcactccagcctggcgacagagcaagacttcatctcaaaaaaaagatagtgatcatttgactcagctttccactcccatgtgttttcatatctctttcttttcttcctttctttttgtttttttgaaacagtcttgctctgttgcctaagctggagtgcagtggcacagtctcggctcactgcaacctcttcctcccgggttcaagcaattctcttgcctcagcctcccgagtagctggaattacaggcacctgccaccatgcccagctaatttttgtatttttagtagagatggggtttcaccatgttggccaggctggtctcgaactcctgacctcaggtgatccacctgccttggcctcccaaactgttgggattacaggtgtgagccaccaacacacccagcctttcatatctctttcatgcccaggagatatgaaaacacatgtccacacaaaaacccacatgttctagaagcattattcatagtagtcaaaatgtggaaacaatctaaaatgcttatcaacaaataaatggataaacaaaatgtttattcattgtatatcatacgatggaagattattcattcataaaagaatgaagcacaagggccgggtgcagtggctcacgcctgtggtcccagcaggttaggaggccgaggtgggcggatcacctgaggtcaggagttcgagaccagcctggctaacatggcgaaaccccgtcactactaaaaatacaaaaattagccgggcttggtggtgcgtgcccgtaatcccacctacttgggaggctgaggcgggtgaattgcttgaacccgggaggcggaggttgcagtgagccgacatcgcgccactgcactccagcctgggcgacagagggagactctgtctcggggaaaaaaaaagaagcactgaagcacaaaccttgaaaacatgatgctaagtgaaagtaaccagtcacaaaggaccatacattgtatgattccacttatataaaatgtccagaataggcaaacccatagagagaaagattagttattgcctagggctgagggggatggaatagtgggtttgggggtgatatttaaaaggcactgggtttctttttggaatgataaaaatgttctcaaactggagtggcagttgcacagctctggggatacacaggcacacttcacttttttgcactttgtggatattgtgtttttaaaaaattaaatgtgtgtggtaagcctgcactgagcaagtctatcagtgccatttttccaacaacatgtgctcacttcattctgggtcagcattttttagcaataaagtgtctttcaattaaggtaggcacattgttttcttagacatggggctattgcacacttaatagactacaatataaacataacttttatatgcagtggcaaaccaaaaaatttgtgtgacttgctttattgcaatatttgcttcattgcagtgtactggaaccgaaccacaatatctctgaggtatgcctatactaaaaaccattcaattatattctttaaatgggtgaattgtatggtatgtaaactatatctccacaaggctgttagaaaaaagctatagcagaagatatttggggtccagggccaaagacttcttagacctgacatcagaagtgtaatccataaaaaggaaacattgaatctcatcaaaatttaaaatgtttgctctgtaaagtaccctgttgagatgatgacaatgaaagctacaatgaataaatatttgcaccctgtttctgacttaagataagtatctagaatatataaacatctcccaaaactcgacagttaacaaaaagtctaattgggaaatggaaaaatgatatcaacaagaatttcactgcatagaatacaaaaatggcaaacaggcacatgaaaagatgttcagtatcatcctaatgaggaaatgtaaatgtaaaccacaatgagatctcactacacacctatctgaatggagaaaattaaaaacagtgtgaacatcaaatgccagcaagaatgcagagaaactagatcacttagaccttgctggcaggaatggggaatgtgaaatggtgcagtcactctggaaaatcagtttggtagtttcttataaaactaaacatgcaactgccacacaactcagcaattacaagcttgggcttttatcccaaagaaataaaaacttatgttcacacaagaaccttacaagaatattcatgtcatccttatcaatgtataaggttcccatggctgctgtaatacatttccacaaacttagtggcttaaaacaagacacgctttttttttttttctcacagttctagaggccagaagtctgaaaagagtcttaggggacgaaaaatcaaggtgtcagcagggctggttccttctggaggcttcaggggagcatcccttccctttccttgccttttcttctggaagcgttctttggtttgtgaccccttcctcaaatcacattgccatttcctgcccctgcttccgtggccacgtaaccctttttctcttctgtagtcattcttctgcctccctgttataaggacccttgtgattacaccgggcccattcagataacccaggatgatctctccatctcaaggtccttaatttgacacatctgcagagtgccctttgccatagaaggcgatagtcacaggttctaggcgttaggacctggctactttgggggccattgttcagcctactctgatttgtaatagcccaaactgggaatgacccacatgtccttggatgagggaatggttaaataaactggggtatatgtccataccgtgaaactccactcagcactatgatttaatgaactgtcgcgatacaaaacaaccggaatgaatccagagaatgatgccgagccaaaagaccccgtttctaagatatcgtgtattgtgtgattccatttacgtggcatttttgaaaagacaaaactagagaatcagagaacagatgagtggtcaccagggattggagggatgggatgggagaaagtccgtgtaaaaggacaaataatgggaaccccgtggcgacgggagcactctgcatctggactcttgctgttgacatcctggttatcatattgtgctatggttttagaagatgctaccactgacggaaactaactaaagggtgcatgggatccctattatttcttaccactgcatatgaatgtctaaaaataaaaagcttgaaagtctcatttttttaaacgggcaaaagatctgaataaatatttcactaaagaagatacacaattgggcactaggcacgtggaaaaatgctcagcatcattaggaaaatgcaaatcaaaaccacaatgaggtaaccattccaactggacagtatttttttttctttctgtactttcgtggaaggggtgctagagttggaaaatgatcatttttgcaactaccacagtaaagcctggtttccaaaagcatttaaatctggagagactttttttttttttttaacaagtagcagggtatatgcatggccttaaagaatctcccccgattgtttattggttgcaaggcaaaatatagtaactgtaaggtagaaaagtggataacggcctcaatttggtgatcaaaataacatcgttaataaggggcagatacactgtgtgcctcaggatgtgatacactgagaaggacatcaggtcacttacagagtacacaacgtggatctaacctgaggaaacatcagactcccccaagaagtggcaggactgtatctttaaaaaatatcagtgtcataacagagaaagagactagaaatgttccagattaaacaagactgaagagacacatctaaaggcagtactgaccctgaactggatcttgcagtggaggaaaaaatgccacaaaggacattgtcatggcaactgacaaaatgggaacataggcattaaattaggtccaagtattatattgatgtttaattgcagaagtcaataactgtattactgctttcaaagataatatctttatttttcagaaatacacagcaaaatgtttaggggcaaagagctgtggagtatgcaactcacagatgtttcagaaaaacatgttatgtgaatataatgtagagaaaggggttcaaatgataaagcaaatgtggcaaaatgtaacaattagtaaactggtaaatcttagtgaagggtatgtaggtgtttttatatctcgtgcttgtaatttttctgtagttcaaaattatggccaaataaacagtttgttttgttttaagaaacaatcctgagggactgctttagctcagcaggtcacaactgggggcaattttgccctccaggggacatgtagcaacatgtggagatgtttttggtggtcataactgaggccggagatgctgctaaacatcctgcaatagacaggacttcctccctcaacaaagaattatccggcactagatttcaatagaggtacagtggagaaactctgccccacttggctgacaataagtcactctgccaggactggtgggcaggaatgccggccgggaaagaggaaccctgcctgtggaattcaaggtcagacaaaacgagaaaaacaacctggctacatcactgaaattaacaagcctattcctgtgtcacgggctgaattgtgtcccacaaggtttgcagttgaagccctggtctttaatacctcggcacgtgactcagcatgtttggagacaggacctttaaagaggtgatgaagctacaatgaggctgttagggtgggccctaatccagtgtgactggtgcccttaaagaaaaggatatttggacacacagagaaacaccagggtgcaagtgcccagagcaatggtcatgtgatgacacaggaagaaggcggccatctgcaaggcaaggaaagaggcctcagggaaagcagccttgctgacaccttgatctcagacttctatcctccagaattgtgagaaatacatgtctgctgtctaagccacccagcctgtggtattttgttatggcagtcctagcaaactaatacatcctggaaagttaacacatagaaataaaagttctgtacatagaaacaggttcaagaacctatgttcttgaacaaaatgaattttaagcgatagagaacatcacagagtatgtacaccaaaggaaattaagcagagattataaattttagaatagaattgaaatagaaataaaattcaattagagatagaattaaatcaaaataaaattgtttcagcagccttagaggcatttttactattttactgattgagaaaaacaagatgcagaaagcaggtatgatatgatcccgtgagtttggaaaacaatgataatgccttcattatgtcacatgtattttatttcattgaatattatatgaacatcaggaaaaatgtaagacaacaaatcctagattatcaacataggtaacagagaggaggggagcccaagcaaacataagaaaaaagttctgtactgaaacacatctattccattctactcatctgtaaagttaaagtgtgaatattggaaagtaatacaacattaaggacactaaaagaaagaatagcccctattcagatctggtattgatagagcctgaggccaatttggcagcagacagagacacaagactgtttgctgcatatgggtcctgggtgagcacttacatgttctaactcactcagtcaacacaggagtcctgggagcaggcagttaggatcctgatttcacagatgtggaaactgaggcacagagaatgcagtagcttgcttagggccacataagaaaatggcagagctgggctatgaccctaaagaaggttggccatataggctgtgctccaaaccactccatgaaacctgccactcaatttttagaaacataattgtacaggaagatttaattttcctgtctcagaatttggcagatgtattagggttttttttttttaactaagggcagagcagacctaaatgaggcaatgaataagtatgtatacacaatccatctcaatgtacattttgtctgtccatgtatacaaataaaactttgtgttatacaaatacagaagatattttctgaggtctgtggagcatttacaaaaataatgatgttattttcatacttggagacaaagaaaatcttcattttaaaaaaagtggagacttcataggctacatcctttcactgtaagcctactaaattagaaataaataacagtgataaaaatttactgcttaaaaattaagaagacattaaaagaactctaaagagaaaaatcaaaacacaaaattaaaactatcaagaaagcaatgaaaaggaacatatttcataatcagatctacgtgtcacagctaaagctgcaatcagaggaaaatttatagcctttaaaaatgcctttagtagaagaacttcaaataaatgaactatgactcttaagtaaaagaaaacaaaaatagagttagccaagaaaagggaattaatagctataaaagcttagattaatgaaatagataacaaagagtacaaagatagttttctgataataaaatataaataaaacataaatttctcatgtgcttgattaagaaaaaaggagaaaaaccacaaaagttcaggcataaaggaaaagaaaaacgaagagatgatagagaagaccataaaatcactaaaggaaaaaatcagttgctaccaagtggcaacacaattgaaatgcttgaggaaattaaatagcaatgaataaattactccaaaagatgcaataaactaatttagaacaacatatcataaaacagactaaaaagaaattactaaagatatcctataaaacatgtatcaggcccagatggttttacaactcaattctatttaacctctacagaaaagataatcccaatgttcttcaaacagttccaagacacagaacaaggaaggtagataaaactttgttttgtaaaccattgtatttgcccccacatgatggcagatttcatactcttctgaaagatgtactgttatttctaggatcagatatcagggatgtcctgcatcagtgatgagagtgaagcttcacagttttgatggctgtttaacggagatatgatacttgaagcagacctccactgatgggtatgtcggtggtttgcaattttttgctatttaacaattgcagaaatcaatatcctgatgatggattattttgcaaatgtgtaagatatgtgtagaataaatttctagaatgattcaaaggcatatgcatctttaattttgattgaaattgccttatttatctccacagaggtttgtatcaatttatttttctaacatcaatgactgagactgagagtttccatgtacacatacccatagagtgttatcaaactctttgatatttaataatcagataagtttcaaaaaccccattgctttagtttgcatttctcttg

SEQ ID NO: 140 - DNA, 1226 bp, Homo sapiens
gcagaatgcagatggagccagcggggagaggagtggacatgagagaaagatcccatagccctcttggtcttggttggaacaggaggaaaatgaaaactggacatccatcttaggacttaatcctacggagaccacaagctggaagaggcactcaatactagcatggcttctgtggcattttgatgagtagtatgggctccacactgaaatattaatatcttattgttttgatgatgatgatgatgttcattggcccagggcaaaaggtaaaggttgtgttataaagctgatctattcaatatctgtggatgttaactccaccccatccccttattgaacaattacgatgcctataaatattgtattgagaaagaaaaaaaaaactaaggcagaagatatcatattacctgtccatatgtgacattttggctggccaagccataatggccaaagaggagcaactgtcaaaatttaagtggggttagaaaagaagagaggaacttgcacgtttgcacctacaaggaccctcttttctcctctggtagccatggaaaccactccttggacctcctttcaagagactctgcatggggagcacagttgactgacagctccaattgctgctccttcgagtccaccatggcactcatgcccacgcaatgtttcctccagggttctccaggtagagatggagcaggtggggttgccagaggcaggccatcaggccatcttgactgatgtgggacttctaatgcttccaggtctgaaggctcacctgccacttcctgctccctcctcctttacccttcacaggagtttcctccccataaatttcttgtgtatctagtcctgtcttggcatcagcttcttggaggacttgaactgatatgcactcaacagccagtaaatcctgctaattcacaaaatccttgattatcagtactaaagaaagacactgggggtgaagatgtcatcttctaaaagacttactggggataatctaccaccaaatgtaggtggcaaatgccatctttgatcacataatggaatcaatgaaggaggttattgatctggttcagaggtgactttagaatgtcccaaaccctttaaatatgtgtgtattgagtatgtgtgcaattctccttgaagaacatttatacctttcatctcattaatctacaaaattatcagcagtggcagctaattgtcagttaactaggtagttg

SEQ ID NO: 141 - DNA, 3516 bp, Homo sapiens
gccaagctggctcaaagagcaaccagccacctctgcaagggtgtgccaggagcaggtggagcagccaccaacctcacccactcaaagaagcagggatggccaggttccaacagcctgagtggctgccacctgatggctgatggagcagaggcgtgaggaaaagctgatggcactgctttgtagtgctgttctttgtctctcttcatctttttcagttaaagtctgttttatcagagactaggattgcaaaccctgcttttttttgctttccatttgcttggtaaatattcctccatccctttattttaaacctatgtgtgtctttgcgcatgagatgggtctcctgaatacaggacaccattgggtctttactctttatccaacttgccagtctgtgtcttttaactggggcatttagcccatttacatttaagtttagtattgttacatgtgaaatttatcctgtcatgatgttgctagtttttaatttttcccattagttaatgcagtttctttatagtgtcaatggtctttacaatttggtatgtttttgtagtggctggtactggttgttcctttccacgtttagtgcttacttcaggagctcttgtaacgcaagaatgtggatttatttctggtaaggtaaataagtggatttatttctcaatgctgtattctatgtcctttaccccaagaatcattactttttaaaatgcaattcaaattagcataaaacatttacagcctaggaaaaggcttgtggcattagaatacttatttataggattattttgtgtttttttgagatacggtctttgtcatcgaggcagaagtgcagtggtttgatcataattcaccacagccctgaactctgagtccaagccatccttttgccttaatctcccaactagttggatctacaagcataaggcatcatgcctggctaatttttttacatgtttttttttttttttgtcgagattatggtatcactatgttgctctggctgatctcaaattcctgacctcaagtgatctttctgccacagcctcctaaagtgctaggattacatgcatgatgcaccatgcctagcgtagagtattacattagtttcaaagtcttattctaagagccatttattgactttggcctaaataactcaatataatatctctgaaactttttttgacaaattttggggcatgatgatgagagaagggggtttgaaactttctaataagaattaacttagacccatttaagaaggaaaaaacacaaattatcagaaaaatataaaagtaagatcaagtgcaaaagttctgtggcaaagatgatgagagtaaagaatatatgtttgtgactcatggtggcttttactttgttcttgaatttttgagtacgagttaacatttaaagaatctacattatagataacattttattgcaagtaaatgtatttcagaatttgttattggttttgtatgagattattctcagcctatttcattatcaagctatattattttattaatgtagtttgatgatcttacagcaaagctggaagctgtatcttcaaaatatgtctatttgactaagaagaagttattcaacaggagttattatctatgaaaaaagtacaaccagaatataaaaaacttgaggaggataaaaagatgttggaagaagtaatattaaatcttaaaaaacatggaaactgcacattggtgaagacacattggtgaagtacaaaaatataaattggatgtagaagaaagggcaatgcaggcaatagaaaaattagtagaaatccctttacaggttagtttgtaaaatcaggtaagtttatttataatgtgctttcatttatttcactgcaaattatattttggatatatatattgtgtttcctctgcctctcttatagcaatttgccttgtagagttctagcaaaaaggtggcatctgtttttactttcaaatatttaaatttccatcattataacaaaatcaatttttcagagtaatgattcttactgtggagtcatttgattattaagacccattggcataagattacatcctctgactataaaaatcgtggaagaaaacctaggaaatattcgtctggacattgcacttggcagtgaatttatggttaacctgcggacgcccaggggctcctccatctccaccgtgttctcctcgggctgaagcccaaagtcccacattttctcctcaaacagctctcagagccacttctgcaggcaggaggacagcgcgtggactcagtgtctgacttgggaagccacatgtgaaggaactgctgggtgactatggtcgtaagtcaatcaaagcagactttccctggcttgctgtgctacgttgattttgttttcgtattttaaaagaagcagaagggaggttctaggaaatttgcccaacgtagatgctgacaagagtggtgacatgaaaaagattacccagaaggaaaacgagctattttctaaacatctgaaatctgtgtaggcttttggaaaagtgaaactagatgcaaaacacaatgatataattctggcaatttccactgacacagaactcagtcaatctgaattaatctaagagttataaggaaaatggcactccaagaagtacctattaacatcactcagctgctgtgaaataggcttacaggcaacatggagtgtcaattacccaatgtttaaagtcgatcatacagattggactacaatctctatggctcataaagtctttaaaggattgacagatgatttatctcatatgtagacaatgattctcagcagttaactagcgcaacttgataatgtcaattgcttgagaaaatcagataattgcttgagaaaattaggacattgcttgaggaagttaggtagttaaataaattactttttttaaagaatagtttaatattttggcaagtagactttaaaataggttggtaatattttaaaggctacttttaaagaagtagcaatataacatgtttaattatgaaaaataatgttggaaacaattcaattttctatcagatcattcacaaatacagaaataccatctcaataattagaagaagtagcagcaatttctgtcatttttatgcaagttactcttagtccatttatttggttttaaatagtgtttttaaaatttgttttcaaacagggctaatcataaataatagaacatattttacaatagttgaaggtaacaaaaagtaagtgccatttaaaaaattgtattagattgtttaaaaatgttgtgggtacatagtatgtgttgtgggtacatcgtatgtgttgtgggtacatagtatgtggggtccatgagatgttttgatacaggcatgcaatgtgaaataagcacatcatggggaatggggtatccctcccctcaagcatttatccttcaagttataaaaaattcaattacagtcttagttatgtcaaactgtacaattaaattattattgaatatagtc

SEQ ID NO: 142 - DNA, 3205 bp, Homo sapiens
ggcaaccagttgggggtccactgccgcagtgtgggaggtttgttctttcgctctttgcaataaatcttgttactgctcaccctgggtccacactgcttttgtgagttgtaacactcactgggaaggtctgcagcttcactcctcaagcccgggagaccgcgagcccaccgggagaaacgaacaactctagacgcgccgccttaaaagcggtaacattcactgcgaaggtctgcagctttactcctgagccagcgagaccacgagcccaccagaaggaagaaaccccgaatacgtctgaacgtcagaaggaacaaactccagaagcgccacctcaagagctgtaacactcaccgcgagggtccgcggcttcagtcttgaagtcagtgagaccaagaacccaccaattcgggacacaatacctataatcccagtactttaggaggccagggcaggcggatcatctgagctcaggggttggagaggagcctgaacaacataccgaaaccccgtctctacaaaaaatacaaaaattaaccggttgtggtggccggtgccggtagttccagctagtgggggactgcggaggtgggagctgaagcgggaggatcgcttgagcctggaggttgaggctgcagtaaacagggattgcgtcaggacactccaacctggggaacagaacgatgccctaaaaggctggctgagctgactggagtccaatctcctgactctcaatcctccaccatgccggaatccacttgcatttctggcaagaaggttgtttacgctcaaggtctacagggatggaagtggcacccagtgagagggctctgccgatggagctgtgaaggcgtcgacctcattctgacgggcttgttgagactggtcagcgcctgggcaagagggcagctgggatatgtctatgccatgtttgacccatgctattgttttttcctccctttttactttctatctgtactcctctccttctcttccactccattcccctgcccacctccacactgaaaatcgaggccttgggaggagaggtcaagggaggaaagaattctggaaagaattcttccacactttataacaaggagcccaggcactagtattttcctcttgccatcggcggccagccataaaaagggttgatccatgagttgtttctccaactcttcgagcagctcagttcatggcactgctatagtttagactaacccgctcaacattgttagaaacatttagaaatgtctccccctttgccgcaatttccctctctctgccggtgtctgctctaacagctggaagaaatttctccttcatctgctatattcagcctttcactaagcgccatcaattttgcctttgaaatttcttttgtactggtctccttctctcctttccaccgctaatcccggggcctgtctctagccctgtgattctgaactgtttaagaacctcctgacagagctccctgcctctggcttctccacctttgatccattctgcacagccaagacagattcatttttctcaagctctgtttgcatcttaggaggcctcagctcaaaacccctaggctctctaatgtccttggcattgcccagacagctttcacagctccctctcactctaccttcttcccagatcgtggctgcttttgcctcctgtactgttgtaacaaatcaccacgaacttggtggcttaaaacaacggaaacttattctcttacagttctgtggccaaaaatccacactgagtcttataggcctagatcaaggtggcagcagggctgtgattccttgggaggctcccagggagaattctctttcctggcctcttccagcttctcagggctgcaggcatttcttggcttgtggccacatcactccagtctctgcctcagtggtcatattgccttttcttctccctgtagtgaaatcttcccctgcttccctcttataagatacttataattacattaggagcccatctggataatccagggtaatctccccatctcagaagccttaacttaatcacatctgaaaaatcccttttcccatgtaaagtagtagttataggctccatgaaagggatggggacatggatctttggggggaccgttattcagcctctcatcatggccagcttaatccttccacttccctactcgctactacaacaagtatcagttgagtatctactatgtgctaggcactgttttaggcaataggaatcataatgactaatgagccttttcggattcagtctcctgcagggtgaactatccctttcctgagctctttacctcttagagcttggtatcattacatagcatgatcatcacatactatgtatgtctgtgtgtttgacatgtggttcatagctggtgaacggtgctcttcgtttctataggcaggtaggatggacgtgcttcgtagggcctttctccgcaagccctgacatacacagcacagagatgggacagccccctactacatcctgccagatgttgctggcttattttaaaattagaaacgcctatacagtaccataaaccagtgatgccaactggtttatactccataagtttgtactcttggaagtgctagggttggttgcagcctaatatttaggaagagttttgaaaggcactgtgacttgtagcttcacacctgtcttcttaaaagcctggccctttcccgatttcaggttgacatgtgcctcctgcaggcactgacactgaggccttaccggtgactgtttccttattggtaagtgtgttgctttcctaggtggaaactctctgaggaaaaagatcacgttacacgcacacaagcacacacatacacatctttgtaactctctggccccccattggatctagcaaagataacttggatgctagatatttgcataccagccagtgttgtccagcactttcgttcaactctttgacaactatcgtcacattcctatactgcttgtgctatcatttgattaatgtttgtatttaatttgtctcaacttttagcttgtgtaaacttattttaaaaggaagcatttgcatctctaccataaatagaagaccagagtcatttatcataaataaagcataactgtaaaaataaagatactgaaaatgaaataatgttattcccctaagaattaaacaataaaatattgagtaataaaattg

SEQ ID NO: 143 - DNA, 3206 bp, Homo sapiens
ggcaaccagttgggggtccactgccgcagtgtgggaggtttgttctttcgctctttgcaataaatcttgttactgctcaccctgggtccacactgcttttgtgagttgtaacactcactgggaaggtctgcagcttcactcctcaagcccgggagaccgcgagcccaccgggagaaacgaacaactctagacgcgccgccttaaaagcggtaacattcactgcgaaggtctgcagctttactcctgagccagcgagaccacgagcccaccagaaggaagaaaccccgaatacgtctgaacgtcagaaggaacaaactccagaagcgccacctcaagagctgtaacactcaccgcgagggtccgcggcttcagtcttgaagtcagtgagaccaagaacccaccaattcgggacacaatacctataatcccagtactttaggaggccagggcaggcggatcatctgagctcaggggttggagaggagcctgaacaacataccgaaaccccgtctctacaaaaaatacaaaaattaaccggttgtggtggccggtgccggtagttccagctagtgggggactgcggaggtgggagctgaagcgggaggatcgcttgagcctggaggttgaggctgcagtaaacagggattgcgtcaggacactccaacctggggaacagaacgatgccctaaaaggctggctgagctgactggagtccaatctcctgactctcaatcctccaccatgccggaatccacttgcatttctggcaagaaggttgtttacgctcaaggtctacagggatggaagtggcacccagtgagagggctctgccgatggagctgtgaaggcgtcgacctcattctgacgggcttgttgagactggtcagcgcctgggcaagagggcagctgggatatgtctatgccatgtttgacccatgctattgttttttcctccctttttactttctatctgtactcctctccttctcttccactccattcccctgcccacctccacactgaaaatcgaggccttgggaggagaggtcaagggaggaaagaattctggaaagaattcttccacactttataacaaggagcccaggcactagtattttcctcttgccatcggcggccagccataaaaagggttgatccatgagttgtttctccaactcttcgagcagctcagttcatggcactgctatagtttagactaacccgctcaacattgttagaaacatttagaaatgtctccccctttgccgcaatttccctctctctgccggtgtctgctctaacagctggaagaaatttctccttcatctgctatattcagcctttcactaagcgccatcaattttgcctttgaaatttcttttgtactggtctccttctctcctttccaccgctaatcccggggcctgtctctagccctgtgattctgaactgtttaagaacctcctgacagagctccctgcctctggcttctccacctttgatccattctgcacagccaagacagattcatttttctcaagctctgtttgcatcttaggaggcctcagctcaaaacccctaggctctctaatgtccttggcattgcccagacagctttcacagctccctctcactctaccttcttcccagatcgtggctgcttttgcctcctgtactgttgtaacaaatcaccacgaacttggtggcttaaaacaacggaaacttattctcttacagttctgtggccaaaaatccacactgagtcttataggcctagatcaaggtggcagcagggctgtgattccttgggaggctcccagggagaattctctttcctggcctcttccagcttctcagggctgcaggcatttcttggcttgtggccacatcactccagtctctgcctcagtggtcatattgccttttcttctccctgtagtgaaatcttcccctgcttccctcttataagatacttataattacattaggagcccatctggataatccagggtaatctccccatctcagaagccttaacttaatcacatctgaaaaatcccttttcccatgtaaagtagtagttataggctccatgaaagggatggggacatggatctttggggggaccgttattcagcctctcatcatggccagcttaatccttccacttccctactcgctactacaacaagtatcagttgagtatctactatgtgctaggcactgttttaggcaataggaatcataatgactaatgagccttttcggattcagtctcctgcagggtgaactatccctttcctgagctctttacctcttagagcttggtatcattacatagcatgatcatcacatactatgtatgtctgtgtgtttgacatgtggttcatagctggtgaacggtgctcttcgtttctataggcaggtaggatggacgtgcttcgtagggcctttctccgcaagccctgacatacacagcacagagatgggacagccccctactacatcctgccagatgttgctggcttattttaaaattagaaacgcctatacagtaccataaaccagtgatgccaactggtttatactccataagtttgtactcttggaagtgctagggttggttgcagcctaatatttaggaagagttttgaaaggcactgtgacttgtagcttcacacctgtcttcttaaaagcctggccctttcccgatttcaggttgacatgtgcctcctgcaggcactgacactgaggccttaccggtgactgtttccttattggtaagtgtgttgctttcctaggtggaaactctctgaggaaaaagatcacgttacacgcacacaagcacacacatacacatctttgtaactctctggccccccattggatctagcaaagataacttggatgctagatatttgcataccagccagtgttgtccagcactttcgttcaactctttgacaactatcgtcacattcctatactgcttgtgctatcatttgattaatgtttgtatttaatttgtctcaacttttagcttgtgtaaacttattttaaaaggaagcatttgcatctctaccataaatagaagaccagagtcatttatcataaataaagcataactgtaaaaataaagatactgaaaatgaaataatgttattcccctaagaattaaacaataaaatattgagtaataaaattga

SEQ ID NO: 144 - DNA, 4673 bp, Homo sapiens
tccacctttactttcttctcttaatgtttataattaggtcgttaccttaaattctcctattgcttatgtttgtcactttaaatgatatctttaacctctatttcttgttctgtgaattttaggtaggatcccttaactctacactttaaaaattaagatatggtagaatttttttggcaagaaaaaaattaaaaagaagaaaaacttaagctatttggctccttactcttccttcaacttttcttccacaccagagtcctttccacatcccaccatctaccacctactttttccttttatatttccaaggttgttaacatttaccttcatgcaatcaccacccgggtttctgtgctttttcacagattgactctaaatataatgacccagaaacagcatttacattatccttattgtgtaaatattctttaaagttggaccaagtactatattaagattgcattacttttttctgtggaccaaatacaacccctagggtcactcaaaagagattgtgatggctttgtaatgtgttagtgcgttatgctaccagctaggctgacctatgtgttctggaattcctctccctatatgattcatattagattgggccacaagagacattctgtgtcagattttgaaggcagaaatgaaaaagtggttatattgtttgtatgctcagaagatcaaggaagaggcaacaggaggttttagctctcacatattttcttatttagcagctcacattgttgggtaggagcagaagcccagcctgcagctgctccatcttcccctaggtctttctgtttcttcttctttcagtttcttctacgccaggtgtgtgcttagctccatgacaaaaggtgacagcttattctgcagcacacacacatcatcaaagtgggaggtggtgagactggcacactgacagtctgtcctagcagatttcagctcacactggtgagttccagcatgcttataccgctattttacacgtcttcccttcgccattgtctatctgcagacttctccaacatcagatgccagatgtctcatggaaactaaataacttctacaattgtgtgtgtatttatataattgatacaaatattggttctaacatcaattccaagttgattttttaacattcaacaattacttccaattgtgtcacttcttattttgcttcatattttttactgacatttctaattatatttcttggttccttgaatttgtaactttatcatactcatattcttcctcattcttaatcatattgtccatagagttccttcccccacacctttcccccaaccccatagataaacttatttatttccttcaatcgaggactatgcaaactataattatgggatttctttgacttctttaccagttagacacactgtttccaaaattccatataacctttgtgcactcttctgttttactttaatatatcctgttagtcacaaagaaaaattgatgaagaataaatattttgaattttgcatgattaaaaatgtcttcaaacaatcatcatatatggttgatggtctgagcataaaacattttgtctcataaatttgaaaaatatttttatagaagtttttagtgtcttttctccttggtgatctgtaaaatgttacaagaatatgcctttgtggggatctttttgcagtctcagacacctagtggatccagatccttttaatctgaagactcatgtccttttcagttttaaataatttccttatatccgtatctttaataatacttcctcttccatcgccaccaccccatcctaaccccaagcacgcactattttttgttctctttctaagactcttactaaccaaaagttgaacattccatatttgaaccctatgcctcatttccttgctaacatttccattactttctcatttgggtctactttctgggagattattatcttttatctcaatggttacattttaatctgtagaagctctcttttattgtgtaatagttttctttgcattactttcctgttcttggattaagattaataaaaaaatactaatatcctctttaaatttctatgaatatattaactatttcagatacaatggaaaggacactggccttgagtcagatatctggaccttgattatttaatgtaccaaacaaggataatatttactattccacaggattattttgaatattaaaagagataatatattttaagagccttgtaaattatgaaatatgtaagtacaacataagaaagatatttaaattattatatatccctgcatgacaatgtttctgagcatggcaattaaatgcttttacgaacccacgtttagttatttccttctataatgttctatatacataaaacttcaaccacatcacacaatgaaacttgtggagttatttttttgagtcctttgctgtcattcctccaggccttgcttttgttaatggagcagacactgtcatatatacccaatattcattttccacatcttcagtaataaaatcctgtttttagcaaaacacatcatttccccacttctccacctctcttgaggttgcttccagaaataaacagaatcagtgtacacaacttttggtaaatgtttggaaataaagagggcatgctcttcttccctactatccctttcctttctgctggctggaatgcagatatgatgaatggaaataatgtggccgtcttagagcctgagctggaagccatgtatggaatatggtggagaaacaacatggagggaacacccttggctcctacctctgagtacagtacccatgctagactaactatacctagatttcttttatgggagcaagagacagtttcctagcttgtcagaccaatataacttggggttttctactactccatgatgaacctaatcctaattaatatgctgttatagtttctcagccttttggttaagatcagatatactaagacactccccatcaggacatgacagtatttactcatcctttatgagccaatgaaagcatcaccctctctagtaagtcctgcctaatgagacctccccaataggatttaatgtctttattatagaatatatttttcatgagacaaaggatcctgtttattttattcactagtgtgtgcctagtgccttgaaaaatgtgtgggccatattaagcaggtgtttgtttgttttttgagatgcagtctcgttccaccacgcatggccttaagcagttaaatagttgttaagtatgcacaactctataacccttaggattttgtggttacctcagctaaaccatagatgcttttcccaagcctctctccctacacaaattgtaacctcactagcgggtaaaaccgtatatatgtatcacttactttgctccttaatatatggtacatgactgacagtacttatgaattgaataatttaaatgagaataagtgtaatgatatataaaaaattatttttaaaataaaatttacataaaagtattacaatttgagatgaactacatcaacactttttcatcaaaaaatagtgttttctctcccctgattataatgagacaatttagtgactgcttttatcaaacataatagagcaaaccacaatctgacttggagcaatttgctggacttccaaacctcagttttgtcattaataatatgaggttcatatccaccacatttggcatcttggactgtgcttgattaacacttgtgctcagtaagtggtagctgcaattcttatagtgactaagaaaaagcattatctttaaaatttactgatttaaagttttatatacattcatttattcaatagctatttgcttgatccctacaatgtaacagcaatctagatgctggggacacaaggtccaccttccaggaatatggccatgacaccagaaatcacaaacatgatgagaatggaatgactggggaagaagtgccagatgcttcacttgtaaatgaagacccagcctctggggatgcagataccacctccctgaagaagctgaatatctgcagataagtggagttcaccaatgatgaggagcgggatggagaaaggaggtagggagagtcatccaaggaacatgagcaacatgttaaaaggtaagaagtgagacaatggtgaggtggtgaaacttaacaagtcggccatggctgggggtgagagtgagggagggtggtgggaaataaagttgctgggatagggagaagccagatgatgcagcttttgcaggacatggtacagatttgggaaaatattgtaaggttttgggagagtatgagggatttatgggtcaggtttatattacaaagattattctaaaaatattaggcctcccgaggcactcaagccttttaccttgcagtttctactcaccctttgggactcagctcaaatgacatttcctcgggggtgctccctgatacccagattgtgcaccctgtgattctccttcagagtatcacaagtcgaataaaatcgttaataatagaaaaaatatcctgtatgtaaataggctactttaaaatgaaatcatttcacatgtattatattttctatttaaataaattctaccattaaatttttgaaacatatttacctcttaactatatgtctagttaagaaagt

SEQ ID NO: 145 - DNA, 2093 bp, Homo sapiens
acagatgggagcagagaagccggtctttctagcatttctctccctcttttccactagtcctcagtaaaacagccttgccagaaccagatgtcttttttctgcagatatttactgttatgacttgggaggcagcaggttctggactgttgccctcacctagaccgccccccccccttgtcagatgccacccgttttctcagacccgtcggtctcccagaccacattgctttgtgagcagatgcctgtcagggacagctctatcagaacagaccgagtccagcccagtgagccgtgatgttctctcactgctcggtcccccctctgccatctacagcgacataggttgggtctgttcccctggcagacagcaggccttcagagccctgccagaatctcttgtgtctcccctagcacacacacatccctccccacccaccaccgccaggcctggatagccctagttctctcccatttcttggtgtcagggtgttcagaccttttaagcagatgaatgctaactcattcaaggcttttaaaacccagtgccttagcagggtacagtggcacacacctgtagttacagctgtgtgggaggattgcaggagttcctgtctagcctgggcaacatagcaagacctccttgtcttttaaaagaaaattaaaaaaaaaaaagtgccctaaactgaatccagccctgcagatgtagctgggccaggacagaacagagggtaaccactgccttcccaagcaagcaatggaaactggcagctgcagtgtcttcatcacgcgatggggtgggaatgctgccccttatctgggcacaaggaatagtgtcatctgtgcaccttaaagttgcacaaaagctttcctagtagcgacatctcatccttgtcaaacttgaaattatctaaaaaccacaagtctcttcataggaactgtttgcaagtcagcagttccccattttgtactgcatgaaatgcacccttgagcctaaatatctggcttgcatttgccctggtacatttaactggcgtggtgaagtaggaggagcaaaggcgtcggaatctaacagtgctgtatgattcttgcttctttaagcttcggtttccttgggtttaaaacagggttcctaggaagctgagatggaaaaaggtggctgccgcctggctccattccaagttgctgctctcgttctgtagctagcccaggtttccgggttccgtattaaccctgtgaccatctcaacccttgacactgtcgataggaagctggtcgttctctcagctgggcctttacttaagtcctggacaaacaagttgaccaagggcaggcagagactgctacagggtgccacatagtgtatgcagtgcacaaatggttctatttttggtgggtcggtgttgccagcgagctgaccctgaccaggtgtggaggggagtgggtggggggctgtggaaatgtggccaggtccctacccctatcggcagaggctccatcctgcccttcctctcagccacaggtgcaggatggtagatgggaacttgccagaaggatgcgaccctatttaagtagttgtgttttcttccagcccagcatccccaccaaaacaggaaaagaagtgctctcgtgcagggcttgttcacagtgagcctggctggctcctcatgatctctgagtttaaaatgtgccagcagatgattttaacgatcccatcaaaaattgttgtctggatcagtttcgagctagcgtttccttgcagaggccattcttccttttttgacaaaagttgggtcggccaggtgcagtggctcatacttgtaatcccagcacttcgggaggctgaggcaggtggatcacctgaggtcagaagttcaagaccagcctggccaacatggcaaaaccctgtctctactaaaaataaaaaataaaaataaaaataaaaaaaagccggacgtggtggtgggcacctgtaatcccagctactggggaggctgaggcaggagaatcacttgaacccaggaggcagaggttgcagtgagccaagattgcaccattgcactccagcctgggcgacaagagcgaaactccgtctc

SEQ ID NO: 146 - DNA, 1476 bp, Homo sapiens
atgctactcctgggaggaagcttcaaaggcctcagccacaagtagctctagctcaagcaaaaacaaagcatgttgagaattgtgaacaatcagtgatgcaacacaaggtggtgctcttgtcccagtgagtgctgtagagccttgttagggcattaggcaaaggatgtacaactccaaaagatttggttggtataaacgccaatggggatctgccggacagactgaacagctgactggggggcacaaagccaaagggcatgtgccaccatgcctggctaatttttgtacttttagtatagatgaggtttcaccatgctggccaggctggtttcgaactcctgacctagtgatctgtctgcctcggtctcccaaagtactgggattacaggtgtaagccactgcacccagcctgagagaccgtattatttctaggcctgaagaagcaaggggagagagcagatactgtaacacagagtgggtggctgtttggagataactgcccaaccagagctgaagcttcccaaagagagaccaaatgattcacaatgacccagcaggcagggagcaaggaaattaacagtcttacctcattctcctatcaaccccaatctgccaccaggcttcccactgacagaacctcatggaacctagagggcaagggattcagtagacacggtccatgcagaactaccaaaaaggatttcttataataatcttgaaatctagtcttagtggagaaagaaaaagaatttccaattgtgtagctcccattaacataccaagaaccaggtctgggaacttaggttgttgcattttttcccagctttgaaatggtactgcctctaaggatgatggctaggccatgaagtttgctattctaggggaaaagagggattggaagaaagaagaaagcctgaatctgtctgttctgtccccaggagaatgataaggggagagagtaagaaagcaatgagatacacatgtcttgactgcttctcttcatgctgaaatcctgggggaaagaagtgctaaatcagttgaggacatgggaacatttattctggtgagtggatgttgagggcagaggggtgtttgccccattcctttggtgtgctgagtgttaaccactttgcagggagagctgtatggggcgtcatgttaacatgaagtcattaggtgggccttaatccaatataactgatgtcttcataaaggaagaaatttgggtacagagacagacaagcaccaagagaagatgatgtgaagaagcacagcgagaacaccatgtgaaaatggaggactggaatgaagcatctacaagccaggaaatgtctgaggctaccagaagccaggagagaggcctggaacagatcctgcactagaaccttcaaagagagcatggtcctgctgacatgttgattttggacttctggcctccagagctgtgagaataaatttcagttgttttaagccatc

SEQ ID NO: 147 - DNA, 2400 bp, Homo sapiens
gtgggtcaccacatgttgtcctcaccatcatcgtttcctgtagaaataaaatgcctaaggagagaagggagatatgaaatatgaatatctactttaacaagggtagaggaaaacatatactcctgcatgggcaaataaggttcaaaatcagagactctataatgttgcaatatttggaaacaaagagaaaaaaacagaattattaaataaccaaccccatatgtgtaatcattaacttaaacatcattctaaataataagaaacatttagggacatcaaatttctcaagatagataacagaaacaaagaacggtttggccccactgatcaactaaactttggtttaaattctcttcttccctcatgcccctgcattttgatccaacacagcctgaacctgcacacaacccatctttaatacccaactattgggtacttgggtttaatacctaggtgatgaaataatatgtaccacaaactaccatgacatgtgtttacctatgaaacaaagcttcgcatgtgcctccaaacctaaaacaaaagttaaaaaaagaagatatttgttatgacatatcactatgtccttgggagaaatattgttgccagttaactcttcaactagtttgtctgtgttttttattttagccatataaaagacaagacaggtttttagcattccaactgatttttattttctcagtctcctcttgcccaaattctgacttcattattttgtgagacaaagatcttcatcattgtccattttgctttgattagatggctgattggacaggtggactaaagtcaatctttagtattttttcattgtaagattaactattgagtcatttgatatgacaatgggttcacagtagttttaaagattatgcacaacacatatttgagtggaataacacagaaaaatacaaaggaaaatatttggagtttacatcttaacaaatatttggagtttggatcttaacaatcacataggctgccatctatataattcatgtaacagacaaacaagatttgttgtaattttcaatatgggaatattcacttttaaatataattatgtattctacgcataagttggaatgaaaatcttcatgtgtacttctcacattgaaattctaagtttaaatgtatatttattttctaagaataaaatgctacaataattaatatgattacataggtgtataaagctcaccagcttgtacactgagatttaatgttttatttttgctacacctcaattaaaaatcttttttagaagataaagtgtcagtgaagataattttcttccctgaggttatataacattttgttacaaggataagatgcagcaaaaattatcatgaaactaattgtgaaaatacacttatctttgaaagttcttaactatttgtttacataaaacaataacagagttaagaatattcaaatataagtaaataacaaaataggccaggcatggtggctcacgcctgtaatctcagcactttgggaggcccaggcaggtgtatcacctgaggtcagttcaacaccagcctggccagtatggtgaaaccccatctctaccaaaaatacaagaattagtcagctatggaagcgcaagcctgtaggtagtcccagctactcagtaggctaagcaggagaatcgcttgaacctgggaggcagtggttgcagtaagctgagatcgtgtcactgtactccatcctgggcaacagaacaagactccatctcaaaaaaaataaaataaaatacattggtggtatattacaattttaagagaaaatgtgaaagatggctaagtagttgagttattatttgtacccaggttgcctgactctacagcctacatgtgaaaccacaaaattccattaaatgaatacaatatgtaattgcctgcctggtaaactgtgaatattttacacacagtgaaccttttggaaaaatagactttccagtgttattggtataagatggtagcccaaattcattggtggggtggtgggggcagtgggcaagaatcttacatccaatgaacaaactctgaaaagaaagcttaatgtttctcatagtttttatgattctcaaaaaagaaaaaaaaaagaaaaaaaaagagataactaagacatgtgatgagcacctttaaatactcgaaggttccccaaatactaattcagggaatgtcatacccaagcctgtagctggcagatgacaaaacactactgctcctgtgtagacacataattaaatataaaaacataaccacaccatcagtcttggaaaataatacatatggttgccacatatcacttaatcaccacattttcatcttcccagactaagagtttagcctacttttacttggttattaacaaatacat

SEQ ID NO: 148 - DNA, 3900 bp, Homo sapiens
gggatgcgcttcgctgttctctaggaggtaccaacctctggcggtgggtcttgcgtcccggcggaaagctccgaggagtcctgtagacttgtggctcgggtggagccggcggaaaaccccgagaagcttgagacagccgtggctgaggtggagccggcgtcgctgccctggagcgtgggcgagtttcctcttagccggagcttcagggattgactcaaagactcctccgcttttttagttgttttgggtgtgaatacagcccggactaaaccttagtcgcctagactaaaccttagcctcccaggctgccaaaacagcacagcttttacagatgactcttacatcaccatccctactctgtgatactgtgtttttcaaagtttagtgcctgaaccatcagcatgaaatctgcctgagacggttgttgaaaattcacatcgctgggccttgcggcaggatgcctcttgaagcccaagtggaagccaacagaagaggggtccatgtgtacagataggcctggagtgatccatgttccaacagcagtccctttaacctcacttgaatgtggaggctgcacaggtcacaagtctgaagactacaagctacctttgcttaaaaggaaccacaccaccgctgatagctaactgctagattgttctccagcatatcagagctacattgaattgcttgagttgtgcttcaattaatgtagagatcttcactgaatcgcacataaccattgaagtaacctgctgtttacagtctctatcatgctctgccaagagagttattttacagtgacaaaacttctcttctggtgccctgacacatcctaggactttgatgttggtaattctttcccctcagcaaatgttggttctaaatccacagaactacttgagaaactagatgcaaaattgtagtaggtttaaactatcaatactcttttttttttttttttttttttttgagacagagtctctcgctctgtcacccaggctggagtgcagtggcgcgatctcggctcactgcaagctccgcctcccggattcacaccatttgcctgcctcagcctcccgagtagctgggactacaggcgcccaccaccacgcctgggtaattttttgtattttttagtagagacggggtttcaccgtgttagccatgatggtctcgatctcctgacctcttgatctgcccgcctcggcctcccaaagtgctgggattacaggcgtgagccactgcacccggcctatcaatattctttatatgttttgctattcccatttaaaagagggaaactgtagctatacactttctagtcatgttctttggtgattttcctgcacaaaccaacactgttgttcagaaatataatttcccctagaattaccctccatccaaaacatattgttattctatcacagagataaataatggctttccaaatcctggttaaaaaaaccaaacactctcttcttctctgtatttttacagaacaggcatagatgatggcaattgtgttttaccatcttttttttttttctgagatgttagttttctaggatatggaaatcttaggattcataaaaagtgaaacaactttttgaaatgttagttttccaaaattggacaatctttttgagccattctatttttaggactattggttagctgactttagagcctttaatgtttccttattatttcaaacaatagagaactttcttcccccccacgttttgagacagggtctggctctgtcacgcaggaggctgtctgtagtgcagcggcacagtctcagctcactgcaacctccgcctcttgggctcaagtgatccttccacctcagcctcctgagtagctgggactgtaggtgcaggccaccacatctggctaattttaaacaatagagaacttccaaaacaaaagttctttattaattcttcaagaaatctgttttttacttagtcaattaatgtccatttcatgttgcctcaatagcccatgtatgaatcactcttcttgcagattttgttcagttttgttgtatgtagacccatctttctttgattgagttggtttctttgattgagttgatttgtctgtattatatatcagtcagtattaaaacccaaacaatacctaagccaaaaaagcaaggtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattcggtacaagagataaggcaggtactgctaaatgataacttagatgcaggggccatcatgaaaatattcatcccatatcttacattaagcaaactactagcaactgtttgttgaaaagtataaatgaataaatgaaaataggacagataggcagtgtgggaagctaaaatatggaagtgttattgctttgctttatgtggtataatgatctgactttatcttcccagctctcccaggaagtatgcagaataatatttatctcatattgtggatgtggcaatcaagacagagaggctagatgctttacctaaagtcatccaacaaatatttggtagaaccagtgctagaatgcaataaatggaaacagagtttatttttgtgtttcttttcctaatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaatgagatatgaggagcagtctactggggagtttctgggaaagtttgtttttcttgtcctaataagcaaacaagtaatggggtcactggattggagatcctattgagtcaaaggaatattgaatttgacacagtaaaatagtctggaaggaaaggaaatgatattcagtaaatgaaatgctgaaaattgatattatgaaggtggcacagtagttgttattgattaaatgaaacagttgagattaagaaagtttagccaggacaagttgtatagcacaaatcatttcaggtaaggaagttaaaaaaaaaaccctgagaggctaggaagtcctggctccaaacttctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgcaaggaagggatcactaccctgggtgttagcatgtccgaatatgataactaaacctgctgcaattatcttgcaaccagggaggagctagcttgaaaataaagccaacacagttagatgacaagcagaaagtggaaagaacctaagtcattgatgatgctattcagctgatgaattaaacctggagtgtatgttccatgggcttctgtaaggaattaaaatatttttactgtttaaaccagtgtttcattgttttctgcagaaatcctaattggcataaagaaactattgaccga

SEQ ID NO: 149 - DNA, 2474 bp, Homo sapiens
aagacaagacaagatcagcaggagaagggttggacgcatggtacctttccatggaaatcctgtctggggttcatgacccagagtcttggtctgtttgcttgtctcacagtgcacaagaggcaagagcttagaaagcagatcagggaagagtggggaggaaggtatttgtgcatccctgtgggggaaaggtgggcacttcccagcacagcccgggacagtgcgaggaatggcacagaggaacactctgctttttggttcacagtatggccaggacagaaatgagacctttctctacatcctgaggttttattttctttgtctttctcaggtggagcagttaggtcaggccaagcctggccctgttctgatacagctcacctagcagatttgaagttagactatttacaacaagaagaaggcatgccctgccatggcaaaacctcaccaggtctccctgtatgattcttgaatgtcttctttagcaaggttacacctggcacacagaccctatcagccactgactgcattccttacaaacccaaacccattggtgggcagagcgggaaggtggctggccaccatccagacagtaaacaatagaggcaattattatgcagccattaatcttgtcaattacacattaacccaggctgtgtgtaaacaggagcacaatcctcattctttttctctgcctttctcaatggcttcccaccccacctcctcagaaaataaaaagggactgcattctaccacattctcaatatcatccttaattccactttttcacttatggaaacaatcataccaatctggaaattcctttaacctgtgtatcgattttatctttttgtgtgtgtgtgtgatttctattacatatgatactctgctgagtgcttgggaagctgattttgctgttttctacaaatctatggttcctttttcactttgaactccccagttgaaaaggctatattcatatatattacctcatgaggtaatataatgattgatagcacaaatttattacatgttttgaagtcgctttctaatatacctggataaggatctatttcctattcatcttcatctgggtagatgccacccaaagacatccttgtccacttaaaaacctgtagcagttggctttgtggtcaaaggagatttttgttttttaaagtgaggagcagttctggaagcaattagatctggcattgttcagggcagatggtgaagtgggcagagattctcttcaaagcctctagcctttcattttcctgtgctcactcttcctttagtacacttgacctctcctttccctcctcctcctccaaagccatctctaagaaatggcccacgtcagtcatttatctcttcctgggcattaaagagtctggggaatgctcattcctgctgtgttttcactgaaagccttatctttaattgtggaatgaaaggaatttcaggtattggatcacagctcaaagttcaagtttttaacgttctattcacatagcagtcaggaaaaaaaaatcctttttgattggaaggagggcagttttcacaggccctcttctcaggctctggtggtgatccgtctctgttctctcctctttgtggagccattctggaagacaaggcttgaggttggggtgggcaggacaagtagcacagagatttctcaaacgttgctggataaggtgtttgagaccgatttcagtagaaccctaatacacattaggtaagatttctgaatcaggaatgtgagaaaggtctgttgaaactgggcatcaataccctttttccttgggatatgtcagggaattccccaagaggcttcaatgttcagggcagccctgctaccctattttttgggtggtggggtgggaacttggaaagaggtcttgctggctgaaattaaattagcatgttgtttcgagggagttgggaacattttcaagttgctgtgcataaacctgcgagctcattttctcagatttggttcatgcatatagggtggtactatgtattcactagaaagggttcagacttgttgcatcttggttctgtctctagatctaggataatgcatttattccaaaacttaattttggtaaaacgaaagaatcaactaggcaatcactgaggttccttctagcttcaaaaatcccgatgatctctgagatctatgaattaaaattaattggtgcaacttgtgggatgttatttaagtgaaaattcttagagtcagggcactagtgaaaggtaagagccaggaatgcaggggatactggtcattttccatagcttctttcctcccaaattgtagcaattctggggttgtgggaagaagtagagatatgagtggcaaatcaatacaaactgtgtcaccaataaggttgttcagggaaataagtttataaagagtggaaaggaacaggctgagcctgacagggttaaaggaagcaccaatttct

SEQ ID NO: 150 - DNA, 4953 bp, Homo sapiens
acgtgacggggctccggctgggccggcgggttcttcatccccggggatgatcgagttcatcaaagtggaaaacttaaggcggtcttcgtcgggctgatacttcctgctttattgaatgttgatattaaatgcttacctccggaattattttttgaggtatcgactttagattaaaagcctaacaattcttacctttcccgtgggctgcctggctccccgcgcggttcaacgcgagcagcgccagtgcgctgacccttgccaacgacgtggctggtcctggggatcacagggcttcgctcatcccatcttcctccatatccccaaggtggaaacaagggggcgagatgtccacaaactgaggaacagacaaaatgctggctgtccatgcagtggagtgtgagtcagtcatcaagaagagtgaagttcagacccatgccacaacatgggtgaaccttggaaacatactaagtaaagcaagccaatcgcaaaaggacaaaacctgtgcgactccatgctatggaccgagttctgtccccctaacatttgtatgtgaagccttaatccccaatgtgactgtgtttgcagaaagggcctttagagaagtaattaaggttaaatgagattataagggtggggtcctgatctgataggattagtgtccttggaagaggtaccacaggcctggcactgtggctcacacctgtaatcctagcactttgggagtccaaggtgggaggaccacctcctccaggagtttgagaccagcctgggcaacaaagcaagacccctgtctctacaaaaaaattaacagggcaccgtggtgcgtgcctgtagtcccagcaacttgttatggttacgtaagaggaatgtgaattcaaccctggtgattttgggtcgtgtcaggagcagccctgcgacaccagttggcaccttctgcagactctatgtgtcgataagacaaggtcccacccagcaagtgcccttttctcagctgatgaacataagcctgcatggacgttactgtccatggaaaggagcggccggcaccggctgtgacagacacgtgcctgtctgcgatctgagtttcatgaacagtaaactctgttggtcacagcctctttggaaaacaatgttagttaaaagaagtgccctgtgaccagcagtgccaccctcgacagggttctccaagtgggacccgggcaagcagcctcagtatcactaggggttgttagcaatgtgccttcctgggctctgccccagagtggccgcaccagtgactgggagtgaggtcccagggccctgtggtccatgaagagctctcaggggattctgatgcccagtggtacaggtgggccaccggactggggtgtcatctgcccgtgggcatgagacatgaacaaggacatagcaggtctgttagtagtcataactaaaagaacaaaggagccgggcacggtggctcatgcctgtaatcccagcactttgggaggtcgaggcgggcagatcgcgaggtcaggagatcgagaccatgctggctaacacagtgaaaccccgtctctactaaaaatacaaaaaattagccgggcgtggtggcgggcgcctgtagtcccagctactcgggaggctgaggcaggagaatggcatgaacccgggaggcggagtttgcagtgagcccagatcatgccactgcactccagcctgggcaacagagcgagactccgtctcaagaaaaaaaaagaacaaaggaaaaaaccagaaaaccacccagatgttgatgagcagatgattgtactgttgtaatagtaatctggtacaacatttgcaacatcgcggttgttaaaaatgctaacgcatgaacctccagtgtgtatacacagatataaataaacgggtgaagaccatctgtgaggttgcatgacaaaggcaagtgcagaagcagacagggtgggcacatttcttttctttctttctttctttttttttttttttgagacagagtctcactctgtcgcccaggctggagtgcagtagcgccatctcggctccctgccacctccgccccctgggttcaagcgattctcctgcctcagcctcccgagtagctgggactacaggcgcccgccaccacgcccggctaatttttttgtatttttagtggagacggggtttcaccgtgttagccaggacggtctcgatcttctgacctcgtgatcctcccgcctcggcctcccaaagtgttgggattacaggcgtgagccactgcgcccggtccacgtttctatcaaattgaaatcatgagcggttttgctgagggtgtggggcacccagagcctgcggcctgtgctcgagtgaaaatggtggccccgctccagaagcctgcgacggcgctcacggaaccgcagccttcgtgcggcggcacctgggccgtgctactcctctgtgacttcccggaagagatgagctgctacgtccagcaaaaggcacatccaagatcgttcaccccagcatgactcgttacactccggactagaaggaaccccaaggtgcttcagtgacagaacgatgaaccagctggggtgtaacccccatgcaatggaatatcgtacaggaacgaaaaggacacgctacccctacaagcaacatggatctcagaggcaggatgttgcgcagaagaaaccagacacaaatgcttcggctcgtgttgctgcgactcattacaggcagccgaatctgcggtgatgggggccccaggagcagtgaccaggaggcagtgccacggagcctgcggtgggggctgatagtcagtagcgtgacctggttgggatgttctgtttttaagctggagtccatcatgtttgtttatttgttcatttcgtagaggtgggggtcttgtagaggtgggggtctcactctgttgcccaggctggtctcaaactctgggcctcaagcgatcctcccaccttggccttccaaagtgctgggattacaggtgtgagccactgcataaggccgttattgttattagtgcttaaaaatatttagtaaacattttatttagcctaaaaaccattcagagagcagaggctggatggaacacggcgtgccaggcggtgagagcacagaccctcctcttccagagcaggaagtgggtaaatgacttttaagcctcatttctggggtggcaaaactcttctgtatgaagaagtacaaatatgtaatgtcccataatggcagctatgggacgttacgtatttgccaaaacccacataacgcacaacgccaagagtgaactgtaatgtaaactgtggacttaagtcaatgatcgtgtcccgatacgggctggttggttgtgatgcagggcaggtgaggcccaaagtggagcttagcctgccagcgttcttggctttgcccaagaaagaattcaaggacaagccggaggtagaagagaacaacttgattgaagaggcagtgtggcagccccagggcctggcaccgtaggacctctgcaggctggtgggggtgaatgaatgattgattgatgaatgaatgaatgaatgaatgtcagttcagctgccatttcaccgcctggaatttgggactcggactggcttcctggctcctcagcttgcagacggcctattgtgggacttcacctggtgatcatagaaacagtggacccactgagaccaagggcaaggggaggaaaggcccggggtagggctgaagacacaggttccaggcccagctctgctgctcaccgatgaggcttctcctctgttgagcaggtagccccagttgggagctgaggtgtgttgattggggctctgggaaccatagcctgccagctgtggcttggccatcccctctgccagcgctttcccgcccatcagcccttttctctggagtccctccttcagccaggtcctgaaaagtcataccttttggccaagctgctgaaaatactactcagccagaactcatgtgctcatgccagcctcattcatgacaccctccaaaccagaaacagcccaggagccgatcaacagcttcatgggaaaatgtattgcagtctatctcatcgccgggcccttccgtggccgtggagacgggcgaatcatggtctatcccgtcgccgggcccttccgcggcagtggagacaggcgaattgcagttatgcgcagcaaggaagcctctctcaatcacattgagcagaagtggccaggctcaattctgtggaattctgtgtggatcacaaacaggcaacatagaggatggtgttttggggtgcatgttgagggagagacggggttctcttcatcacaatggtggctggcctccaggaagggagggacagtggctgggaggccaggggcctctgggatgctgaaaaattctttttcttctccttcttcttctttttttttttgagatggagactcactgtgtggccgaacctggagtgcagtggtgggacctcggctcacggcaacctctgcctcccagttgaagtgattctcatgcctcagcctcctgagtagctggaattacatgcgcctgccaccatgccaggttaatttttcgtatttttagtagagatcgggtttcaccaggttggccaggctgatctcgaacttctgacctcaggtgatctgcccactttggcctcccaaagtgctgggattacaaggcatgagccacagcacccagcccagaatggttaattttatgttatgtgaatttcactcaataaaaaaaagacaggaaggggaaagaaagaaagaaaaggcagggagccgggcatggtggctcatgcctgtaatcccagcactttcggaggccgaggtgggtggatcacgaggtcaggagattgagaccatccgggctaacatggtgaaaacccgtgtctactaaaaatacaaaaaattagccaggcgtggtggtgggcgcctgtag

SEQ ID NO: 151 - DNA, 2535 bp, Homo sapiens
cctaatctgattcgttcaaagaatgttttggctgaatgtaaactccttgtgtgtaaacttgaaggagttagtacagtttacctttaaatttcaatatcattgtaaatagttagtttaaaaattttaacatgcttttcctcaacatttggccctcatttaaaaagaggtcagataagaaccaactcaaattccatctggtatttttttaatatatcattcaagggtatacattttagcctttttttttcttttcttttttttttttgcattaagaccatgcattcctaagacaaacttagttgtcagaaattttgccaccaaaggcaaatgcttaaggccatgtagggattgatgttgtattttttggtagagacgggttttcaccatattggccaggctggtctcttaacttctgacctcaggtgctccacccgccttagcctcccaaaatgctgggattacaatggataatttgggacatccatgtccaaaatggtggcaagatcagtttgttcctttagaatctttatgagcctgattttctagagcttgactcaacatacaaagattttttttaaagttttttaaatatcaatagcaaggttcactgaagaaggggcagccataaaaggcaaaaggacagttaatttattaaagggtaggacatttttcagcagtttccaaagagaaatgttaacactagtgcacttgtatataattagacaaattcatcaactgaccctgaatttcatagtttgtattcctgctaaggaaaaacaactagttttctatatgctattaggctaatgatttgtttgactgccatgtatgcatcatcagaaaaagaaaacacttagcaattgtagcatttgcccctagaataacctttctaaagagactttggaaacattccctaattgaagctttgatccacacctgggaccacacaagacataaaaacgcagtcagaaaagaggcagagaagagctattctctgaaacagagagtattaacatcccttctttaaaagggcacagaaagaacactggatttcactataagatgaagatattttgggaaagtattctatgcatgccaaagttccagctggcaccagagcatacctctctctatcagctaagaccacagactaatactatattaaccatttctttaaaaatatctccagtgtgagctggcaggtttgtttatccacaaaagagtctggagacttactctgacaagctggtgtaggacatattttttgtcacatgaaaacacataccacacgacaaatttttagatacaaaatgcaaacttagtacttatctgttgactctctaaatttttctagaaaatttcaacagatacagaaatagaataccacatactccacattcaacttcaataattattaactcatgagaaggggtggtggggataaacccagctctgctgaacaagccttgagccctggcctggggctgctcctgcctggggcagggagcccctttttataatgtgcacgaagtctccatatggcctagaggtagcccaggagctggcatacaaaagttgggtggcatctcctgaaggaggagacattatagaggcatgtcactttctgagactcagtttacaaagcaagatgcagagaagaaaggaaggctggcagcttgaactgagctgagccatctgacaagtgaagacagggtcctggcaggcaggactccctactgtggaggtcagggccttcctggcactctgtgaggccttttctgggtgttctccaagctgctgtccactgccaaggaggagcctccaccaggcaggccagagtggcatgcaactgctggcacccagcggctaccacattcccacccagatgctgcctgagctttgggcacaccccttcccacaactgtccccttgctttccccctcctcctgggctatcatcaggctgtagcgaaagcatcagaagctccctggggatatgtctgaaaccccttggctgggataatcagcaccagaaaagcattaaaaacaggaagccacagggataattgacaggcattgctgcaaacacctggggtgggggtgtgctcagaatagggacagaataaggagaggcagcgtccaggattggggaagaataacacaggactgttctggggatgtggggatgtgtctcatcataaggtcccattcattatgttccactaggttctcccaatatactaaagctgagatcataaactgtcatgacaaagaacaggtcatctgtactttctctgaaagcctcatgattagacagtagaatagcttagaagagtgacataatgtttagaccctttttttctgtttcttgcccagagttctttcacaacctctagatgatatgaaaatggacacaacacatggctccaaaatcccagagtactacagaattcttaaacccatgcatggtagataagaaggcaaaaagcaaagcagttataaatggaaggctgcaagcagaagctttctgtttacc

SEQ ID NO: 152 - DNA, 3223 bp, Homo sapiens
ttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattggactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtatgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatatgtagcctttttagattggcttctttcattctgcaatatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaaaaaacaagattgcagggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcaattcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccactgggtcatagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaataaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagctgccgaccttcacgagcgctgattggtgtgttttacagagcatggattggtgcgttttacagagcgctgattggtacatttcacagaactcgtgagacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttc

SEQ ID NO: 153 - DNA, 1521 bp, Homo sapiens
attcccagggccagatggggaaacacgggaggggaggagctggccacctgccaagcccagacctctggccgagccccagctcctagattccagcctgtgctcagcctctgactctacacctgactttcagcaagtccctgatccctctgagcctcagtttccccatctcttgagttggcacagagagttgtgaaaaagaactcagaggctgggagctggagcgggaagggagtccccagggagcacagctgactggtcttcacaccaaaagcaagcacaggagaaagggagctagcatttcccagtgcctgtggtgtgccaggagctcctgcattttccattaattcccatcaccctgctatgaggtaggcattttctccccattttgcagatgatgaaactgagccccaaacaagcagagattatagagctgggtttgaagctagctctccttgcttggggcctgggattctgtccacagcagccactgggccatacctgcaagggtgtcagaaggtttgtgctggcgtcagtgtcgccaaggactctgggagccactcacattttgggcactgcctaaagttgattactttgttaaccctgcccaggccccaggcagaggctttaaattgttagaacaatgaagaagggagagctggataaacactggccaggcttgagggagtcctgggacatagttggggtaaaggactgatcagagcatatgctgaggctcaggaattcataggcatcttcctccagctccctgacacagggtacctagaagactaacgatggtggtgctgagtactagaaaggttctgtcccggacacaaatctagacaccaagtctggtcccccgaacaaggcagggacccaggttattggagcaaggctgtgagtccctgaggtgaggaactacagggcttggcctgaagatggagcttggcacggtttgtgcaggagcaagcgggtcaacaacaggccagcatcacaggtccacaggactggcccagccccacacccatgccaggtttctgccctgccacctaaggtgaggctggctctgccatggtgcccatgggtggtggggcgggggatgaggaggtctagtgcccacagagctggctctgccaccactgggcattttcagagatagagtcttgcccaaggattaccccatagaggttttaccaaggaacttctggagacagaagggcttgacccaaagacatcgtgttgacataaaattccaagcactggcagaccactcattttctctcaaaacccacttttcctgagcaactgttccgagccaggccctcttctggaacacagaagcaaaccaaatctactcccttaaacaatgggactcacaccaggtgctcaggaatgggacggaggggaggaagcagaggagctctgggactgtagcccagccagaaggagcccagaagtaccaatccagtgtgggatcaggggtcagggaagacttcttggaggaggctacctaaggttgag

SEQ ID NO: 154 - DNA, 1064 bp, Homo sapiens
gcacttactgggaattcctcattcatggggaaaaattgcaatccctgatcaccatcgccaatgaggttcaacaggttacccacatctgccacatagggtaggcacacgctgagccagtcagtgtagcgcgcgtgcagccctggacatttaagggcatcacagacctgttattgctcaatctcaggtggctgaacgccacttgtccctctaagaagttgggggatgccgaccgctccagggtcacataactagttggcatgccagagtctcgttcgttattggaattagccagacaaatcactccagcaactaaggccatgcaccaccacccgtggaatcgagaaagagctatcaatctgtcaatcctgtccgtgtccaggctgggtgagttttcccatgttgagtcaaattaagctgcaggctccactcctggtggtgcccttctgtcaattcctttaagtttcagctttgcaaccatactcccctcggaacccaaaaacccaaagactggtttcttggaagctgcccagcgggtcatgggaataacaccgccacatcgccagttggcatcgtttatggtcggaattacaacggtatctgatcgtcttcgaacctccgactttcgttcttgattaatgaaaacattcttggcaaatgctttcgctctgttccgaaaaccaacaaaatagaactgtggtcctattccattattccaagctgcagtatccaggcggcttgggcctgctttgaacactctaattttttcaaagtaagtgcttcgggccacaggacactcagctaagagcatccagggggcaccgagaggcaagaagcagggacgggctgtggctcgctagcccacccgctcccaagattcaactacgagctttttaactgcaacaactttaatatacgctattggagctggaattaccacggctgctggcaccagacttgccctccaattgatcctcattaaaagatttaaagtgcactcattccaattacagggcctagaaagagtcctgtattgttatttttcgtcactacctcccccccaaccg

SEQ ID NO: 155 - DNA, 12952 bp, Homo sapiens
gaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactgctcttcattcgatgtacaaaaaccacaagattatctaaatagatgcagaaaaggccttcgataaaaatcctcattccttcatgttaaaaactctcaataaactaggtattgaaggaacatacctcaaaataataagagccatttatgacaaactcacagccagtgtccttactgaatgggcaaaagctgaaagcattccccttgaaaaccagcacaagacaagtttgccctctctcccaacccctattcaatatagtattggaagttatggccacggcaatcgggcaagagaaaaaaatgaagagtatttaaatgggaaaagaggaagtcaaactatctttttttgcaggtgacataatcctatatctagaaaacccattgtctcaacccaaaagcttcttaagctgataagcaacttcagcaaagtctcaggataaaaaatcaaagtgcaaaaattgctatacaccaacaacaggcaagccaagagccaaatcatgaatgagctttgattcacaattgctacaaaaagaacaaaatacctaggaatacagctaacaagggaagtgaaggacctcttcaaggagaactacaaagcactgctcaaagaaatcagagatgatgcaaacaaatggaaaaacgttccatgctcatggataggaagaatcaatattatgtaaatggtcatactgcccaaagcaacttataaattcaatgttattcccattaaattaccactgacattcttcacataattagaaaaaactattttgaaatttatatggaaccaaaaaagagcctgaatactgaaagcaatccttagcaaaaagaacaaaggtggaggcatcaggctagctgacttcaaactatacgatagggctacagtaaccaaaatagcacggtactggtacaaaaacagagacatagaccaatggaaaagaatagagaatacagaaataagactgcacacctacaactgtctcatctttgacaaacctgacaaaaacaagcaatggagaaaggattccctatttaataaatggtgctgggagaactagctagccatatgcaggatattgaaactggcaccttccttacgccttacacaaaaatcaactcaagatggattaaagacttacatgtaaaaccccaaactataaaaacactagaagaaaacctgggcaataccatttaggatataggcattggcaaagatttcatgatgaaaacactaaaagcaattgcaacaaaagcaaaaattagcaaatgggtctaattaaactaaagagcttctgcacagcaaaaggaactattaacagagtaaacagacaacctacagaacgggcgaaaattgttgcaatctatgtatctgacaaagccctaatatccagaatctataaggaacttaaacaaatttacaaaaaaaagcaaccccattaaaaagtgggcaaaggacatgaacagacacttctcaaaagaagacatacatgtggctaacaaacatgaaaaaagccttcacatcactaattattagataaatgcaaatcaaaaccaaatgagataccatcttacatcattcaggatggtgattattaaaaagtcaaaaaatgacagatgctgatgaggatgtgaagaaaaaggaacactttaatactgttggtgggagtgtaaattagttcaaccattgtggaaaacagtctggtgattcttcaaagacaaagaggcagaaataccattctacccagcaatctcattactggttatatactcaaaggaatataaatcattttcttataaagacacatgcacatatatgtttattgcagcactattcacaatagcagacatagaatcaacctaaatgcctatcagtgatagattggataaagaaaatgtacatatacaacatggaatactatgcaggcataaaaaggaatcaggtcatgtgcttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaacaagaaaaaaggatgaatgccatttaccaagattatagaaaatagccagtctgtttattcttacactatcaattgacacaacttccagttaataagttcactttattttctgaaagttacaggagaagactttactggttatgaccttatactgctttaatggtcatctgtagccaaaatcatggacataaattctgaggagggttcctggtaagcctcccattcctgctatgagaagaaaccagcatgcccatgcttcccagcagcatactgtaattgctaagtgtcaatgatgatgtcagttttagtgtctcagtaacagttgctagaggaaggaaggaaggaaggaagggagggagggagggagggagggagggagaggatgaagaaaaagaacgaaaagttagaaactatgtagtcccagcctctagaagccagaggcatgaggtctacttagggtcctcttgagacaggtgaagacttttcagtgtcacaaaattaatatcacaaagtgatattatgttagtattatgacatcaaaatgtgtgggcaggctgggcacagtggctcacgcctgtaatcccagcactttgggagtctgaggcaggtggatcacctgaggtcaggagttcaagaccagcctggccaacatggggaaaccccgtctctattaaaaatacaaaattagcggcgcatggtggagcaagcctgtaatcccagctacttgggaggctgaggcaggagaatcacttgaattcaggaagaggaggttgcagtgagccgagatcgtgccattgcactccagtctgggcaacaagagtgaaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgattatggtcatcaaaacttagtatgatcaaggaaactggtttttgcataatattctgaatatttaaactccacagagcttgaataaatgaagtacaaattaaacatatcgatttttttcttttggtacatggtctatgttattgcagattagcatcccaaatcccaaaatcccaaatttgaaatgcttcaaaactgaaaccttttgagcactgatataagtctcaagggaaatgcattttggatttcagatgctcaaccagtaagcacataatgcaaatattaaaaaatctgaaatccaaaacacttctggtcccaagatatgggatactcatcctgtaccatggtaaatggttagttcttccttggcttatgccagtggttcttgatttaagccccaggagatattggaaatttctggaaacatttttggttgtcaaagcttgggggtggagtatgtttctggcatctaatgggtagaggccagggatgctgctcaatcttataatgcataggacaggccccagaagaaagaattgcctggcccaaaatgtcaatcactagtgctgaggttgagaattcttgacttaggccatagccgttccacagctcaagtcacagttgcattcctttagttgaaccttacagttcagttgttctactcaatatttgaatgctgaaggaagactggccctctagggttgtatttctagaacagggagaatgtagtactttgaggttgcatgctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttagaacactttcattactccataaagaaaccccatgcccattagcagtcactccagttcctctcctagtcctgggcaaccactaatgtaatttctgtctctaaagatttgcctgttcttatgaggagtggcggtgtacacctgtagtcccagctacttgaggaggccaaggcaggaggatcatttaagcccaggagtttcaggctgcagtgaattatgatactgctactgcactcccatctgggtgacagagtgagaacccatcctctaaaaaaaataaagatttgcctattctagacatttcttataaacagaaatatacagtattttgggactgctttttttcacttagcataatgtttttaaggttcatccatgttgtagcatgtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactcagtctgtggtattttgttatggcagctctagcagactattacaggtaaatacctaggagtagaaatgttgggtcatgtggtaactccatttaacactccaggtacctgccagactgttcatatgagtttttgtatgaatatatgttttattttctcttaagtacataggagtggcatagctgctaggtgtacatttaactatttaagacacggataaatggttttccaaagcagctgtaccattttacattcctaccagcaatgtttgagggttccaattttctgtatccttaacaaaacttgttattgtctatcttttgactatagttcagggactaagctctgatttttatcttgcccaaattcctacctaagaggtctggggagtcatgtcctacaaaccatggatcctcatcagatggcttttatttgaccatgtatattgtgacttgcttttcaatctgactctggcgtgacattatgagacaaggaaataatatttagccccataatatatttccttgccatgcctcgaaattgccctgcaaagtctcttgtgggaaaaatccacattccatagaaaatctccttccccttttattttctttcctttctttgcagatccagtggataatcaactaagagctaggcatccttttagatttgataagaaacattttacaacctaccctctctctgaagtctgccatctgagagattcttctgaacaataaaactggttctccacaatcctttatcttaacctgaacattcctttctattgatcccaagtctttagacaaattcaaccaactgtccacccgaaaatgtttaaatttacctatagcctggaaggccccactttgagttgtctcacctttctgaaccaaaccaatgtatttcttaaatgtatttgattgatgttttatgcctctctaaaatatataaaaccaagctgcaccccgaccaccttgggcacatgttctcaggaccacctgagggctgtgtcacgggccaaggttgttcatatttgactcagaataaatctcttcaaatattttacagagtttgactcttttcatctacaagtcatgtggtgtaaagtgatagctcattgttttctaatagactattttctacgaaagttttaggttcacagcaaaattgagcagaaagtacacagagttctcatatacccctgcctccccccaaccccatgcacaacctttcctactatcaatatcccacatcacagttgtacatttgtttcaaattatgacacatcattatccaaagtccacagtttatattagggtccatttttggtgttgtacattctatgggtccagcaaatgtgtaatgacatatatccacccgtgtagtagcatacagaaggctcactgtcctaaaaatcccgttttgtttattcattccttcctcctctccaaaccttcatatttcggttttgatatctactttcccagctgctaaagctgttgatcatcttttcatgtgcttattggtcacttacatattatcttctttggagaaatgtctattcaaatcctttgcccagttttaaattgggttatttgtctttctgttgttgactatcactttttaaggttgagtttgctccctgccaaggaggaaaacccatgacttttgtctactatgagaaaaacgctaatactttattattctggagaatggcttcctcaggaatttcactgttcctttctacttgagattcactaaatgttaatacagccactttgtggtttcggagcagagccatcatttttcttggcagccagatttataggactccaaaagaaacaaccagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaactttaaaaaaaaagaaaataacaccccccattcctccttgtatttcttagttggctgaagatattctggaacttaacaccatatattttgggagaaagaaaaacaaacctaaaacagaaaataccatagttatttaaatataggacttaaactcttgaagtttatctgcacttaaaaaaattctttccttttcttaaaatttttcagaaaggatttcactatctcctttgatagtttattctgcattctaaaactctcttttctcatggataatcaaaaccgatcctataggcgcctcttctgtattcagtagaaaaggtgactagcagccgggtgtggtggctcatgcctgtaatcccagcactttgggaggccaaggcaggtggatctcctgaggtcaggagttcgagaccagcctggccaacatggtgaaaccccgtgtttactaaaaatacaaacattatctgggcatggtggtgggtgccttgtaatgccagctactcgggaggctgaggcaggagaattgctggaacccgggagtaggaggttgtggtgagccaagatcgcaccattgcactccagcctgggtaacgagtgaaactcaatctcaaaaaaaaaaaaaaaaaaaaaaggaaaaaagaaaaaaagaaatggtgactagcttccccccaccatcttgatataatgatgaaattcttcacgccttctctacccaatgagggagaaaacaaacatgaaaatattgcaagacacaagactaagtactaacatttgttgacaatattaattttctcaatgtttaggtttctgaaaacagaacatttactgttgactttttccctcatgttaccaggtgtatctccaaacattctagaaacttcatgagataataaattattattaagcctaaattaggtgctttatctactttttgactgaaaaaattgaaacatggaataaattcattatttaatattaacataggtctacatttcctctgcaaaattcttgacccataactgccaattttaagattaaaaatacaggctgagtgcagtggctcatgcctgtaatcttagcactttgggaggctgaggcaggaggatcacttgagcccaggagtttgagaccagcttgggcaacatggagaaaccctgtctctacaaaaactacaaaaatcatcctagtgtggtggcatgtgcctgcagttccagatacctgggagattgaggtgggaagatcaccagaccctgggaggttgaggctgcagtgagtcatgatcatgccaatgcactccaacgtgggtaacacagtgagatcttgtctcaaagaaaaaaaaaaaaagttgaaaaggaaagaaaaaaacttttcaggaagggtacacatgcaaagcaagcctggcacgtaatgagtataaattagaaactatataaaatatatacattacaaaatataataagttaatgtatataaaatagaaaatatacttttttggttaataaaacaaaatgatgtgaggttatgaagaaattgtataatttcttaattggctttgaaagcaatttcaagcatcctaaaagagtttcgagtgataaaaacttaactagaataaaagcttctcacattcgtaagagcaacaattacttctcttccagtgatctccaaacttatttaattacatatctcaccagtaaaaggtttgtgcaactatatatccagtgcacatttatttaaaatgtaaataggttattagctatttctattttaaagcacgcataaattatagttggagtaaaacaatgtaaaagattgtgtttttacttactaatgggacagaatctttttgctgttattaaaacatagatttttagtttttaaataaaaacaggctatggaatatatttcattatttaaattctttgttgttgtttgtattagtccattttcatactcttatgaagaaatccccaagactgggtaatttataatgaaaaagaggttgaattaacttacagttcctcatggctggggaggcctcacaattagggttgaaggtgaaggaggagcaaaggcatgtcttacatggtggcaggcaagagacttgtgttgagcatgttgtttttgttgacacatatgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 156 - DNA, 12856 bp, Homo sapiens
gaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaaggctcttcattcgatgtacaaaaaccacaagattatctaaatagatgcagaaaaggccttcgataaaaatcctcattccttcatgttaaaaactctcaataaactaggtattgaaggaacatacctcaaaataataagagccatttatgacaaactcacagccagtgtccttactgaatgggcaaaagctgaaagcattccccttgaaaaccagcacaagacaagtttgccctctctcccaacccctattcaatatagtattggaagttatggccacggcaatcgggcaagagaaaaaaatgaagagtatttaaatgggaaaagaggaagtcaaactatctttttttgcaggtgacataatcctatatctagaaaacccattgtctcaacccaaaagcttcttaagctgataagcaacttcagcaaagtctcaggataaaaaatcaaagtgcaaaaattgctatacaccaacaacaggcaagccaagagccaaatcatgaatgagctttgattcacaattgctacaaaaagaacaaaatacctaggaatacagctaacaagggaagtgaaggacctcttcaaggagaactacaaagcactgctcaaagaaatcagagatgatgcaaacaaatggaaaaacgttccatgctcatggataggaagaatcaatattatgtaaatggtcatactgcccaaagcaacttataaattcaatgttattcccattaaattaccactgacattcttcacataattagaaaaaactattttgaaatttatatggaaccaaaaaagagcctgaatactgaaagcaatccttagcaaaaagaacaaaggtggaggcatcaggctagctgacttcaaactatacgatagggctacagtaaccaaaatagcacggtactggtacaaaaacagagacatagaccaatggaaaagaatagagaatacagaaataagactgcacacctacaactgtctcatctttgacaaacctgacaaaaacaagcaatggagaaaggattccctatttaataaatggtgctgggagaactagctagccatatgcaggatattgaaactggcaccttccttacgccttacacaaaaatcaactcaagatggattaaagacttacatgtaaaaccccaaactataaaaacactagaagaaaacctgggcaataccatttaggatataggcattggcaaagatttcatgatgaaaacactaaaagcaattgcaacaaaagcaaaaattagcaaatgggtctaattaaactaaagagcttctgcacagcaaaaggaactattaacagagtaaacagacaacctacagaacgggcgaaaattgttgcaatctatgtatctgacaaagccctaatatccagaatctataaggaacttaaacaaatttacaaaaaaaagcaaccccattaaaaagtgggcaaaggacatgaacagacacttctcaaaagaagacatacatgtggctaacaaacatgaaaaaagccttcacatcactaattattagataaatgcaaatcaaaaccaaatgagataccatcttacatcattcaggatggtgattattaaaaagtcaaaaaatgacagatgctgatgaggatgtgaagaaaaaggaacactttaatactgttggtgggagtgtaaattagttcaaccattgtggaaaacagtctggtgattcttcaaagacaaagaggcagaaataccattctacccagcaatctcattactggttatatactcaaaggaatataaatcattttcttataaagacacatgcacatatatgtttattgcagcactattcacaatagcagacatagaatcaacctaaatgcctatcagtgatagattggataaagaaaatgtacatatacaacatggaatactatgcaggcataaaaaggaatcaggtcatgtgcttcgcagggacatggatggagctggaggccatcatccttagcaaacttacacaggaacagaaaaccaaatactgcatgttctcacttacaagtgggagcaaaatgatgagaatacatggacacatggcggggaacaacacacactagggtgtgttggagagtagggagaggatcaggaagaataactattggataatgggcttaatacctgggtgataggatgatctgtgtagcaaaccaccatggcacacatttacctatgtaacaaacctgcatatcctgcacatgtatccctgaacttaaaataaaagttggaaataaaaaaaaaagagtgattatgtcagggactaggtggtagctgtggagatgatgaaaagtggtcagagtctagatgcattttgagggtgggcttgattggctggtggattagatgtgaaggatgagagaagaaaaaggtactaggatgactctagagtttttgccttgaacaagaaaaaaggatgaatgccatttaccaagattatagaaaatagccagtctgtttattcttacactatcaattgacacaacttccagttaataagttcactttattttctgaaagttacaggagaagactttactggttatgaccttatactgctttaatggtcatctgtagccaaaatcatggacataaattctgaggagggttcctggtaagcctcccattcctgctatgagaagaaaccagcatgcccatgcttcccagcagcatactgtaattgctaagtgtcaatgatgatgtcagttttagtgtctcagtaacagttgctagaggaaggaaggaaggaaggaagggagggagggagggagggagggagggagaggatgaagaaaaagaacgaaaagttagaaactatgtagtcccagcctctagaagccagaggcatgaggtctacttagggtcctcttgagacaggtgaagacttttcagtgtcacaaaattaatatcacaaagtgatattatgttagtattatgacatcaaaatgtgtgggcaggctgggcacagtggctcacgcctgtaatcccagcactttgggagtctgaggcaggtggatcacctgaggtcaggagttcaagaccagcctggccaacatggggaaaccccgtctctattaaaaatacaaaattagcggcgcatggtggagcaagcctgtaatcccagctacttgggaggctgaggcaggagaatcacttgaattcaggaagaggaggttgcagtgagccgagatcgtgccattgcactccagtctgggcaacaagagtgaaactccatctcaaaaataataaaataataataataataataataataataatgtgtgggcagatgtcatctacaccatagtttcagaatgcaataaattcacatttaaaaaccttgaagtacaccgtatcaaaactttacttcatctttcattcttatgtgattcagttgataggctggaagaacaatgaaagtgagttccatcatgctgcctggtgtccgtgtccttaatgataaagactttgagtgtatttgcaaactctctgttaatgacagcatttttttttattctgagctttattaaggtataattgacatacaaaaattgtacatatttaaggtgtataatgtaatgttttgatatacatatacattctgaaatgattaccaaaatcaagataattaacacatccatcacctcatagttatccatttagcaaatcctttactaggtggcaaaattgattttaaaatcacatttttatccccttgaagttttttcatctgtaaattttcaagggcagtcttttaatagaatacaaacagctcattccttatgtggctccaagctggcatttcagcattgggtttaaactttagagcaacatatgaaaatctcctgaataaacttgtcaatgattatggtcatcaaaacttagtatgatcaaggaaactggtttttgcataatattctgaatatttaaactccacagagcttgaataaatgaagtacaaattaaacatatcgatttttttcttttggtacatggtctatgttattgcagattagcatcccaaatcccaaaatcccaaatttgaaatgcttcaaaactgaaaccttttgagcactgatataagtctcaagggaaatgcattttggatttcagatgctcaaccagtaagcacataatgcaaatattaaaaaatctgaaatccaaaacacttctggtcccaagatatgggatactcatcctgtaccatggtaaatggttagttcttccttggcttatgccagtggttcttgatttaagccccaggagatattggaaatttctggaaacatttttggttgtcaaagcttgggggtggagtatgtttctggcatctaatgggtagaggccagggatgctgctcaatcttataatgcataggacaggccccagaagaaagaattgcctggcccaaaatgtcaatcactagtgctgaggttgagaattcttgacttaggccatagccgttccacagctcaagtcacagttgcattcctttagttgaaccttacagttcagttgttctactcaatatttgaatgctgaaggaagactggccctctagggttgtatttctagaacagggagaatgtagtactttgaggttgcatgctttagaattagtcattatgtgagttggaagaccatttgattctttattagaagttagcaagtgtgccagattagaccttcacccaagaacgtcatgagggttaatgagaggtttttaaaagataatagttatctttgtttcatgtttaacaactttatgcattggctggtcattccagctccacagaaagctcttcagttgagtttcaattacagcccgcaattccagatgctacaacattttaactgtggctgccagatatcagtgagattcacaggcctggagtacaacattctttacaatgtgtgcttcatattttgaaggccatctgtctcattttcatctacaattggctctgccgaagttttgcatgccaaatgatattttttaaaataagcttttgtgctactttaaaaatgtttcaaaaatatcttcgagatacaattcacacaccatgaaattcagccatttaaagtgtacaagtcagtggtttttagtagattcacaaagttgtgcaactatcactacagtctaaatttagaacactttcattactccataaagaaaccccatgcccattagcagtcactccagttcctctcctagtcctgggcaaccactaatgtaatttctgtctctaaagatttgcctgttcttatgaggagtggcggtgtacacctgtagtcccagctacttgaggaggccaaggcaggaggatcatttaagcccaggagtttcaggctgcagtgaattatgatactgctactgcactcccatctgggtgacagagtgagaacccatcctctaaaaaaaataaagatttgcctattctagacatttcttataaacagaaatatacagtattttgggactgctttttttcacttagcataatgtttttaaggttcatccatgttgtagcatgtataagtatttcatttcttttttgtccaaatcatattccattagaagtataaccatatttgatttatccatttatcgtttgataggcatttgggttgtttccacatttgcctactataaataatgctgctataaatattcacatacaagtttttctgtgaacacatgttttcatttctctccattattattataggctgaactgtggctccaccaaattcataatttgaagtcccaacccctagtatctcaggatgtaactgtatttaaagataaggtgtgtatagaggtggttatgctaaagtaaagctgctaggatgggggctctaatcccgtatgaatagtgtccttataaaaagccatcaggggcctgtccgcacagggaaacaccatgtgaggatacagaaaacaaccatctgcaagaaaggagagagatcttagaagaaaacagacctgccagcactgtaatcttcaactgccaggctccaaaactgtaataaataaatttctgttgtttaatttactcagtctgtggtattttgttatggcagctctagcagactattacaggtaaatacctaggagtagaaatgttgggtcatgtggtaactccatttaacactccaggtacctgccagactgttcatatgagtttttgtatgaatatatgttttattttctcttaagtacataggagtggcatagctgctaggtgtacatttaactatttaagacacggataaatggttttccaaagcagctgtaccattttacattcctaccagcaatgtttgagggttccaattttctgtatccttaacaaaacttgttattgtctatcttttgactatagttcagggactaagctctgatttttatcttgcccaaattcctacctaagaggtctggggagtcatgtcctacaaaccatggatcctcatcagatggcttttatttgaccatgtatattgtgacttgcttttcaatctgactctggcgtgacattatgagacaaggaaataatatttagccccataatatatttccttgccatgcctcgaaattgccctgcaaagtctcttgtgggaaaaatccacattccatagaaaatctccttccccttttattttctttcctttctttgcagatccagtggataatcaactaagagctaggcatccttttagatttgataagaaacattttacaacctaccctctctctgaagtctgccatctgagagattcttctgaacaataaaactggttctccacaatcctttatcttaacctgaacattcctttctattgatcccaagtctttagacaaattcaaccaactgtccacccgaaaatgtttaaatttacctatagcctggaaggccccactttgagttgtctcacctttctgaaccaaaccaatgtatttcttaaatgtatttgattgatgttttatgcctctctaaaatatataaaaccaagctgcaccccgaccaccttgggcacatgttctcaggaccacctgagggctgtgtcacgggccaaggttgttcatatttgactcagaataaatctcttcaaatattttacagagtttgactcttttcatctacaagtcatgtggtgtaaagtgatagctcattgttttctaatagactattttctacgaaagttttaggttcacagcaaaattgagcagaaagtacacagagttctcatatacccctgcctccccccaaccccatgcacaacctttcctactatcaatatcccacatcacagttgtacatttgtttcaaattatgacacatcattatccaaagtccacagtttatattagggtccatttttggtgttgtacattctatgggtccagcaaatgtgtaatgacatatatccacccgtgtagtagcatacagaaggctcactgtcctaaaaatcccgttttgtttattcattccttcctcctctccaaaccttcatatttcggttttgatatctactttcccagctgctaaagctgttgatcatcttttcatgtgcttattggtcacttacatattatcttctttggagaaatgtctattcaaatcctttgcccagttttaaattgggttatttgtctttctgttgttgactatcactttttaaggttgagtttgctccctgccaaggaggaaaacccatgacttttgtctactatgagaaaaacgctaatactttattattctggagaatggcttcctcaggaatttcactgttcctttctacttgagattcactaaatgttaatacagccactttgtggtttcggagcagagccatcatttttcttggcagccagatttataggactccaaaagaaacaaccagcattaggcagtattaaataaaatttggagataaaagctaatcagtgtgtataacaattactgatatcaaaatcaaggaataagaatcaaatagcacttcttactgttcatggacttcaaaagatttatatgaatttggtactattaaaacttcctctaaatttaaatatgaaacagatgggaataatacagttacatgagaaatattagtcatttctcagtgcttatgagctgggtccctttggtggacagtatttgtgcaaatgttttagtaactacatgactctgctctgttgtgagccatagttatcatatttttatttattctaaccagttaaattactatttactgaacacccactgcctcttgtactgaagtcattaaattctttgatacattttaaaaaagaaatagttgctttttctctgtttactaactttaaaaaaaaagaaaataacaccccccattcctccttgtatttcttagttggctgaagatattctggaacttaacaccatatattttgggagaaagaaaaacaaacctaaaacagaaaataccatagttatttaaatataggacttaaactcttgaagtttatctgcacttaaaaaaattctttccttttcttaaaatttttcagaaaggatttcactatctcctttgatagtttattctgcattctaaaactctcttttctcatggataatcaaaaccgatcctataggcgcctcttctgtattcagtagaaaaggtgactagcagccgggtgtggtggctcatgcctgtaatcccagcactttgggaggccaaggcaggtggatctcctgaggtcaggagttcgagaccagcctggccaacatggtgaaaccccgtgtttactaaaaatacaaacattatctgggcatggtggtgggtgccttgtaatgccagctactcgggaggctgaggcaggagaattgctggaacccgggagtaggaggttgtggtgagccaagatcgcaccattgcactccagcctgggtaacgagtgaaactcaatctcaaaaaaaaaaaaaaaaaaaaaaggaaaaaagaaaaaaagaaatggtgactagcttccccccaccatcttgatataatgatgaaattcttcacgccttctctacccaatgagggagaaaacaaacatgaaaatattgcaagacacaagactaagtactaacatttgttgacaatattaattttctcaatgtttaggtttctgaaaacagaacatttactgttgactttttccctcatgttaccaggtgtatctccaaacattctagaaacttcatgagataataaattattattaagcctaaattaggtgctttatctactttttgactgaaaaaattgaaacatggaataaattcattatttaatattaacataggtctacatttcctctgcaaaattcttgacccataactgccaattttaagattaaaaatacaggctgagtgcagtggctcatgcctgtaatcttagcactttgggaggctgaggcaggaggatcacttgagcccaggagtttgagaccagcttgggcaacatggagaaaccctgtctctacaaaaactacaaaaatcatcctagtgtggtggcatgtgcctgcagttccagatacctgggagattgaggtgggaagatcaccagaccctgggaggttgaggctgcagtgagtcatgatcatgccaatgcactccaacgtgggtaacacagtgagatcttgtctcaaagaaaaaaaaaaaaagttgaaaaggaaagaaaaaaacttttcaggaagggtacacatgcaaagcaagcctggcacgtaatgagtataaattagaaactatataaaatatatacattacaaaatataataagttaatgtatataaaatagaaaatatacttttttggttaataaaacaaaatgatgtgaggttatgaagaaattgtataatttcttaattggctttgaaagcaatttcaagcatcctaaaagagtttcgagtgataaaaacttaactagaataaaagcttctcacattcgtaagagcaacaattacttctcttccagtgatctccaaacttatttaattacatatctcaccagtaaaaggtttgtgcaactatatatccagtgcacatttatttaaaatgtaaataggttattagctatttctattttaaagcacgcataaattatagttggagtaaaacaatgtaaaagattgtgtttttacttactaatgggacagaatctttttgctgttattaaaacatagatttttagtttttaaataaaaacaggctatggaatatatttcattatttaaattctttgttgttgtttgtattagtccattttcatactcttatgaagaaatccccaagactgggtaatttataatgaaaaagaggttgaattaacttacagttcctcatggctggggaggcctcacaattagggttgaaggtgaaggaggagcaaaggcatgtcttacatggtggcaggcaagagacttgtgttgagcatgttgtttttgttgacacatatgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 157 - DNA, 987 bp, Homo sapiens
attggcagttggcccttcagctgctgtacagcctcggtaggggcccaggggtattgaatctggttttggaccacaggaggagagtgaagtgaagtacaaccaatattgtcaacagcaagatcgtcaagtgagtcctgataatatattcatggaaagatatattgttctgcttctaggttctgtagggaaggagggcccagggagaatgcatgttgcaactctgcaagcagaatctacccctctgcccatagaagctggttgtggttgttcagttttcctttagctttttggtttcatttctgcaagtggcatgttttggttgctaagcaaggtgttgcaaaatatgaggtgagatgtcaatataactttaaaaggggagatgtggtcagaagggacgtaatactcagattttaagaagaaaaaggatttttgaatttggcattattaacagagagctgtcatgttcctttccctcaacagagaaaataagtgacccaaaatagaaaataaatgaccctttctgtgattagcaactcactgtgtttgtttagtgtcaagaatgctattagtaactaataaaaatttataatcatgagatcacctccccaaacaaaaatgaataaacagagaatacatctttatagcaagtctaatgacacctttgcagctaaggagtctggacctagcagagtatcctgcatgcctagagcaggcatttcataaatgttgaaaaatgagtgttgtttgctgaatattgaacttgcctttgcagtctatatccctccccaaataatcagcctgttgtatgacctccagatttatattattgcaccgtcactttggtgctgagatttggcataattactttaggaaaatatcccttattgatacacacattagtccactgtagtgagtggcacctggtatgggaccctaaacctgatacattctcaataaatgcttgttaacctgaatagtcactaggaa

SEQ ID NO: 158 - DNA, 3141 bp, Homo sapiens
ttaacaccacttgctcaatccgtatgcaaatttcgttgtctattttgttaaaacatgtccatatacgacccttttccaccactgttcaagccactgtcatcatattatatatctcatgcacaggactgtttaagataggccaacacgatgccccttcacaaggacccaataaaatctacattgtcttatggccctacagatacctttgcctcttacccttgcctctcatttggaaaaatgtatctagattttaggttgggaaaaacagttcttattaataaaatgcatattcttctgaatctgttgtttggtcaggacctactatgcagtcttgacttttgacattcaatagcctagattttaaaaatcccaagtttcctttctgtgttttggtgctttgtcctgtggcagtgaatgctttacaaattctattttaagtggaggaagaacacgtttaaaaataatttctggaaatgaaaaaacatatcataaaatgaatgcctctccccatatataccattcgaatatttttattattcattaacattttgatgtattttcttccatccttttttctctgctcaattttgaaaacatttgcaacaaaataaccatttaattttatatcctggatttcttccaatttatcattataatctgaacactcttcatattattaaaaacgttctataaatatcatttcaataattccaaaatattatatgaatgtacatagtttatttaaccatgatcagttagaatactttaaacattttaatttgtatgtaatattttgtatgttcaaatttaccaaaatttctgattactcccgcagtatagaaaagttaaattgctaggtcaaagtgctttaacattttaccattcttgatattatagcttcatgattaagtgcatgaatttttaaagtcagatataccctatatggaatcccgaatccaccaaaattatgagaagtactatgttgaagaggaacggtgagagtaggcatcctggtcttgttcccgttctcagagggaatgctttcaacttttccccattcggtattatattggctgtgggtttgtcacagatggcttttattacattaagagaagacagctataactccaaaagtgagagaaagtagaagacatgccagtgctcaaaagctacaaatgtaaccagagccgtggcataaaatgaaatacttctggttcatatacttccactgagcagcattgcattttatacacttcttctttaatggttcagacatatagttcttaacatcacatggagactcataaccttcagaatacagcatgaatcagctggctgcactgcaaagagaatacaaaataccatcaagaatgtcctaactggaacagtaaacttttaaagtacaaacaactcatctgttagcagcctggcattttgctttctggaaagtaaatacattagagagatatctttaaagagagtctattacctgtgtaagtcagcaattttcaatcatgactgtagcagatccaggtgagagacactgcgacctggccttatagcaggaccaataagcataagcaatcccttggtcctaagagtttgtgcatacttatatatacatgatgtctcttaaataacccagaaaaaatgctctgagaagacctgaattacaagtgtgtggaatacctccatcttctgcttaactgatgtccagcttagtgagagatgttttctatttaatcccacaccttgtgtaggatgggataagaattataaattaacaagtcaactatattaaaagagaaattgaagaatgacttaaaccttctcagtctcaaattactccgtcctggatacatatagttgaatcctgttaagtaaaatacaagtgtaatatgtcgtccccatgctctaaaacactacaataagaaaggagacaaaagaaagaaaattataataaaatcttatcttcaggaatccttaagagaatacatcattctgaactgtcaaagatttgctcacttgaatcttcttataaaaatctttctaaattgcattgcttatttcactacattcttaaacaacgtactctataatttaatctgttcttagatgatataagattattgttattttaaaataaaagtccactctagtgtacagcaatggtggctgcatgatctactgtggtggataagactgagtattgctgagctttgtgagttattttgttttgctttatggatactgttttttttttttttgctgaaggaaaccagtattgttttctgttatatttgcaatcaaaagcatcttaactgaaagaatttggaatcaggaagtagggtgttacataaagccatgaaagtgtccttaatattttgggaagataatgtagaagtatatggcgtaaaatgactaaatggtaattaaattatcttccttggtcacctgagctcaactgcccaacaggatataaagctctaggagacaatgttgccaccaccagtgaagaattcaaacaattcagtgactatcagtagaagtcagtgtttctgatgcattagtaatattaaagaaagagattatcaaattcaaatacataaatttttgtctcacggtacgaactaaaacctaggaacttttagttactgggctaacagcacctctaatgtcttttatttccccaaatcacattgtaatgatttggcatccagtaagagtaacgaaataggtggtcagagtaaatagaaaaccccactgattagaaagaggaatcagtgataatacttctttcatttaccattggttactgtttttcaaaaatgagaacatttagagatttagcaaaagcattacgcatctccatctgctttccatgtcaggcaagacagatactactcactacaaataattatttaaaggatggagggaggaggaggaaatccagaaacaatgtttatttgaacatcttgaaagacagcacaattatgctgttttataagacatgtataacttattattgtaagaactttaaggttttttttttcatttttttttttgctggtctgtatattctaaattttatttatacctatgtattatatttgttataagaatataagcacaatagaaaag

SEQ ID NO: 159 - DNA, 874 bp, Homo sapiens
aagacaccgaaacaaggatttcagtgcaagttgtttcatgggagacttcaagaagcatcagggtcgatcccagcactttgggaggccaaggacatctttcaatggctcctggccaactggcagcagaattttaccttcctgtgcatgaatgaccttggatattattcttggtggcatgactggacacctgcagcctcttgatgtttccagtcaaaaaggtatttaagagccatttgtcaggcggaccacttgagcccacgagtttgaggccagcctgggcagcatagtggcacgctgtttctaaaaaacaaaacaaaacaaaaacaaaacaaacaaacaaacaaacaaaaaacgaaagaaaggaagaaagaaagagaaaagagcagtaatatcttcatcactggtcattggtcattgtctttaaaacaactttccatcgatatcttctggggagaacaagagagcactagtgtcaaaacttcaaccagcttggaagaaaattctggagataagagagcaataattttttaggttgaatcacataagtttgccatcttttggtcaaaaacagtctaatgagcaatttcacttggttccacttacaagaaaagttccatctctaacactcttgatgggactgtgtgcagaaataagggcattgacaagtcggaattaaaacataatctagaagggttgcattctgaatataaaaagttttaggaatatttaaaccagtttgttttacttatattttccttctttatacatatgacaagagtaatattttttaaaaaattatttaaaggcctattcatagcttgaaaaaaaattcttgcagtaaaagcatttgcaaaaatatgaaataaaatttgac

SEQ ID NO: 160 - DNA, 1628 bp, Homo sapiens
aatgggctgcattaaaagcaaagaaaacaaaagtccagccattaaatacctgaaaatactccagagcctgtcagtacaagggtgagccatgggagcagaacccactgcagtgtcaccatgtccatcatcttcagcaaagggaacagcagttaatttcagccgtctttccattccattataccatttggaggatcctcaggggtaacaccttttggaggtgggcatcttcctcattctcagtggtgccaagttcatatcctgctggcttaacacgtggtgttactatatttgtggccttatatgattatgaagctagaactacagaagacctttcatttaagaagggtgaaaaatttcaaataattaacaatacagaaggagactggtgggaagcaagatcaatcactacaggaaagaatggttatatcctgagcagttatgtagcgcctgcagattccattcaggcagaagaatggtattttggcaaaatggggagaaaagatgctgaaagattacttctgaatcctggaaagaacaaaacaaaacaaaaacgagagagcgaaactactaaaggtgcttattccctctctattcgtgattgggatgaggtaaggggtgacaatgtgaaacaccacaaaattaggaaacttgacaatggtagatactatatcacaaccagagaacaacttgatactctgcagaaattggcaaaacactacacagaacatgctgatggtttatgccacaagttaacaactgtgtgtccaactgtgaaacctcagattcaaggtctagcaaaagatgcttgggaaatcccttgataatctttgcgactagaggttaaactaggacaaggatgttttggcaaagtgtggatgggaatatggaatggaaccacaaaagtagcaatcaaaacactaaaaccaggtacaatgatgccagaagcttttcttcaagaagctcaggtaatgaaaaaaataagacatggtaaacttgttccactatatgctgttgtttctgaagagccaatttacattgtcactgaattgatgtcaaaaggaagcttattcaatttccttaaggaaggagatggaaagtatttgaagcttccacaaatggttgatatgcctgctcagattgctgatggtatggcatatattaaaagaatgaactatattcaccgagatctctgggctgctaatattcttgtaggagaaaatcttctgtgcaaaatagcagattttggtttagcaaggttaattgaagacaatgaatacacatcaagacaaggtgcagaatttccaatcaaatggacagctcctgaagttgcactgtatggtgggtttacaataaagtctggtgtctgctcatttggaattctacagacagaactggtaacaaagggcagagtgccatatccaggtatggtgaaccatgaaatactggaacaggtggagcgaggatacaggatgccttgccctcagggctgtccagaatccctccatgaattgatgaatctgtgttggaagaaggaccctgatgaaagaccaacatttgaatatgttcagtccttcttgggagactacttcactgctacagagccatagtaccagccaggagaaaacttc

SEQ ID NO: 161 - DNA, 1852 bp, Homo sapiens
catgcgtggctgactgtgggcgagcgaatcctggaacatcacatgttttgtttgtggagtggtgtgtacattgtttgtagagtggtgtgtacattgtgtgtagagtggtatgtacattgtagagtggtacgtacattgagagtggtgtgtacattgtagagtggtgtgtacattgtttgcagagtggtgtgtacattgtgtgtagagtggtgtgttcattgtagagtggtatgtacatggagagtggtgtgtacattgtagagtggtatgtacattgtagagtggtgtgtacattgtgtgtagagtggtgtgtacattgtgtgtagaggggtgtgtacattgtagagtggtgtgtacattgtgtgtagagtgctgtgttcattgtagagtggtgtgtacattgtttgcagagtggtgtgtacattgtagagtggtgtgtacattgtagagtggggtgtacattgtttgtagagtggtgtgtacattgtcgagtggtgtgtacattgtttgcagagtggtgtgtacattgtagagtggtgtgttcattgtgtgtagagtggtgtgtacattgagagtggtgtgtacattgagagtggtgtgtacattgtagagtggtatgttcattgtgtgtagagtggtgtgtacattgagagtggtatgtacattgagagtgctgtgtacattgtagagtggtgtgtacattgtagagtggtgtgtacattgtgtggagagtggtgtgtgcattgtagagtggtgtgtacattgtgtggagagtggtgtgtacattgtagagtggtgtgtacattgtgtgtagagtggtgtgtacattgtagagtggtgtgtacattgtgtgtagagtggtgtgtacattgtagagtggtgtgtacattgtgtagagaggtgtgtacattgtagagtggtgtgtacattgtgtgtagagtggtgtgttcagtgtagagtggtgtgttcattgtagcatggtgtgtacattgtgtgtagagtggtgtgttcagtgtagagtggtgtgttcattgtagcatggtgtgtacattgtagagtggtgtgtacattgtagagtggtgtgtagagtggtgtgttcattgtagagtggtgtatacattgtgtgtagagtggtgggtaaattgtagagtggcatgtacatggtgtgtagagtggtgtgttcattgtagagtggtgtgtacattgtttgcagagtggtgtgtacattgtgtgtagagtggtgtgttcattgtagagtggtgtgttcattgtgtgtagagtggtgtgtacattgtgtggagagtggtgtgtacattgtgtgtagagtggtgtgttcattgtagaggggtgtgtacattgagagtggtgtgtacattgtgtgtagagtggtgtgttcattgtagagtggtgtgtacattgagagtggtgtgtacattgtgtgtagagtggtgtgtacattgagagtcgtgtgtacattaagagtggtgtgtacattgtagagtggtatgtacattgagagtggtgtgtacattgagagtggtgtgtacattgtgtgtagagtggtgtgttcattgtagagtggtgtgtacattgtagagtggtgtgtacattgtgtggagagtggtgtgtacattgtagagtggtgtgtacattgtgtggagagtggtgtgtacattgtagaggtgtgtacattgtgtggagagtggtgtgtacattgtagagtggtgtgtacattgtgtgtagagtggtgtgttcattgtagagtggtgtgtacattgtggagtggtgtacatggtttacacacgtgtgtgcatggggacaagacttggatggagtttgccatcccctgtta

SEQ ID NO: 162 - DNA, 1395 bp, Homo sapiens
agacagagtctcgctcttgtactatcttggctcactgcaacctccacctcccggattcaagcgattcttgtgcttcagcctctcaagtagctggaattacagatgtgcaccaccacgcctggctaatttttttgtatttttagtagagacggggttttgccattttggccaggctagtctcaaaactcctgaccttgggtgatctgtctgccttggcttcctaaagtgctgagattacaggcgtgagccactgcaccatgctgtttcttctgctaataagacttattttattttatttttttaaatggagtctcactctgtcgccaggctggagtgcagtgctgcgatctcagctcactgcaacctctgcctcctgggttcaagcaattctcctgtctcagcctcccaagtagctgggactacaggcgtgcaccaccatgctgagctaatttttatatttttagtagagacagggtttcaccatgttggctaggatggtctcgatctgttgacctggtgatctgctcgcctcggcctcccaaagtgctgggattacaggtatgagtcactgtgctcggccgagtatcctcttttttttttttttgagacagggtcttgctcagtcacccagggaggagtgcagtggctggaccacatctcatgtacctgaacttcctgggctcatgcgatcctcccacctcagtctcccaagtagttgggactatgggcgcatgccaccacgcctagctaatttttttttttaagtagatactgggtctcactatgttacctaggttggtcttgaactcctgagcttaagcgatcctcccacctcagcctcacaaagcgctgggatcacaggtatgagctactgcacccagcccatcttggatttcttttgcttttttttttgagacagagttttgctcttgttgtccaggctggagtgcaatagcactgcctcggctcactgcaacctccatctcccaggtacaagggattctcctgcctcagcctcccgagtagctgggattacaggcgcccgccaccatgcctgtctaatttttttgtatttttagtaaagacgggggttcaccatgttggccaggctggtctcgaactcctgacctcaggtgatctgcctgactcggcctcccaaagtgctgggattacaggcgtgagccaccgcgcccagccctcttttgctttcttaaataggtctgcttccttctaactacaggcccgttgcacatgctgtttcttctgctaataacactttttctctcctctttgcctggcaactactcatctttcatgtttcagtttaacatttctccagggagactttcctgaaccttcaggctactttgaactgtctggtatagcacactaaac

SEQ ID NO: 163 - DNA, 16209 bp, Homo sapiens
agcttctgcccgcgcggagataaacaagcaccgcgaccgccgagcagcgccgaacccagcgcgcccagtcagaccccagggcctgtgtaccgagcatgcgcagttcccgcccaagccaggagcagcgtcaacctgagactcccgagacattaagaattcggaagggatgagatggtagaggggctagagctacctccaagctttatcctgaggcggggagtgaaggagagatgcccaaggcccaagaggggccgcgagggcctttgtccgatgccacccagtctgtcagcactcctagagctttggttttatcttgtattagcatgtgaagctttaaggggggggcacctacaggcttctgactgaagttgtgtaaacgcaacaaaatgaagctttggagcgttaggacattgatgggagggtgacgcccccctctagcagcgcgccagaggggcgagtcagaggcggccacacaccacggaagtcgggtccaagcccgctgacgtcgccggggtcccgcccaccaaccctctggacccgcccacatttcttctagacccgcccctttcggtgccgaactgaagtcgagctcttcccacgccctgtcagccacgggtgagttgaaaacctggagagcggaatcccgaacggcagccggaaggccctggactcctcatagcaacagccagctaggggcatctagtgggaagctgggattcattctagccaaccacatcacgtctctgtaccacaaggtaccattcacgaccaataagagagcgcccccataccacgtgcctttactccttcaaccaatcgagaaaaacgctagtcgtaggatccgcaagcccacctcccagtgccttgccaggcggggctcttcgcgcacgctctgccaaccaatcgtaggtgagctggcgagtgacggaagcttcggccaagccaaccagagctcgcgagccccttgccaccgaggccggcgggatggagacagggaccggctgctggggtttgggaggggcagagattgaggagccagttgctgtgccctgttctggcaaaagaacaagatgcgttgcaagccagaatgatgaattccacttttcacgtcgcctccgtggcattctgcctaaatgatgggcatggaaatggtgctgagggatgtgggctgaatcgagaacacagggacttttgtcttcagggtgagaaatgttccggtccttaaggaaacatcgtgcagcagttgcatgggtcttccaggcgttcctcccaaaacattattttttttctttcactattgagttttaaaacttagcgttctgtcgctagcattgcatcttagttacacatcctctcccacccataacgtcaaatttaggagacgatacatccccaagctttcctgcattattttttgcagtaactggttattcagtttactttctttaaactatgtccttctcaaactagtctcacctgttcgttactgtcgcacatttcctgcgaataacacgtttctgtagttctgttgttagagcctggcatacctctccccgttcctctttcccacaaggtcatcatgcagaggggattttggtctgagttaaaagccaggtattctttcaccatcttttctgtcgatagtcaaactactacaaagactactcaaatttagtagtttcttatttccctatagcttcgttatattagaatggataacttatatttgcattaccttgctgtaatgaacacacaccaagttttcatttaaaattatcaaggacaaatgtcctctgaatttaaaaatgtgtatgtagtaaaatataactcagcatttcttgattacatatcattaaaatatgaatggtactatctgagccaccagaatcagcagtgaaggtattatattaataaaaaggactaagaatcaggactgttttaagggaactggaaccgaagaggatctactatttcatcctaggctagttaacatgaaatagtgaattaaaattgaaagagcttacatggatgcttcatatctgagctactttggcagggatgtttcaagaggatgtaggtaagtatggtgttcacctagctttccagaagtctcatattttgtgtaaaattggtatgcttattcatggttactttgggttagtagaagctatacttcttttccaaggaaagacagactgtcttaagattctaactgtgcatcttggtgataagaagttcttagggttgttaaatagagccaggaagcgtgaagctttctctctagatcatgacaactcatctagtaccttgcattacaaaggagctctaagtccatttactttgcaaggaatgaagttccagtgattaatgtttttgagaaatttgtattgggattgtggggtccagaaggttgccttaagtaactgttttcatgactcctaggtccctagatgttgagaagctctggattgaagctgtcacaaaaatagtgagtgggctccgtagtcactccatttagcataatacagagtaggacagctttgtgacatttctcaggctatttcccctgacctctcatcaatgctgacgtttttgataagaaggggtatagagactgcagcccttggggtggttacagttcatttatttacaggccttatattgacaggcctcagatttcatgctcagtaccataaaggttgatttttaaccaccaagaggcaaaagaaacatgacaggtcggagcatattttctcacctattctggcttaaatgatggtacttacctgatttgtggttgtaggtgaaatgttgggtgaaagattagctgctataaaaaggatgtcaggacgtgtagagaatttagaggacttgggtgggagatggatgtctattttctaaccccttagtcatgttcattccgatgccagcataaactctattttgagatgattatagaaataacttatatcttcatttgtttgtgggaaataaaaaataaaaatgatataaaagaaatttgaattattcccaagagctgtaaatctgtaagatagtgaaaacttaacgcagtaactgacactgcaggatccctttagtttccaaagtgcattgccaggagaataaaaagaaagaaaatcttcatttctcctctctccactaaatctgaaagggagttatctcacctatagccagataccttcaattatcgcacttgtgttaccgtggaaacccaagtccatcctttctttctgtaaaaggtgttggaaaaggtggtatgaagtgggaaaggtactgtattctgggacttcctgacaccagcaagaagcaaatatgcagataatttaatagaaacaaattagtagaggatgtttgtaatgcgaggggtacttttcgactgtaaaaccctgattcctaatgcttcttattaaagcctgcatgcctctgattaaacataaaggggaagggcatgtcaagtacatttagcacctgtgaaacgctgctggcaagtataaggagagcagacgatggtttcttgacctgtgaggctcctaatacagttgagaatctgcagtatatatgtggagtggaaaggaaggggcaaaataaactttgttcttcctttaaaaaatgtgatatgtctcagtgcttttgaaaagaaaaggaattagaatgcagaaattaagagtatggaaacaactcaataaaagaaacgtatgggtggagagagtagatgtttcaaaaggccattttaatcagaaaaaaaatctgaaagaaaagacgtaatgattaaaatgtaggcagaaaaaagaaaaagcctgaagaatcttaagagctagaggattctgcggaaaacagagcttcagtgtggttcatttaacaaagcagaagagcaggcacagtgttgcttgcgtacccagcagtttccctttatttttgccaaagaagctgggatgaatcaggattggactttaatagcattgctttccctctgcccacggttagtccaaaagtaggcacgtgactcagttcttgtcattggaatggggagaaggctgctagggctggagggatttctaggatattgacaagagtgaggaaatatccccgttttctgatgtcgctctctttgcttcctgctttacacattgaaatatgagaatgtggcctccatttgggggctatgatgcattatgacattatggtgcaatactgtagaaagccagcaacttcggatggccagggaggaggatgggaagaacctaggtcctgcatgacaacattggacagtcaaaccaacattagaactgcccacatttggacttatggctaagtaaacagctggtgtctttcaatttaagtgtgtgttggtaaggttttctgcatcttacagcaaaatacatcccacctgttaacaaaaagtatgagggattccagccaaaatcgggctttaaaaaatcagcaagcatttgtgagcactttcatttcactaatatctgaacgatagttcaaagatactataatattaattgagtaattactgtgtatattttttaggctctggggataaaacaataagcaattagccaaaagagcttgtattctagcaggagagacagatattaagcaaccaattacatgtttatattataaaataatggttatgcttaaaactaataaggaaaaatcaggaattagaaagggtatatagtaattatataaataataaaatattacaaaatatataactaaataactgaatgaaattacaaaaacaaacactttccaagtaaatgagaatgaaatgtatagtttttactgacattcccagaggtcgagagaaacagtaaattggagtaggttagtccaggagagttgtctgaagcaaattaatattgtatcaggttttgaaggaagtggcgaaaggacaggctagatggggcagaagagagcactctagatgtaaggaaccagaagagcaaaggaagaaagcaggaatgaagtaagagtgaatgagggaaataccagaatcacttgattttttaaattccctgtagcaacagcattctaggggcatctctcagagaaaaagacagaaagatgccagaagtctcaaagcaagattatttaaaggtataaaaataatataggagaaaaatacagaagacaaagtaggagtacaagagtgcatttgaaattaaggcgtcattcaaaataatgaataatttataatgtgggcgtcaaaagagttgtcataagaagtaattatggatttaagggcatcaagaaggagggattcaaactttcacaaatagaaatagaaggaaacatgaggagtggcaaaaaatgaagacaggtagaaaaacagtttttgcttgttatttttccatgatagctgttattgacatgcattatgtagaaatgaatggaatttgtttgaaaagaaaaatttcaatagagcagtaatacataaaggtaggctttttggtaaatagtgtaatttaaaatgttttcactagaatgcctttttgtaccttcctgtaggaaaatcttttcaacaaaaaaagctgtaagtcataataagttacagattagcaaagcatttttgaaataaaaaaaaacccatagatgtgccaaatgtaatagtagagcaacaataataaatatttgtaataaaaatcagaacttgttaggcattatgtggtttctggtcaaatatggttgtactaatttttctaatgctattttctgtacaaatataagaattttttaaattaagctatggtaggtatatgaacacatcttgatattactggaggtaggatttaccactcactttttgtgaccccaagtgtaaccctgaacagacttctgtcttaacaccaataacacatgattgcactgtcttctccagtgactggggaaagggacagtgctttgttcatttttgctttaccagcattcagcacatcgcctaaaaacaattgtgggaattcataaaatgtttgtaaataaatgagcaattgagtggactataatgttgcttctaaaaaccctgggttttgaacacagagaagatgagaataaaaggaaaggaataaggattttccccaaatcaaggtgaggttgatgtaaatgtcctccaaagttggtctaatctccaaagaagcttgtatctcaaaaacagtaagtctccaacaggcaaagtcaatggcagtttgtagacctggaatttaggagtgccaggaaagatctgaaaaatcatgtcttctatcaactgactgttgtctgaaattctgcacttaggttttagtcttttgatgtaaaagttatttttttccaattaaaatgtaagtaggagatatacagttaaattgtaccatcagtctgtcaacttcggggcatgcaactatgcttacctggatgaaaaagaaaatgaagaaagtaaaatagaagaacgtagtttaaattgggggataagtcatggcatgagtatgtgcccagagcgagtataagaaggccatggaaatccactgtatttttgtcatacacttattaatttgtttcaataaggttaatcactccacatggtgtaacaagaaaaataacagcctttacaattactagattcttaaacttatttcaaatactttttaatttttatgagattataagaattttttaaactttgaagctgcatgccttgtctgattccttccatttctcttctgcttctcacattattgtgttcagcaatggtttggaggcatcttggggaagacagagcagagttatggtgtaaggaccatccaactcttctcagcagccatccagttatcttgtcaagggaagttactcatcctgctctctagaattatctcctcaaaaatcggtttcctgcttttcacagaacagtacaccatcttttactattatcctaattaatgcttctcacacagccttacaaaatattagtcacttaattattaaccacattcattgggctgcactagttgaaaaagatgtcttgtttacttagtcaaagcgctgtctctgtgcaatggcattgatggtgaaattgatcagagtctacgtttgaatgagagaagctgagggagacatttcagaaatagtaagcctttttatttccttggtgtaccaggtagtcaaggaaagttaaagtatttttttatactttgtcttgattacattcttttggggactggtctctggtgttaggtttttaataaagattttggccattttccatgcaaactaatgtttccaatgaaaagatacaacattgcatgtaaattacctaagaaatattaatctgtcaatgtaattaaattatataagcaacaattagtttcaaagctggaatggattaagtcagttctatactgcacactgacaaagtgaaaggaactaaaatggacaaattgtggtgctgtaaggttatgattcttaagatttttatattaaagttgcagagtttcaaagtgctcagtgctgctctttacattagggctgtagactctcttaagcccgaggattctatctggatatgtgattgatagggtggaggctgggctgaggcttagtaagacatttaaccatgctttgtataatactccttaaatgttggctctcacaaacatagaaatagcgaacattaactagctctctgtttcaatgtctaccatctacctgtcaacttaaaatcatgaaatctataaatttggagaggagagctttatttcttaccaagagttgcagccagcagggtggccatcctaactggctgggaagtgtaacctcaggcagagaccaaaagcaagttattcaagggaggatgagataggaatttatgctgaatggattggccaagtatatttatttaacagattgtaggaggagctatacatatccatgaagagggggcatgtgcatgaatagtaagcaaacatggatgttacatgcatcccttgttcactttggggtgcagacttcacatttaaatgcattccaattaagccctatatgtcaaaaggtgaagcagggacaggaaggcactcagtgctcagcctctgtaaaccagacagaaccagaagatggtcagtggtctcttatcaggagaaagttactgaaatcagtcttttatccaatcaaagctgtagctgtggcttgtggaacagaggggtcagttagtcagcatctggtgctcagtgagctacgattgtttcaatactgcttatcttgaggccagtgcttgtttagctgctagagaataagaaaaacctgtggcaattagagcatagtttattctataagggtaggggtacgtgacttcagctttttctggcatggccttaggtctcatttattatttggtactttattgccacaaggagtctgttccattagtcttatgatctctattttaacatatctattttgtttttttcctccacttgattccagaaggactaaagtacatttcataaatacatacaagataaataaaaataagaaaaccttcaataaaaatgatctatattaatacatttccagttttagggtcaaatagattgtttcaagaaaccttaacattatctattcaaaataagttttttcagaaactgtgttgcacattggtgtacatctctttaaatagatttcaccttggcattcacactttgtctggctctgtgtgtgttagggttggggtagggggagcattgttaatgcccaaatccttcccaagtctcatcagtgaatagtctgggggaaggagggttgggaatgtgtatattgaacaaaatcctctaaatgattctgacttgcctctgggttgaaaatcaatttaacaatactatgtgttttctgaagtaaaagtcacacttaaagtaactggtgatcttggaaatttttaccaaggatactgactaatgagatggcctaccccaaatccagaatttaacttaaattccacctccccctgttttccttaaactaatctctcaccatattttccaaaaatgttatacttttcttctcatatgtactgcaatttgtcttgcattgtatttatctttgtgatttcagctagtatatggactcatggatgtctgatggggaggagggtggagaatctataagttttttcatctttctaatctttattatgctttagtcaatagtatatattcaataaatgctgaatgaattggattaaatataaaacattaaatgttatgaaaagtatgcttaattttcaaattatcaaatgattctctctattgaagggaaatcaatggtgtttttcaactttgaactgaaactctaaactatatgaaatcataacaatgtgaaattttaaacagtattattcttcataaaacagtaatataggctttaattcacaagaactgcaatggggtctcatcctttaagcagtcatttttaatgttctaaccaaatccttatactaaaacagaaacaactgctgaatgtgataaagtaatggaaaatatagaaaaactcccattttctctatctcattgtgtgtgaaatcattcttaaaaagaatcacttccacttctatttgaatcaaaaatagccaatagggcaattctaactggttaaaaaaaaaaaaaaaaccaacgagaataaaacaaatcaccaaggcaaacgagttttaaaagatatgagtcatcaaggttaaaaaaaattagaaaaatatataaaaacttacacatgtccttgatatagttttgtcttgtgtccccttaaaatttcagtagcttttcttgttgcttagaaatcaaggacatctgattggcaggactttgacaagctgcctaaaggaaactatgatgttttcagtccccatattaaagacccccttttacattccagctgagggctggtataggcaggataggaaagcttacagatggtgggaggcacagaaccttcataggggctgaggcaagaatatccagaagacaggagagagaatgaaagatgccagccgcctcattgtgagttcacagtggctgccttggtcgggagcttttggcatggttctcatgaattacacaatctaatctacttctgtacagaagattttagaggcacagttgagtgtgctaaaatggcattactacctactcagaacatgatgcttctgtgtgcccatatgcccaacttattttcaaatgtatttgagaaaaatagaaaataggcattcttagtactagagacatacaataaaaatgcgcatgactctatccatttgtaggtttcttgggagttttatcaggctccaggggacccatgtttgtagcacatgagttctctggtcgtagatcgttgatgtggtcattggcacacggtgcctagctcatgagccagtaagatttgtttcctcctaggaatttagaactggagtccagagggtggggctgggcatttgaactaggaagtaaggaaagccacactgggaaagcctttgatgggctgtgtgtacaactcagcggaaatgccaatatacagagaaatgtcaaagaataaagtcgattcttagagaagtagtgatggctcacttagttcctgagagctttcctactcatgaggagatccaattgcattttctaccattggcattgagatccccgcctctaccccaacattacactaaattttcctttaagttagtatcagtggttttctggttttctattacaaccagaaggttcctgaaaaagacaaaattatcctgttagatcatgttctcttatatctctgttagaagtacattggaaatgaacagcattctattgtcagtttgtcagcattaattataaagtatggcccaataatttttcagaacctaattgcatatagctgatgacagtggcttctggagctgttttatgatagtgttagttagagagtcctgccagattccctggaggagatagtttgtcctttctgtaatgttggaaataatgtctctcgtgcaggtttaataacaagatgcagtgcaaaagctccaggcactagccaggtcatgtgacatgaggcttgggatcagcttatctcacaaacccagacatagaaccccgtgccagccccacaacaagtggacaatccaggaggatttgagtatttcctcagctattcaacaaatacagagaggtggtttgcttcaataacaataaatagttatttattgttgtccttatgcaacaacaattctccagttgtcatctggagaaactgaaaagtaatatgaaatcatctagttcctctttaagacagtacttgggatcctgtgaatgcaaggatttccttattgtcctacctgcagggaggggcattcagggcttctggatcatagcctcggtcacattttaaaacttgacataatgtctaaaatagctgtatttatattttaaattaacttgaaaatgaaactgctagaccatataatttacctactaaatttggacacttttgagagtaaaacgggatgctattaataataaaatgaaagcaggccttggaactgacccaggcaaactggatgatagtattaccctattcttaggttttgcattcttggtttgtgagtaactcacatattgggaagcccaacaatttttggcacggtttttgaccaaatcaaattttagccgccattttggagtatggcccacgatcccaccacgagtcactagctatagaaatgagcttctctagggcttcagcttcttcacctttacaattgaatgggtaactccaaatccctttcagcactgaatagtccgtaatcaatgacacatctatgaaagagttttactttttggagaaatttgtattattttgattcatattcaatataagatacagaatatgaatatccataaaagaatattatgaataaggtttgtacacattataaaatcatactgggcagcatggcgtagcaacaaacacctggactggaatctagccacttatttcctctgtgaatttgccgaggtttccaaaccatcctggatgcctaaactggaatactttcaactgtaaaatgggcgtaagaataacaactttttagtaatgttatgagaattaagtgatatgtagtgtgtgaaggtatcaaatatataccacataaatagatgtatatgatcattaaatactagttcctcttcctattagaaggttagtgtcattattgaatatttaggtcataaatgtgcactgcaccttcttataactaaagtaagaatattgccaatgagtttctctattcccaatattggcttttattgacacagagagcaattacgtcggatggaagcacatccatgattacaggcatcatcaaagtcaaacacacctggacccaaaagccctctttcttcttttagatatatgacattgggaggttacttaggcttacagagtctctcttcccttatctgcaacaatgaatgagataatgtgtatagatcacgtggcacaggtcctagtgtatattcaataatatgcattattgttactcattattgttaatatgggagaagagaaattaaaagtctccatttaaaggtgagagagatgtttccataagaagagcttatagtgcatgtggacttcagaagtgactataagtgaagaataatagttgagaaagcaaacccatgagcatgtcgtgggtttagcattatgctaaacagcagcattgtgctattcccactgagaataatgtctttcatggacattgtggaacgattatggactggtcatgatactatgactcctgagaattctaacaccttcagattcacagtagggctgcagatgtgttttacccatccagggctcctgacagtgaaatcaaaggcttggattgataaactctgcgaacaatgtgtattagtccgttttcacactggtgataaagacatacccaaaactgggcaatttacaaaggagagaagtttaatggacccactgttccacttggctggggaggcctcacaattatggtggaaggtgaaaggcacgtctcacaggtggcagatgagaaaagtgagagccaagtaaaaggggtttcctcttataaaaccattaggtctcatgagacttattcactaccacgagaacagtatgggggaaaccacccccatgattcaattatctctcactgtgtccctcccacaacatgagggaattgtgggaactataattcgagatgagatttgggcggggacacagccaaatcatatcacaatgttaagttgctcttaatcgttttattgatgaagtacaacaggttgattagtaatacaacagttttatctgagcctcacttatctgttttgtaaatgttattttggagaaagccactcctacaatttgtttataagaagtctagcatggagtattggtgatcacatttagagaattataactgtgatattaatgaagactgacaatgtggatgatgacgatccaattcatgtgcatcagaaaaaaaaaaatcacaacttgatttttctacctgctttgtttcaattaatcctaatttttagaaaacagacaaatgcaagacccagacaagggtctttgcttagtaaagatttggaattttctcatgccaagagatccttttctgaggccttttccaattgaatccaaagtttgccatccaattcttccagaggagaggggtctagatttagtagagtattattattattattattttgccaacttctagtctctccttcatgtatttgacagctccttaaagtttctggctatagcccagccctccagctccctgactgagatgggacctatcggaagcatgttggtgttaaaatcccaacttgcctccattcctcaagccctggacttaaattggggtcctctggccctgtggatagccttaacctcactacctaatttccactccaggtttgaatttcttctctgtttctgtatctagtgagttcccattctatcttccaatcccggctttaatgtaattatatttgctatatgttgttcaataattacaagtgtttggaatggggccaagggccctttctcagcagtttagtctccagattttggtataagtgaagattagacttctcctgatcttcacatctttcagaatgccatttctaatttttttcatgaacagaattaacagaggaaaccagagccagtatctaaaatctcaaagtccatcactatatagcagcgccaggatctaaaaatctcagagtccattatatattgtgatatagtccatcacaatattttgggaaaacaaaataaaacagtctcctaccctaaaatacttagtatcttgaattaaaaccaccaaccttaaaccctgatggcagtgaaactgcgaattttaaactttgccaaggagctggggttatttgttttactgggaataatcacaacgggtcaggtagtatttgtggagggttcacttttgagtaggagtacgggggtcaccacaagaagttctgtccacatcaactcaacccttgaaggacatggagcatgcatcaggatgcagatgtatgcttgcctttatggtgtgcaagttcctatcagtgagccacactgttctcagatcctcagtgtccacagtgttttagcacgttttttatttggtaccctgaactataggactgggtaccttcacggtagcttcagtcaagatgtgattggtgtagaggcattcactgacctgtgtagggttttcctggatttgttttcctttgcagttttggatggctggttctcttgggatcagtgatgacaccaggcagtcagagtaaggctgtgctctggcagggactgatgaggcctggaggagcagggatgtgcacgactcacaatatcttttttctttttcctttttggcatttaaaaagcatcagattacattgtgaataaatccatattggaaggttatttaagtcattaagcaccagtctgccaaccacataagctgtatagtagcctctagcaggctgcttaaaggaaagcggcctgaagattgatccaggatgccaggacttgcatcctaaaagtcaggctctttgtattcttctgcctttactactgagggaaaggagtaggggaaaccaaggtagagtttcacgaacctccactttccccctcacatcagctctcagcaccaaagaggcaagttaggaaacaacacaagtgtccatcaacagactaaatggatgaacagaatgtactatatccacatagccgagtttcagccctagagaggaaggcaattctgacacatgctacaacatggatgaaccttgaggacattatgctatggtgaaataaactcatcacaaacaaacaaatactgtatgattccacttatataaaatatctagaacaggcaaattcataaatatagaaagtagaagacaccaggggctagggggagaagggaatgcggaattgttgttgaatgggtataaggattctgcttgagttgatgaaaaagatcaggagagggatgatggtgatggttgcacagcattgtgaatgtatttaatgctgctgaacttaaagccacttaaagtggcttctgtctgtaaaaccacagttcttaaaaaggcaagttgaggggattaccacttctggaaagatggagtggattcacttttctctatttctcactgagcacagctaaaacccctggacatgcatgatatgtagaacaaacagaagagtctaaaaggtggagaaaagaaaacaaagcctccagggaccttgagatccaataaatgacacaaatgtgagtttcctcggttttctttttgcttcatataacccagactgcgtgctgcagaagtctcccgcttggaaacacaccaataattgcaggcaaaaaaaaaaaaaaggccctgagtaaaaggcttgacattgaaggtgctggtttcttatttgttgagggaggggaggaggtggagctacaatagggtgactcgatctctaggcctagggagtagcccccagatcactgtggatgcaaacttgctggaaggatctcaaagacacccattgactcccctaaatttttcctttattcagattatgtaaaacttttgttttactctattcaggttaaat

SEQ ID NO: 164 - DNA, 1409 bp, Homo sapiens
agatctgtatcagaggcacgggcctggcagccttcactgcacttgggctctgaaagacgttctcactcttgcaagtcacctgggaaagccagaatcgatactgtatggtttaacatttgaaactgacttgcaggtaatggcttctgcatttccagaaggcacccgtgtgcctgtagggatctcattttaaggatcactgctttttgtttctcatctacaggctacagagacccatctctcagtttggattttgattaaacagttatgcagagtagaaaacttgggccatacacaaaacttaattaaaataagcctccacttgggattaatgtatgttattgactgaatcgtgtccctccccgctcccccctctcctgccatattcatatgttcaagtcctaacctccaatgtggctgtatttggagatagtgcccttagggagataattaagattaaatgaggttctaagggtagggctctaatccaataggacaccagagagcttgtgctgggaatctctctctctctctctctctctctctctctctctctctctctctctctgtctctctctctctctgttgcctccctgtacaaggccatgtgaggacacagtgagaaggcagctatctgcaagcccggaagagaagcctcaccagaaaccaacacgattgcaccttgatctcagactttcaggctccagaactgtgagaaaattaatttctggtgtcgaaaccacccagtctgtggtatttttttatggcagtcccagcagatacaatgtgactgtttactttcttctctactacaggcaagctgcaaagtgctgctaagtaatatcacacagccactgctgattgtgtgagttgagttggggagaggttgttactatgagacctattccagagcagaaacaggaagattgtgaatctcatcctcgtcacttgcccatggcctgcagcatccagacccctcgaggtcctctcctatcttcttgccaaagcttactttcagggaggacttggaaattcattccctctaggtggtaaataatgtaacagcataaagtgttatgtcacctagggacatgtaaattgagccgagagccaagtgttaagctaaagggatgacaatctaacagggaaatatcatctagcatctacctgtccaacaatatgaatctactgcgagctcaggaacatccccagtatcagatgtaaagctctggggataagagggcaaagaaggcaattacctgaattgtggagctcacatgtgttgagagaaacagacaaataagcagattacgatacagtgtgataaaggctgtaaatgtgaatgaagtgctataggaacatagagcttcaggctcaggccaaataggcaggggggcatgtgtgtgtgtaga

SEQ ID NO: 165 - DNA, 3414 bp, Homo sapiens
acctgggaggcagaggttgtagtgagccaagatcgtgcaactgcatgcctgggtgacagagcaagactctgtctcaaaaaaaaaaaaaaaaagaaaaagaaaaggaagggagctggcatgtacagagctcacatggtgacagagctgaagcaagagagaggagaaggtgccaggctcttttcaacaaccagttctcacaggaacaaagggttagagaactcatttacttccatgagaatggtaccaagccatccatgagggatttacctccacaatccacacacttgccatcaggccccacctccaatgttagaaatcaaatttcaacatgagacttcgtggggataaacaaaccacagcagtccctgaaaactacatatgcttttttcgctccgtttgttattgggttctgccctgagctcagtggcctagttggaaaatgaagactaaatttaaaactaactgataaataaaattggtttccttgtaaaatcttatggtaaattcttatgatttatttttattcctatgattttaccttgatacccatttttaatcttcctttaatatacccaaacttctttaaagagcttaaattctctctgtgttttaatatgtaaatttgctaccttgtttactccaaaatgtgataagggcttctagccatgtggaacaaactttaacccattccatttacagaggcaaaatttaactatccttttaaactagtgagttttacctgtttcacggctaaaatttttaaacgaaagctacaaaatctatatttgtgtatttttctgtgcacatatgtacatgtctgtgtttgcatattgtgtacatggtaccagattgacataaattaataagtactcataacgtaagtatgtccaaatactttcaagttagtgtgattttagaaatctttaataaataaagctagtttaaaaattattagtaaaataaaataaaaacatcttcaaaatttaattcagacatgtttgcctgggtctgttggtcagactggtttatattgtctctagttgatgttttagggtcataaaactcttatttctgtaatattaatactagcttaatttgtctctgaacttatgtcttggttttgagtgtttagattctggagtctagacaagtggccatgatgaggactggggacacatgtgtgttcacagtgcctgggccctattctccctggtccagctgtttccaggctatgctaataggggtcagatcctccagatactgtcttcacagtcctgttctctgtacttggctctgcacctgacacataacaatcacagttacttacttcccaggttttccattaaaaatcagggttattaagagctaaaattgtaattaatatattattgaaactactaaatattttaaaattctatacacaaagtatagatataagaaaagtaatgtctttttaataaaacattacaaaaagacatcaacatatggattttgttaaaaagaaagtaattttttctagtgtaaaggttttcaaaaagttgttttaaatttaaaatacagttgaaatgaaataaaatattttataaaatcttatttacagaatcttattttgtgttgccaaaactaaaattagatgtttataaagttttcttaaaattaactttaatattaaggatacataaaaaggataaaatttgttcttttcaacaaaatttttatgtcatattaataatagataataaaatatttttgttcaccttttaaataaactacaacccctcccccaccccaaaactaggagcacattttcttattctgtctttatgaaatcttttaattatttggaaaactgccccatcaaaggagtaaaggttttgctttgcaaatctttaaggttggtatggtggatcccacctaatgccagcactttgggaggccgaggcaggtggattgcttgaggccaggagtttgagaccagcctgggcaacatggagaggccctgtctctataaaaaatacaaaaattagccaggtgtggtggcatgtacctgtagtcccagctgtttgggaggctgaggtgcagtgagccatgatcatgccactgcactcagctgggcaatagagtgagactctgtctcataaaaacaacaacaacaaaaagtttaaaagaattgatcaagataggatcaacataactgtaaaatagtagtcatttagccaaagcaataatttaaaaatttattttctttcttttttctttgagtcagagtcttgctctgtcacccaggctggagtgcacccaggcatgatcacagctcactgcagcctggatctccttgggctcaagtgattctccagcctcagcctcctgagtagctgggtctacaagtgtggaccacgatacctggctaatttttgtattttttgtagagacagagttttgccacattgcacaggctggtttcaaacaccaaatctgcctggttggtctcccaaagtggtgggattacagacatgagccaccgtgcctggccaaacctttcttttttaatatcaagtgtttcaaaccattgatatttgacaaacttcccaaaattaattctaacatgtccttttgaactcaagttaacttttagacattccaaaaaaaaaaaaaaaagcccctggaagtccaacagagacatgttagtcttatttggtatgtaaaagtcatacaggaagtattgttaataagaaatagtgtttaacaatctctgagttatagttgtataaatgtgttaatatgtgttccaaaattgtgttagattccaaaaattttgatatgtcttgttatatgttatcagtcatagttatgattatcctgttaaattgttgtttgctacagaaataacaaatttccttgtcaattgtatctttaatgatggctattctaaattttggttattcacaactattgtttcactctgtttcttcacaaaaatgcagtttataatcagctactattcaaacattgtgcttcttcaagtaaattcatggataggaaagtgacagatactctgaaataatgacctctgcttatgactgtgagatcatataattggatcgggtaaaaattctaaaaccttcaaagagaaaaactggactcataaaatgctaacctaacatcaagcagaagaactaattacatgaaactgaactaatgcaaggcaaatgattttaaagttttcactttaaaacattactggttcttgccaggtacagtggctcacgcctataatcccagcactttgggaggccaaggcaggcagatcacctgaggtcaggagtttgagaccagcctgaccaacatggagaaaccctgtctctgctaaaaatacaaacttagccaagtgtggtggtgcatgcctgttatccc

SEQ ID NO: 166 - DNA, 1249 bp, Homo sapiens
cttctgccccagagaggacaaatatgaatacccagacaacagtctcatctgtctttttgctatatgtgagtcaaggcaacaggaaaacactgtggggcatcgagctgtggtgggtgcaagggcttcttcagatgcagcatatgcaagagtaacgtttattcttgcaggttccgtcggcaatgttttgttgacaaggccaaaagaaatcaatgtagatacagtcaattaagaaagtgttttagagcaggaatggaaaaagaagttgtgcataatgaatgcaatagaacaagcaccagaagaagcacatgtgatggcagcaatatcccctccattaacacactggcacaagctgaagttctgtcttgccagatctcagtctcaagccttggggcaagtactgatatacatgttaaaaaaaataaaataaaagtgttggtgatgtctgtgaatttctgaaacagcagctcttagtcttggtggaatgggctaaatatattcctgccttctgtcagttaccattggatgacaaggtggcgctgttgagatatcatgcaggagaacacttaactgcctggagctataaagagatccatgatgtataaagatattttgcttttgggaaacaactatattattcactgcaacagctgtgaatttgagattagcagtgtaatcagtcgggttctagttgagctggttcaaccatttcaagaaatccaaaaggcaattgtattttttggcccagatgtgaaagggctacacttaaatgggctacatagatccaataaacattaagaacatgcaattccaagggcggatgggtttggagaactccgtcaatgatccgcacgcagtatggctccctgggggaggtttggagagttgcttctgctgctgcccacactgctgcgcatcatttggcaaatgattgagcaaatatagtttgtttaaaaaacttttgcggttgacttaaattggccacctacttcaggaaatgttaaatggggcttccaatgatagtagtcatctccatcatccaatacatccacattcatctcaagatccattaactggacaaactgtacttttaggtcccatgtacacactggttcttatgaagaccacatctgaactcctgaaaccccactcccttccccaccacaaggctttgcacaagaagattacagaacagctacaaatcaagcttcagtcatttcaccagcctctcttcaaacaaaaacaattgtga

SEQ ID NO: 167 - DNA, 1283 bp, Homo sapiens
cttgagcttcaccacttgctccacattctccaccaactaccgatccctgggccctgcccaggcgcccagctacggcaccggccggtcagcagtgtggccagcgtctatgcaggcactgggaactctggttccaggatctccgtgtcctgctccacgagcttccggggcagcatggagtccggaggcctggccgcggggatgactggggtctggcaggaatgggaggcatccagaacgaggagaccatgcaaagcctgaacgactgctggcctcctacccggacagagtgaggcacctggagaccaagaaccggaagctggagagcaaaatctgggagcacctggagaagaagggaccccaggtcagagactggagccattacttcaagaccatcaggaaccagagggctcagagcttggcaattactgtagacaatgcctgcattgttctgcagatcaacaacacccatcttgctgctgatgactttagagtcaagtatgagacagagctggccatgtgccagtctgtggagagcaacatccatggactctgtaaggtcaatgatgacaccaacgtcactcggctgcagctggagacagagatcaaggctctcaaggaggagctgctcttcatgaagaagaaccacgaagaggaagtaaaaggcctacaagcccagattgctagctctgggttgaccatggaggtagatccccaaatctcagcacctcgccaagatcatggcagccatccgggcccaatatgacgagctggcttggaagaacggagaggagctggacaagtacttgtctcagcagattgaggagagcaccacagtggtcaccacgcagtctgccaaggctggagctgctgagatgacgctcacagagctgagatgtacagtccagtccttggagatcaacctgaactccatgagaaatctgaaagccagtttggagaacagcgtgagggaggtgaaggcctgctacaccttgcagatggagcagctcaacgggatcctgctgcacctggggtcagagctggcacagacccaggcaaagggacagtgccaggcccaggagtatgaggccctgctgaacatcaaggtcaagctggaggctgagatcgccacctactgccacctgctggaagatggcaaggacttcaatcttggagatgccctggacagcagcaactccatgcaaaccattccaaagaccaccacccaccagagagtggatggcaaagtggtgtctgagaccaacgacaccaaagttctgagacat

SEQ ID NO: 168 - DNA, 2710 bp, Homo sapiens
gcagtctttccgggcaggaccccgcacccaaaggctcacctgtgggaccgcgttgtcagtctcggcgcctgcgctccgctccaggaagaaagcgccaaggcgaggcatggcggtctccgtgcgcaccggcagcttctcgtgggacatcaggatgtcgtccaaagaaagaaagttctcctcaggccccagcgcacccgactccactcggaaataagcctctgacatggcggccacttgagcttctccgcttccactcgcgtgattcggaggagcctcaggagttaggggtgtacaagacggggaagcggagactgggcaggatggttggggtcaggaaagtggattgaaactcgtttcccgcgcccggggacgcatcagacaggagcagtcaattcgggcggtaccgcccaggcagaagcaatcgatcaagtctgcagatttagagcagcgggacacggctggggagcggtaggtgggggcgccggaagttctcttccctccgcttgctgcacggtgtgggaacgttacgaagaagctggaacgctcgttgaagctcctggacccatttgtactggattgtgttcatgtgatccttaactatttatatgaaattaaaaacactttgcaacacttttaggggtttaaaataaaagcatcttgtgcccttcactccaggcctaagtccgaccctttcctacagtttttttcactatgcaactccgttaatcttagtatttgaaagaaatgttaaacaaacaaaaacttccagcactatccccagcgagttattatggtctagatgatgaactagtgtgttgtattttgttagtattttggtgggggttggacggggtgggtagaggggtggagcactagactgcacatggcttgctaaggttgtgagtatacttcagggtgtcttagctcatcatcaactgacaatctccttttgtggctctgaatttaaatccctaaaaatggaaatccaattggtccagtttattgattggtccaggtacgccacaatggtcatagatctccagccaccctgtagatgggggtgcctgtgttgggtgcgatcactatccagtgaccaggggaaggaccatggtcgcatagtaccaggtttggtggctctcctcagccagggctatgggtggcggcatattgttgagagatgcactacagaacttacttcgtctagagcatttctggggctactggagccgggagtaaagggtgtgtgtgaagggaggtgtgtattaaccatggattttagtttctgttttctgtattttatgatgctttgacatcttggggccttggggacctggggaggaattgcccctttcagagttagctaattcctagagatagcaaacaacttgcttgtgaacacccctttcatttacaaaccaaccaacccaagcctatatccccacaccatctttatccatctcacacaccaatattttccctgccccaagtcactgtaataaaccaccccatggccaagtaccagacaactaaaattcacctctatatcccagagcttgccaacattattcaaattattcaatcctaagcttgttcagacttcccttccctgcttcgcccattccttcccacggcaataaaggctctgggctttctcctcgctctctctacctcctcattgaccctaatactttctcgtgtggccgtaggcacagccccttctcttgagaactataataaaattttcaaaggcattggccactaactcattgattgtcatcacccagtcacctttataaatgaaattctgaggacaatgaaaacaaggtgcagtggggtggaaaggaatggccaaactgtggaaaatcttggtaccattctaaggagttaggccattccatagaaaatgggaggaaaatgtaaggcaaataataacataaatctgggcttcaggaagagaattccagcagtagataaagaagagagagattagatgcttggaagctgttcagtgggcagtatttggcaaccaattggatataggaagtgaagtatagtgagtagtcaaaagattcaagttttgaacgtggctgaccaggtggatggacatgtcatgaatagatacacagaacacaggaataggggcagctggagggaagggatgagttcagtttgggacacatggtgtccaagagctactagacaggaaggtctgcagcccagtggagaaagcagcctagaagctttagagaggaggcacactgagaggcagttatatgaaggttttttcctttttcatattttaaatgttcagtttgtgatacagtccaatgtaaaaataaacacaatctgcagtgataatttagaatttctctgatgacatggaatatatggtactggatgtagtttgagacagaaatataatttggctaattgaaggcaatgttatttactgccaaggagagtaagctattttttatgctgatataattaagatagatgcatactgatttattgatgccaaagaaaggcattatttttgtacagagaccacaatactggctccaaactcaaataccactattattttaataatacagtaacaggccaatgtttaacataaaatcagattgccttgtttgtcttacttaatgtcttggctcatcatgaaactatcattgtgtatatattgttctatttaaactgtcctctc

SEQ ID NO: 169 - DNA, 3943 bp, Homo sapiens
ataaaattaatgtttcagtttatttttcagattacatgcctttctttataagggatgctggcacagaccccctaaaataagcttttggtagtactgtacctttgaagagtggtgaaggatgctaatggataatctcctgaaagttgtggcttttgatacccttactgtggactgtagagttgctaaacgttgtttagcaaataatgttgcttagtttcaaatgacatttgactttcatcactaaaacagcaatgtactcagggttgtaagcttactcaaatagactttcaataagtcttcaatgtatatatgatagtttttagcctaatgtgaatttaaataatcttaatagtttcctaaaagtcgatctgaaacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcatattgttaagaccccagtgtatttaataggtattttataagcatagcccattggctcatgttagtgaaaccataatcctctttgcttagaacattaaactcataagaagtactacaaaccccaccactctttatagatgtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctgctacataactgcatttagccagcatttctgcagtgcgtaactgtgaggaacgtagtaccgcaaatggcaatggacattaggacccggatgtagtattcctgcttgctccaagattctcattgccgactgcatacaggtaggtaacaagcaatataatctaacttggtgacttgtatgtacttttattccgtgggcattctggcatcacatttctgacaatgaaattacagtgcagcacctaacacttgtatggtaaagcttttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacattttaaagaaaatacagttttcattctaattcaggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaaaggtggatagatacttctcaagacatcacacagcgtgagtcaatcaaggagggaagccacaagcagactgacaacgtttctagagcaggatcaggtgagctgtgtccagaaaaccaacgagaaggagtggaaggaggaatgaacgtttcattctcgttaataaaggcattatcctaatta

SEQ ID NO: 170 - DNA, 2218 bp, Homo sapiens
cagggtttcaccatgttgcctaagctagccccgaactcctggactcaaccaatccacctgcttcagttggtcaaagttctgggattacagacatgagtcaccatgcccagccaagttaaaatttattgagacttgttttacagccaagaatatggactactttggttaatattttatatgcacttgaagataatgtgttctgttgttgttaagtagggtgttctctaaatgtcaattaggctaagttggttgatagtatggttcaagtaatagctatattactaattttctgtttactttttctatcaattattgagatggggtgctgaaatctgactattatggatttctctatttgtccatttgtccttttagtcctgtcagtttttgcttaatgtgttttgaaactctgtgattatgggtccataaatgcttagaaattttgcgtcctcttaatgaatttactcctttatcattatgaaattactctatttgttcctggtaacattctttgctgaaatttactttgtctgatgttaatatagccatcctagttttctttgattagtattaacatggtgtatcttttcctaatctgttacttttcaccctgttgtgtcttcatatttaaatattttttcattttgagggggttatttttcagttttttttttccctttttgtagtggcatatagttaggtcttatttttttccttatttgataatcactcccttttaactagtgtgttaaatgtcatatatttaaaagcatttggcatttaatttgtttattgatatcattgagtttaacttgctgcttattttgtattagttccatctgtttatagatccttttgcctggttttggattaaatgagtatttttaatgatcccatttaaccgcttttgtttacttattagatatcactatgtatgtatatgtgtgcgaatgtgtgtgtgtgtgtgttttagtggtactctaaagatgttgctccactgtcttgtggcttcattatttctaacagtctgcttataatccttatcatgtttcctgtatatatgacatgtgctctttgctctggttgcttccaatgttttgtatttatcactgttatttatttatttatttatattatttaaaagttttttgagacaaagtctcgctttattacccagactggagtgcagtgacaggatcatggctcactgcagcattgatcctctcacttcagcctcctgagtagctgggattatagtcatgtgccactattcctgaccaatttcaaagcagaagagagaggcagaagcagtataatcaaagatatgacagtatcgcactatgttacccaggctgctctcaaactcctgggcttaagcaaaccatcctctttggcctctcaaagtgctaggattacaggtgtgagccactgcacctggcctatcactggttttgagcaagtaagtttatgatgtttcttagtcttattttcttcaggatttttgtgcttgtcctgtgttgagcttcttggatctgtgagtttatggttttaaccaactttggaagtttctggctattctttcttcaaatactttttcttcccatttttctatctcctctgtttcatgattccagttatacgtgtctgctttttgcgggaggagggttctttttgctctccttgtgtcaatttaaatagcttcagttaaatcttgaatttaacaaattatttcttctgcagtatcaaatctgtccttaatcccatccagtgtattttttatcttagaagtatttttaacccctagaagttcaatttgggcattttaaatatctcttgtgttgcttcttaatatgctcaatctttcatctacatttttgaatacataaaacatagtgagaataattgtttttgatgcccttgtctactaattctacaacccatgtcatttctgggtctgtttctattgactgctctttctcttagtgatatgttatattttcctacttctttgcatgcctggtaactgtttggtcgatgacaggcactgtaaattttaccttgttgggtgctagatatttttgtattttgttatatttttgtgctttcttttgggatacaggcaagttacttgaaaacagtttaattattttggttatttcttttaagcttgtgaggtgggaccagaccatcatttagtctaggacaaatttctctccac

SEQ ID NO: 171 - DNA, 7025 bp, Homo sapiens
agtgagggtgaggcggagagacagagcgggaagggaaacaggatggggagagtcaagaggggaagggaagcgggagtcggggtgcgagcctgccctttcccccgccgagggcctgtgcggggcgcggcggccgcgccaactccggcgtcgggaacactcaccgcaggacgctttgccctccttggaatcgcagtagccgcagtggtagccggccctgaggcccttgtattccaccaccgacgccatggccgccgcgagggtccgctcgggccgaccacgcctcttggcgcccggggccgacctcggcgaagcgctggggcccgcggcgggaggggtggagagcgaagcctggcgcggggacccgtgggcggggatggtggtcgtgtccccaagccctgcgtttgggccggtgcttcccacagctgtgcgttatcagccccatttcacagattggcctgggctaaaaatactcaagaccctcagattgcagtagggtcctattccccattagaaaagaagattcagtttgctaaagcagaggcgtactactatcaatagcatcaagaaatgatgatggaagaagcatggaaatacaatatggttccaaaatgggaaactaaaatagaggaagaggaaaagagatcacaacgtgagaaaacagaagatactaaaaaatgggactatctagtgcctgagagggaactgagtcttacaaagaaacatataccaggctgaacaaaccagaggcctcagagaccacaaacaccgactgctccctcaaagaattcccagtgaaatactttcccctaaaatactaacacgggaaaaggatggaaagcatgaaaatatccagaaaacacacaaaactgaaaccagtaagcacaaggtggcatggacaaaggaacagatgaagggacaccaagaccgaatgatctgagggagagaactcaaagcaaagacacgctcagaagcgctccagccccgttccatctttcctaaaatctcaagtggaaaaagagaaggtgaaagagtttgaatgggtcacagcttatccaattttgcaaccttaccagaaagcacttaggaaagtgatgattctgatggagaaataagaaaaaagagagtataaaattaagaaaccactctgaagggagctcttgagtatgccaccatttttgagaagtcaactagaaaaaaataaggtttaaattattttatattttttagactagcatacttttaatcattaatgcaataaaacatatactcccctggtttttttaagtgcatcaaactggcaaaaattaaaaaagccacaagcacagtatttccaagtgtttcagctggctgtgtgacaactctaaaacttagtgacttaaagcaaccaccactttattatatctcgcagttctatgtcaggaaatcagacagagctcaactggacatttctgtcccatgaggtaccaccagagctgcctggggatattcaggtgatgactgggctcatctggagggtccaagatggcttccccacatgcccttggcagggaaggctagaaagctgggcctccctggcccatctctcatttgcagctctccatgtggtttcagtgccacgtggtagttggacttattattcggtgactcacgactccacgaatgtgtattccaagaggcctgttggaagctagaaggcttcttatgacttagcctcacaagtcccagaacatcacttctgtattctactggtcacataagtcaccaagaccagcttaaatccaaggaaagggaaagcggactcctatcaaaaaaactttgggctgggcatggtggctcccacctataatcccagcactttgagaggctgaggcaggcgttatcacttgaggtcaggagttcaagaccagcctggccaacaaggtgaaaccccatctctactaaaaatacaaaaaaaagtaagacgggtgtggtggctcgtgcctgtaatcccagctactcgggagtccgagacaggagaatcggttgaacacaggaggcagaggttacagtgagctgagatctggccactgcactccaccctgggggacagagcgagactctgtctaaaaaaaaaaaaaaaaattgtagccatttttaaatctccccctccaagaatctgaaaagtcttaactcacacaccttcatccttcactatgcttttcattattcttttaacattgctaatcgcaacacttttctagaaatccagaaacctacaatttcacagcctctgagttgatcttgactaaagcggcatggctccctctctgtaggagtaaatatagcagaggatgtacaagcctgttacaattatgcagaaacacattgtcttgtactctccaatccacctaaaacttaatatcatattcctaagcctaaaccctaactctgtccaggagatgtagcccctctgtacttcaaggggtttacaactcatgtggggaagaaaacactgaagaaaaaaaaatagcacgtccggttatgcagtataaagtgttttattgaaaatatggactagagtagggcagcaatttagggggaactgagaatggagcttggatgataacttcttaggcagcggagacaggaggaaggcatggccacaattccaccctgattcctaccaccctcagcacagaaataaggctcctccccagccgttggagacatctatggaaaagatttgtgaatacatgagatgagaacagacaggacaactgatttaagaacaaggtactattgacaaaaccctggaggaaaagaaaggctttgggaaggtgataagttttatttatttatttatttttgagatggattctggctctgtcgcccaggccagagtgcagtggcgccatctcagctcactgcaagctccgcctcctgggttcccgccattctcctgcctcaacctcctgggcagctgggactacaggcacctgccaccacgccaggctaattttttgtatttttagtagagacggggtttcatcgcgttagccaggatggtctcgatttcctgtcctcgtgatccgcccacctcggcctcccagagtgctgggattacaggcgtaagccaccaggcctggccaagttttatttttaaaagataacatggccgggtgcagtggttcacgcctataatcccagcactctgggaggccgaggtaggtggatcacctgaggtcaggagtttgagaccagcctggccaacatggtgaaaccctgtctctactaaaaatacaaaaattagccaggagtggtggcaggcacctgtaatcccagctactcaggaggctgaggcaggagaatctcttgaacccgggaggcagaggttgcagtgagccaagatcacaccattgcactccagcctaggagacaagagtgaaactccatctcaaaaaataaaatataacatgtatttttcagttcagaaatttaaagaaaaagtagctcataataaccactgttgattattttatctttacttgtttgaaatggagtctcactctgtcgcccaggctggtgtgcagtggcccaatcttggctcagtgctacctccacctcccgggttcaagcagttctcctgcctcagcctctgaggattacaggtgcccgccaccatgcccagctaattttgtattttttaataaaggatttcaccacatgggccaggctggtcttgaactcctgacctcaagtgatccacgcgcctcagcttcccaaaatgctggattacaggtgtgagccactgcgctggccactgttgataactttaaaaagtaaaaagtacaggttagaaaattcaatagttggccaggcgtggtggctcacacctgtaatcccagcactttgggaggccgaggcgggcagatcacgaggtcaggagatcaagactatcctggccaacacggtgaaaccccgttctctactaaaaatacaaaaaaattagccaggcatggtggcgggcgcctgtagtcccagctactcaggagactgaggcagaagaatggcatgaacctgggaggcggaacttgcagtaagacaagatcacaccactgcactccagcctgggcgacagagcgagactccttcccaaaaaaaaaaaagtaagttcaatagttacaaaaaggtacaaaatgaaaagcaacatggccttggtttgcaaaatgtaaccacttttaagtgtctcaaattaggaaagtttgaaacaagtagaaagtagaaaaatgacagataaaaaggggggcaactttagacaagaacttagaaagttatggtgttaagactacatgttatataattccatttatgtgcaatgtctagaacaggcaaatttacagaaagtagattagtggttgcttaggggtaagaggtcagaatggtaggtgaggtagagtgacagctaatgggttcagggtcaggggaacaaaaatgttcaaaaattagattgtggtaatggttgctaagccctatgaatagatgaaaaatgatttatacagtttacatagaaattgtaggtatgttaattatatatataatatatattatatgtgtgtgtgtgtgtgtgtgtgtgtgtatatatatatatatatatttttttttttttttttttgaggcagtttcattcttgttgcccaggctggagtgcaatggcacaatctcagctcaccacaacctctgtctccctggttcaagcgagtctcctgcctcagcctcccgagtcactggaattacaggcatgcaccagcatgcccggctaattttgtatttttagtagagacaggctggtcttgaactcccaacctcaggtgatccgcctgcctcggcctcccaacgtgctgggattacaggcgtgagccaccgcatccggtgtgagttatatttcactaaagctgtttaacaaaaaaataaatgctagagtttagagtcctgaggaagcgggcctggaaatgtagggaaaggacctgagcattcgaggctttgaacatcactaaagagttcagattttttttaatcttgaaggcaatgggaaatctgagtaatatgacaagtggttctgaagaagcagaagagacctgaaggacagaagtaggcgataacagattggagtctgtggtagtaacctgggcaaactgagagaagagatcagatggggattagtgactggttaaggtaagggcttggagggtgggggcaatcctagttttccatctgagaaaataaagtcgtaaaagtgccagtataggtcttctagggagatttgaagggctgttttgtacatgtctaaaataacccacaagctgtccagtgagcaactgattgcatgtatctgtaacattttcaagaagtttaggcatcaaagttgtcagactgttcatggtgtaaatgtcagcataaatgatgacagtgactgtgaaaggggaaccagggaaagcaacagacatcaaggatacacagtttcaaggcatagatctccaagtgtcaaatgcacggccatatatccactggagttaacaatttggaaaggaattaggaaagctggcatacaacagactcaatgagtgggaaaggaggtgccacactgccacggactgacatgaggggagacaagtgattctcattaaagaggtgataggatagcagcttgaagagggtcatggtaatgtttttaaaatcagagatgggcttggttgaagggaaaactccagatacaggtgaaggggatgactgagagagcaggctcccctaggaggcaggaagcactggagcccagagtcttccacagaaaagacgcctctacccctgatgccagagggaagcagtgagaaaacatgaaatagcaaagtgggaactgggagaagaaactgactagacttgaaagcatagccgagatgagaagcatggagtagcatgctggtaagatggaaccagggctgatgttgctggggaaagtagtccagcctggcttgccagaggatttaatagtttcttgtgtgtaaatcagaggctgaatcataggaaattactcatatttgaccgtattttacctataaaaacaacagtttcatatgatacaacctatttgttgacttgactagctagcttcgtggcaaaaaagaagtaaaaggaatcataatggtccgcagggcattaacaacctaagtaaaactttcactgggacaggaatagacaaaggagacactctccaataattagaaaataaagagcaactacaattatttgtgaatatggcggtgagtttcctttaatcaaagacaaccatgacaaatttattaactatcaaaagctacattttactaaaaacaatctgcctttaaaaatgttgaatcatacaatatgtacgatacatgccgctttccgttttggacttcactatccatttgagtcctaaaaaggggaagaatagctggttaacagtttataaatgataaaccaaaagttcatataatatacataaattaaatccaacaattagccctcctcagtgagtagggcccaggttaatccacattatatatcttaaatttattccatatttattcccttcttcttttttctttttttttttttttttttttgagacagagtttcgctctgtcgcccaggctggagtgcagtggcacaatctcaggctcactgcaagctctgcctcccaggttcacgccattctcctgcctcagcctcctgagtagctggaactacaggcgcccaccaccacgcccagctaatttttttgtacttttagtagagacggggtttcaccgtgttagccaggatggtctcaatctcctgacgtcgtggtccgcctgcctcgccctcccaaagtgctgagattactggtgtgagccactgcgcccggcctattcccttcatttaaaatatttttacaacttggaacaaaagtatttcaattaattgaagcacatattaagtgcttacattaagtacaaaaaagtttattttaa

SEQ ID NO: 172 - DNA, 2672 bp, Homo sapiens
ttggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgct

SEQ ID NO: 173 - DNA, 4450 bp, Homo sapiens
agacaacctccagagcagggcagcaggcagctgctagagatttatttctccacttagtcgtctccgcttgcggcttcctcccatgagtgaggaccaagagaagccccctgtctctgatgaaagtgggggatgaacactgaaccaaacccacactgctcagcacatttgatgcggccagaaacagactgcaaaggctgagaaagcttttcaggggccgtctggctgtgtgggtgcgaagacctggctgtacttggaatcacctgggaagacttacaaaaatggtttccgagcctcacccgcaaggattctgacttgtggagaaactccaagatgaaccccaaagatctccatctccagctgttcacactcctatgtaatctctagcccttgggtgtggaaaggacttgtgacttactttaaccaacaacagaatatagcaaagatgcctaagaactgcaaatgagaaataattttctcacctggtcacagcatctaccaagaatggcgctgggggagagatcagtgagattccatctttattaccatgtccctccttccctgtcaaaagcatttcacatcccgcaagtccattagacatggcaccactctgctgtgggagatacacacacaactaaatacagggtaacaatacctgcctggtcagcacttcagctccaaatcaagcttcactaatgactatgagattaacgaagatggttttgataattatgactgtttgttttgtttttcttaactattcttcatctgagacttttacttttgtttctgccagcatcctgacaaacatttacaaccagaaagggtaagccactagcttgaagccattaagttaagttcagttaacaaggctttgataacaaccctcatgtttttaaggaaaaacaaagaacctagtaatcctttaggccttaccctgaaagggtagccagaagaaaaatcacaaataacatgaacttaccggaacaatccaccggggtgtgatcatggatgtggaagacacctgaaataattttatatgtatgtatttactttttggaaagactgacttattttcatacttataatacttacttacatctattatgaaatccattctaggagggcaattcttaattcttaatggtgttccttgagctgacatggacttctaaatccaagacccttttctgttatacaacacagatgctatccctcaccacttaagaaagtgtcataattttgagaatctcttatctaaaaatttaccattcaagaatctattactactttcagttcacttaataggactgcccctacctcacacccagtattcagtttaacattttattttctgaaatttcagttaattaattacaaataatgatagccttcttggtagcagcctgaacaatggattgtgactaatccaaataaagagcaacaagaaagtacacagaaaaataatctgtttagatacagatcattctctaattatcatgtatgcatgaagaaagcgcaataaaaacacccatattgctcctggttcacagggcctttgatacattatttttatatgtttaactttctattataggtcatctatgtgtagaattataaactaaggaaacccacccattttactagtaatttagactagtccttgcattggtggccttacatactcataagaaaaaactaatgtaagtccaggtattagtaaattagataaccaccaaaagaataaaaacacaggctgggcgcagtggcgcacgcctgtaaccccagcattttgagagggcgaggtgggcagatcatgaggtcaagagatcaagaccatcctggccaacatggtgaaaccctgcctctactaaaaatacaaaaattagctgggcatggtggcatgcgcctgtactcccagctactcgggaggccaaggcaggagaatcgcttggaggcggaggttgcagtgagctgagatcacgctactcctggcaaaaaagcaagactccatctcaaaaaaaaaaaacccacaaaatctgactttcctaccaatactttttagatgcatgttaacagcaggaaataagagagaaaaaatatcataaataatagtaaacaaaaaatagtttgacagacttttccacacttgcagttaattcttatccttggtaaagtctttgtttattaatctaagctggtcattcccaacgggtggttcccagaccacatctgcaccacctgggaacatgttagaaacacaacttttcagaccccacccaagatataccaaaattagaaacttggaggtggggcccagcaatcttgtgtgttaacgtcccctccaagggattctgatatacacaaaaatttgagaattaatgatctatgcaaacattcagtatcatgtgtatttccaagccttcaggatggcatctagcccctacagcaattctcgtcatatcactcataaggtacaaagttagtcatttctgtttttttttttttttttttttttttttgagacggagtctcactgtgtcgcccagactggagtgcaatggtgctatctcggctcactgcacgctccatctcccaggttccagcaattgtcttgcctcagcctcccgagtagctggcgctacaggtgtgcaccaccacccccggctaatttttgtattttcagtagagacagggtttcaccatgttggccaggctggtcttgaactcctgacctcaagtgatctgcccacctcggcctcccaaagtgctgggattacaggcgtgagccaccgtgtccagcaaagttagtcatttctatctctctcatccctggagggaaggaactgtttcagttggccctccatatccatgagttgtgcatctgtggattcaacaactgtaaatcgaaaatatttggagggaaaaaaaggatggttgtgtctgtactgaacatgtgcaggcttttattcttgtcattatttcctaaacaatacaatataacaactgtttaccagcatttacactgcattagatattagaggtaagctagattatttaaaatatactagaggatatgtgtaggttatatgcaaacactacaccattttatatgagatttaagcatgcatggattttggtatccaaggggagtcctggaaccaatcccccacagatactgagggacaactatacttaatacagtatcttccagactgtaataatgattgatatgttcaatgccattcttacgctctcatctttctataaaactttttaaaaaattaaatatatccttattgtctcaagaaactgctttatccccatgttttctctcatttaatatgatgttgaattataaaaggcttatagagacatgtgatttgtagacagtgatacacaaattcaaagtggtaaaattttaggacagagaggcaatgctaagtggttattaaaacataaactcttatcaaatgaaaagtttaactgaattattaaaaaggaaaaaactggaatctagcaggaacatttttcaaaacagaaatttctttccatcatactattttaaagcatatttacctgaggtgcaactgtgtgatcaattagattctcagttagagatgcaagcaaggcatccaattcatctgtagcttcctatggaagacaggaatctagaattgttaaatgacccctttatcatcagatgttaagttttttccatatcctctcaatttataattctgacacaggcctgattagtgttaatcctttaaatacacagggacactcataaatcatggttgttaatgattccacttctgcatggagggaaacctatactacaatcaggatgtgaaaaagctgaagtgctatgtaaattttcaaatagctattctcctttggtaagacaaaacttgggtagggttatgactattctggctcttaactttttctttttaattacaaaaaaattattttggctggatgcagtggctcacacctgtaatcctagcgctctgagaggccaaggcgggaggatcccttgagcccaggagtttgagaccagcctgggcaatatagtgagacctcatctttacaaaaactgagctaagctgggcacagtagcactcagctgtagtcccagctactcaggaggctgaggtgggaagatcacttgagcccaggagacagaggctgcagtgagccaagattacaccaccgtactccagcctggatgacagagtgagattctgcctcaaaacaaattttaaaaaagtaaatacagccgggcactcctggctaacacggtgaaactccgtctctactaaaaatacacaaaattagctgggcgtggttgcgggcacctatagtcccagctactcgagaggctgaggcaggagaatggcatgaacccgggaggtggaggttgcagtgagccgagatcgcgccactg

SEQ ID NO: 174 - DNA, 8046 bp, Homo sapiens
caccgcactccagcctaggtgacagagcgagactccatctcaaaaaaaaaaaagattctgaaccatccattctctgggttgcacttaaatttttggcttcattagggatgacttggagctgctatgcttgtcatgcaaaatatattcctccatgttattttccatttgctaatcagttggatccatttgagtcaaactgtgcctttgtagacttggttgcttcttttggaagcttctttcaaagtttctttctttagttgcttctttcaaactaggttacagaaacaagagctgaattagacagctgcagaaagcagatttctactttcaaatttaagatgaaaaatatgaatattgagagtatttctttcatgttgaaatcaagcaactttcttggtaaaattctatttcttaacgcagtcagtaattggtgggtgaggtgaccacatgccctgaggaggcaggtaggcccatctagagcaggagctgggctcatgcagatggatctttgaccctacctctgttcctcatagttggatgaccctggccaactcacttcaccctgttactttccttatctgcaaaattcatgtctccaaaattcccttgtggggttgctgtgaggatgagttgaaatgatgtgtgtggtgtcacagcatgatttccttgatccatggaagttattaagttgttggcagtccacttcttgcttttgtggagttgtatttttgttctagctcttttgttcacagacggggtgactatgtaatttatcatccaaactgggaattaataaatgaaaatgaaagactaagtggaggagagtctgggctcaaaggtgtggtcaggactcttcccaggcaaacctgaacatgtatggtcaccttccctaatactaatgcgtagtcagactgagcagcctgtgggagaaagctggctgccatcattctgccactcactgctggagggacaacaaggcagaagcagtctggcgggccaagctagaccttgtctgtgtcgggaagacttacatcatgtgctggtaaagaactaacaactgctgggcacagtggctcatgcctataatcccagcactttgggaggccaaggtgggaggattgcttgaggccagaagtttgagaccagcctggaccacctagtgagaccttgtctctacaaaaaaaaaaaaaaaaaagttaaaaaaaaattagctggtcctggtgacatgcacctgtagtcccagctactcaggaggctgaggaaggtggatcacttgagcccaggagttagaagctgcagtgagctatgactgcaccactgcactccagcctgggcaactgagcaagacactgtctcaaaaaataaaaagactaacaacctggtctttgaaaaatattgagtggccaggcacggtggcccatgcctataatcccaatgctttgggaagccaaggcgagtgaatcacttgaggtcaggagttcaacagtgaaactccataaaaaaaaaaaaaaaggaaaaaagaaaaagaaaaagaaaaggaaaaattattgagtgaagaagcctcttcccttcctcccccaccaccttataatttggcaaagggcctccatctgtggggcctagattgttttctaggagataaaaatagccagcatgtgtcaagatagcatcaaacctgcaggggcaggtgaggactccagaatggggttataagcaggtcttttttttttgtgagccaggctacatgccaggctttatgctactgtgtttatttctctttgttacttgccagcacagtgatactagaacttgcagaaatttaagggtaaccggtattactttaaaataccttttcccaggctcccactgcagaccttcaaaatccatgtcccccaagattctgtatatttaaactggtgtccagagcagtttctatgacctcaaaaggttgggaaacattgccctcatgttcagaaaagtcctttaaacttttcagctttgacttagttgtggagagatgttgaaaaatgccttttgtcatcccattgcctgtacctcagatatgaaggaagaaatgacccaaggaggcttcgatggagccaaaatcatcagagggagagtctcgggagaaagatgaatctccagggcaggggccagggtttgttggtctctctgcttctggcccctgcagttactctttttcagtgtcaacctcagaggagctgagctttatttttattataaaagcagagattatctgtcactatactttatcaatcctttctcttctttccccatcattcttccagaaagaattgttcatactccttgtctctgcttccttaatcttcattcacttctgactgcagtggaatgaagactgacctgggtaacctgccctatgtgactgtgggcaggttaatgaactactccaaccctcagtttccccactgtgacttgtaaaatgaggtaatgcaagaaaaatttccaacatagtccctggcagatagtaaatacttattttttttatttttatttttttgaggtggagtctcgctctgctggtctcgaactcctgaccttgtgatctgcccacctcagcctcccaaactgctgggattacagatgtgagctacctcgtctggccagtaaatacttaattttaaccctttccctttccctacctctggccccaaaacagagataaaatttcttttcctaaaatcattagtaacataattgatttttttttctttttttttttgaaacagagtcttgctctgtcacccggtctagagtgcagtggcgcaatctcggcttactatcacctctgcctcccaggttcaagtgacttttttgcctcgcctcctgagtagctgggattacaggcgtgtgccaacacttcgttaatgtttttgtatttttagtagagatggggtttcaccatgttggccaggctggtaaaatcattagtaacctaattggaaaattctatcatttttcagggctcaatttacttttttttggtcaacatttaagactatactcaattcttgaaattcctattcttttcctatatttatgccactttttctagcttttccctcctggttccaaaaacatcatctctagcctgcctagtatcagaggcactccctgcccagtgtcacatgggcagtcatttaacagccatgatatcctggccccacataatcatttgctccctaaatagggacttgtatgaataaccacacaaggatttcactgtctttttcctttacatacaccttacatttaggtgtattaatgaaattatgcagccattgaaaagtatcatgttgaaagctatggaaagatgcagaagtgattaacatcttcagtagatatagtgcaatgcaaaatgctacatgttaaaaatcagggtgaggtgctattcaccttaagaagacaccataaaggccaggtgcagtggctcatgcctgtaatcccagcactttgggaggctgaggtgggtggatcacgaggtcaggagattgagaccatattggctaacatggtgaaaccccgtctctactaaaaatacaaaaaattagccaggtatggtggcaacccaggaggcggaggttgcagtaagctgagattgtgccactgcactccagcctgggtgacagagcgagactctgtgttaaaaaaaaaaaaaagaaggcactataggccaggcatggtggctcaggtctgtaatcccagcactttgggaggccaaggcgggcagatcacctgggatcaggagttcaagaccaccctggccaacatggtgaaaccctgtctctactaaaaatgcaaaaattagccaggcatggtgggatacacctataatcccagctacttcggaggctgaagcaggagaatcacttgcccttgggaggcggaggttgcagtgagccgagattgcaccactacactccagtctgggcaacagagggagactttgtctcaaaacaaaaataaaaacaaaaacaaaaaacaaaacaaaaacgaaaacaaaggcactacagccgcctaacacaaagatgatagaatctcatccctacgctgtagccacacacaaccaaacccaagatcccccaaggaaaacggatgaatagagaacactagcaaatgagaattaagcatcactttgctacaaatactccagtaaactgggcctgagcactgctttgggcttccagactgtaggcttcctctatctcccaggcataaatagactcttaccttagtgagagcacatcagacattagccaagtgtggtggtgcgtgcctgtaatcccagctacttgggagactgaagctggagaatcgctttaacccgggaggtggaggctgcagtgagctgagatctcaccactgcactccagcctggtgacagagcgagactctgtcttaaaataataacaataataataataattctctgatgactcttcaggaaattctcctcattttaagagttatgctatgttgttctgtgaaaatgaagactaccagcacttctgtgtaaactctaggaagagtttgactataggagtatggtaatacttgctgtgtaaagaaaggatggaaagctactttgttttgataaagtaaaatgtattgaagtgcctattttgagtaaattaaaattcagagtacttaccatttcagctggtctcaacagcaaatttttagaagtctgaaatacatcaataccgtgaaataggagactcttacttccttaagacattcatgaaatcactgggttaggtgctagtaatgcaatgatgagaaaacacacacacacacaaacacacacacacaatcccagctcttatggggtttacagtcaagtggggagacaaacattaatcaaataattacacaaataaatttaacaaactgcagagtgcatgatggaagagcagtattagatggtatgagatgattaacagggtctgttaattggccagaaacatctgggaaagctcacctgagactgtcagttgtgctatggttggaggatggggatgggaggtggctggtgagggcctcgttagggaaggaactaagggtgcaggagccctgctgctggaagcagtatgagcctcgggtaacacaagggctaacccaaatgcctacacagagtaaggattgtgggagaggaagaagtgacatgcctctcaagtattaaaattcagttttcatcatttaaaaatagagtaacaataggcaaacagtttgtgtttttgacagggattgtaagagtcaataaatgatcactgaactcctaggagggtcctaaaactgagcgtttgaattccagaatttaaatgctgggtagaaaaggatgacccagcaagtattcctgagtctgaagaagaaaagccaggagtgagtttagtgttactaatggcagaggaaaagagggccttttaaaaaggaggcagtggtactcagagttgaaggctaccaaaagatcaaggaaaatgagaactgaaaaaatatctgttggagttagcaacatggaggccaatgacattcacaaaatgcttaaaatgcactgatattgtataattagtttcaaccatcttctgaattatctgtgtcttttgcctgactgggaggggtgtgggttgctttagatcaaattccacacttctggagatctgggggcattctagcaacaatccagatagtgttacaaacaagaccattataagataaacacattttaacaaggcatttattacccaatgctttaatattagagagactcaactgggctcatgttaaaaacaatgaagcatctatgtcttatgcaatgctgtataggaagtatctgataaagtctagatcctcagaacaaaaattctatgcattggtctattgtctttatttaagacaaagagtgtgcttaaggtacaggtatctaccagctactgaaaactgcagaacccctatccatgatgtatccttatttatagaatgctctaaaaatgctctaaaaatctcccataaaacaggatgaaagtagttttctaatccaaaatgttatcataattgacacttctcagggtaaaaattagcacataatggtgagtgagctcagaaagattcaaaataaacaatttatacaaatcgagctctccaacaattgcaaatatacagtatctattagtctttagctgaattaatcatttattttttatttttatttttatttttgagatggagtttcgctcttgttgcccaggctggagtgcagtggagtgatctcggctcaccacaacctccgcctcccaggttcaagtgattctcctgcctcagcctcccgagtagctgggattacaggcatgcgccaccacacccagctaacttttttgtatttttagtagggacggggtttctccatgttgtcaggctggtctcgaactcctgacctcaggtgatccgcccacctcagcctcccaaagtgctgggattaccagcgtgagccatcacactcagcctaaattaatcatttcttaaggccctcataaagttactgtttgtaaaaaataaaattctacatatatgggaatttagaaaaacatttaattgtcataattgaatgtaattaatcattgttaaaatatcaaagcaataatacatttcagaggatatatatgtaatgatttttaaggctctagtgaagcatactctaaaatgtagctaagcaatctattaacaccggccttttacagaatacagttacaatcattctaacaagataaattggctgggcgcagtgactcatgcctgtaatcccagcactttgggaggccaaggtgggtggatcacctgaggtcaggagttcaagaccagcctggccaacatgtcgaaatcccatctctactaaaaatacaaataattatccaggggtggtggcaggcacctgtaaaccttggcaggctgaggcaggagaatcgcgtgaacctgggagacgggggttgcagtgagccaagattgcaccattacactccagcctgggtgacagagcaagactctgtctgagaaaaaaagaaagataaattatacatatgattgatatacaagcaaattatatgtattcacacatatatagtttccttttggaagattttaggaaaatatttgtcacaattaatgatttttatattttatttataaattgagtactttgacaaaatattatattaaatggttcagtaagactgaaccatatatgcttggtttggcacagtggctcatacctgtaattccagcactttgattggccaaagcgggtggatcattggagtctgtgagtttgagactagcctaggcaacatggcaaaacaccatctctacaaaaaaatacaaaaattagctaggtgtggcagagggtacctgtaggctagggaggctgaggtgggaggatccattgagcccatgagacctaggctgcagtgagctgcaactgggcaatagagcgagagcttgtctcaaaataaataaataaataaataaataaataaatttcttctctttaaatcttggacctagtcatcagatcaatctttctaaaattttgttttcattcatgcatattattcagtggctccccacttcctacaaaatgaagttcagctctttgttctgacatgtaaaccatttcaatatttggcttcaaacattatttccaaagcaggccatgctcctcatctccaccctgagcttgtggtgtgttcctcaccttgaaagctcttcctctttctcttcttcaaatcttgtgatttttaaagatgcagttcaactcccacccacctcccttatgaaatcttcccttatgcttctagtgccttcctctggccttgtcttcatcacttattttgggttttaaacaacgactattatgtacttagtaacagtacttgtgtcccttttttttttttgagacggagtttcgttcccgttgcccaggctggagtgcaatggtgtgatcttggctcacgg

SEQ ID NO: 175 - DNA, 1202 bp, Homo sapiens
acatggattcagacacactgcaaaccttccagagggagctctgttgctttatctgcaggaactacttaacggacacagtcaccattgactgtgggcatagcttttgcaggccctgcctttgtctacgctgggaggaaggccaagctccaaagggctgtcctgtgtgtgggaaaatcccccagaagactgacttcaacaccaatattgttctcaagaagttggcttctcttgcaaggcagcgcagacctcacaacatcaacagctcagagaagcagatctgtgtgctacatgaagaggaaaaggggctcttctgtgaggcagaggagagactcctctgtgggccctgctctgagtcacaagagcatgaggcttatggccacagcccaataggatgggctgctgaggagagaaacttctgaagaaaatggatcatttatggaggagcactcaagaaatgcaaaacaatctaaatcaggaaattagcaaaatccattcattaacggactatgtggccctcaggaaagggatgatcagataacaatatcagaagttgcgccaatttctcctggaggaggagcaacgccatctggagacaatggacagagaagcagaagagattgttcgacaactccaagacggtgaagtaagaataacccaacatataaaaaagacgaaaggcatgtacagagagctgtgggagatgcgccacatgccggatccccagccagtgaacccagaactcacttcctggcacatcaccggacctttctgaggatgtgagaaatgtggtatttggagatgaccatgatggtgcacccggggagtcccagagagcagagaactttgcagcatggggagctcaggccttctcctctggcaggcattactgggaagtggatgtaacccagtcctccagctggattctaggagtctgtaaagattccaggacagcaaacacaaatcatgttcctgcttttgaggaagcattttttcaattttcttcaaagagaaacagcctttatagcctctccaacacctttcttcccttaactcactatgtgcaaagacctttgggtcgggttgggatgtttctggattatgacaacacagttgtgagcttttatgatgtttcaaaaggttccctcatatacagccttttccctttctctttgtcttcccttttgacacctttcttttgtttt

SEQ ID NO: 176 - DNA, 2000 bp, Homo sapiens
gaggctgaggcagaagaatcacttgaacccgggaggcagaggttgcagtgagctgagatcatgccattgcactccagtctggtcgacagagcaagattctatctcaaaaaaaaaaaaaaaaagctgctgcaaatgctcattccgtcacaaccatgctagtgaaaaaagaaataatgggttagaaggtaattttagagtatatctcttactcttttgccctgtaaaatttttgtatttattacttgccatatagaagcctgtacttcaacaaaagatgtcattaatttcaagtaaatatgctcccacatatattctccctagaaaggtactggtgtatttccagtcaagttgtagcatttctggccttttttgtgctgctgtgtttgtgtgaaataaggcaggaagtaaagtggagtcaaccatgacatttcttgtttctaaagccacagcctctaaaattgaatgttaagtcaactagaaataatgacaatatttaagaaataaaattctttttattttttatagtttataaaaaattatttttgaattataagttaaacaacttgaacatgcagatacctaaaagtgtcatctaggtgatagtattaatattttaatagcttataattgtgagtcacagttgccccattgggtttactgaaaagcagttatttatcttatatgtgtgaatggagaataggctttttataatcctaagcatacagatcttttaagattagcgctatatttagatctgaataaaattgataggcttgtaataacaaattttaatacttttttctaatagaagtgaaaaacagaagtcatttgttaaaatgagtttaagagaaacttcacatgtatttattaaataacacttaaaccacatggtaagttactaatcagtaatttcaatctattttattttagtcactgaaaaagcataacattctttaattattcaatcagaaacagtattcttattagtgtttctgaaagcaactgtagaccactcagtggatgacaaggttcatgctgacaacaaattttctatataataataggctcattttaactttaaatataaacactcattatttcaaaagtaaaattaatggttcttttaagtcataagaggaataatgttataattcacttactgaagtgtttgtctcagactttgtaatgaatactttaaaccaaaaattaagttctacatactatctatggataaaaagaagtggtttgtaaatttatctttatttttactaaattaaaaaatttaaagccaaaatgttaggtcaggatttaaaacaagcattgggtgacagggtgttgggcgtaatggttagattgaaactcggtgtcagctggttactgattgcatccccaactttaggattttggtaaaattaaagcaattaatgcaaataaaggtgcccgaagagcacccagcatatagctctcatttgttgattctgttagatcatgatcaatgttaagcctaaaaacaaggtggccacatcagtggtttgtaacccatgtttattctaatcagtcaatctggggctatatataatagtagttgaatgtttatagtactacccttggaaaattcccatatattcacacccagcatggatataaatacggaaagatttcccattgagtacttctctttagcactccagtaacactagacaaataagcacctaaatgccgagtgtttgtcagttttaaaattagaaaagaaggcaagttgttttcttgtctacctgtttaataaattttttattgccaagtacgtatgttcatttgatttaatacgttgaaatgtagtttaaaatatatattcaaataactaacaagtgaaggaataatttatttagaaacgtagaaataatggtactgtaagcagttgctttagagtcttttatagtattgtattttgaacattaaaaataaacattttatttctgagtgttgggtttagactattc

SEQ ID NO: 177 - DNA, 1889 bp, Homo sapiens
gcccattggaagcagggcctcagcaccaatgctactgaggatgtcagagcacaggagcagggccttgggagattacccagcattactcaaaccttctgccctgatgggtctgggtccttggaaatcaagctgtctcaggctgaattgctggatgattctgttcacacttacaatgaggtaagggaaaccagaaggcccccaggtcgatctctggtttccacacacacttccgccctcattgtgtgaaagtagccatgccttctcctgaagatgaggatctattacctgggcctggagaggaggagaatcctcttttcaccaggtggtctctgggcacatactaatcaaaacttctctcgtgacaatcggaatgtgtagttcagtgggctgtcttttgtatccttttaagggtaccctccttggaaaccaggacctcgtaccctgcacagcccagtgttggaagataaaacgtgcaaaataccccattgggtgaatctaagggattggacgtggagccaaacctgcttccatcttttgattcctggacacacatgttcttcctattgagaacacagcactctagagacatctctgattcaaacaatgcacggtgtcctgaaagacggcacccacctctcagagtgcttcctccaggctggcactgagttttgcctgtagaagacctgtccagcattccttgtggctggcagcctctggatggtccagatggtgataggattagtggaacccacagccatggaaacactgaaactttcccagccaagtgggtccttcaggcagataatgggctaggagcacctcctagcctgcagatcaggaatgtcaacagcacccggagagtggtgctggctgagtttctgagagcaggacatgaaaacacccatggaatagaagcctatccctgtgaagatgaacctctggcccttccaggatggaagtagctaaatgtagtcaacttgttacttagtggctagttagtcacctaaagaaatagtgccccactggggcacatcatgggcctcaattgctgatgagttggacattcagaggtgtcgacagctggatctgccttggtaggggggagtcagtgctgttggccccatatgtagcctcatgcctgccactgtggttgctccattcatgaactcatcctaccagaccagggctgacccatggtgaaggctggctaacttccatttgtctgtttggttgttcagtgccacttcagacttgggtattttctgtgggtgtaaacatgggattcaagctcaacccaggtggaccattttcacctcatgatggatgctgttgggcctgtccaatctatgactctgtgggtcacacaggcacttggaaccacatagttgcttggtgtcccgtggtcaaacattctatctaatcaggacaagggacactaaaagttgcttctaataggtggcatatgtctctgctgtgaatgacatgaccttactccagaatcccaggcctttcactgtgactttcccactggtgcttggttcagctccatcctgcatctttccccaccaatggcatcaccagcaccagggggtctgagagatggtggctgcttgcaccatggcctggatctgctgcagggtccttttctgtgtgggccccacttgaagctggcctcctcctatgtcacctagagtgtgggccaaagcaacatacctagatgtggaaagtggtgttgtcagaactgaaagaggctcatcaggcagtgtgcttccttctttctggtgaggatgcaagatgaaacagtttgtctgttaccttggaggggacacacctgcattcccctaaacacttggccattgttcacccataaaactttacttcaatgccca

SEQ ID NO: 178 - DNA, 20140 bp, Homo sapiens
gcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaaggcaggccaaaggggcttctccctccctcccagtctccgccctcccgaccctggggtctcagcacacgcgctcggactccgcgtggaggtgcggctccagaaagatcgcgagagctgcggctatctcgagatcccggagcgctggcggccgcgcgcagggtctcctcccactcttgccccgcccctccgggagttttcccggagttggagggaattcccgggaattcgcggtagtttcgctggattggctctgggggcgggggcaggggttaccaggtggctggctgtagacctgggcgaatgccagctctcttcagcttcgtcccaactgcgacttctgctccattcttctaacagccctttcaactccgctcggctgtaaccgcagactcgtcactaaaacacccacctaagcgcgggccttggtttctcctctcttggactttcccgccttctctcttcccctgggcgacgtagctgcttggggacggaggaggcctcttcgcaatccattgccctgcttgttgggacagaggagtgcagttggcttgccaaggcagcatgggttaccagtccctgtagtgttctttcttggaaccatctgccaagctgtgaggaagctccagagccatatgacaagacctgatggaggataactgaggactttggccaacaaccccagctgagctccagttggaatgtgaatgaggccattttgagtgttccagcctattggagccctagccaacactctacaaactagaactgcctgattgacccgcagaatcataagaaatgtaaactgctgttttaagccagtacattgggaggtggtttgttatgcagcaatacctgactgaaacactggggctcctttgctcagcttggttttgaggccttgcaccacgttcacctgctcacctcatcaccctcaaacctctgcagggaaatacaacttactttctgggttttcacagtcattttagctcatggacaaagtggttcactcatcagtgactatgaaagtggccaaatgatgatcacaatactaattaagactttttgaatgcttatgatgtgccaggcactgttttaagtgtaatatatttattcatacatttaatttttagaacaactttttggctgagaaagacaggattcacttccagtgctttccaaagcagcattctctttgtcttaagtcagggaaggccttcaaattactttcattagaagaagatttaaaggaatgtttctgtttagggtttttcagtctaaacaatttttagaacaattttttgagctaggcactattattatttccattttatgataaaacaactaaggcacagagaggcaaaataacttgtaaaacagtaagtgggtcaaatcaccatcagaacccaagcatcggcccccagagccacatgcttagctactgtgatgtcctgcctcccataaataatatctcaagcttatttttatttttttaaaaaacgtttttgagtcaggatcttgctttgtcacacaagctggagtgcagtggtatgatcatggatctctgtaaacttgaactcctgggctcaaaagatcctcctcccttggcctcccaaagtgctgggattatacaggtgagccaccatgcctggccctacttgagttaagaaaatcctctaaggctttgattgcctcgttcatttattctaggttccaggctgtgtcccatgctggcagttacatttagaaaactctaatgttagagaagtctgaattaactattcctacattcacagttcagggtaggatagagtgtttgcttggttttcccaggtttctcatccctgtgtggccaccgcagagggcagcagagtgacaggctgagggtgcagagggggcagagaagcagaactgatggagggcccaggcagggcaggggtgggcggagctatttgcacatctcaggagtgagagctaggcgggagctcagccctaactctcaccaaccacccactgatggagagggcagcttcttccaatagcaagggctgtggctgccaaaactgtgccatttgacttgaagcggaggaaagtctccttgcttgctatgcaattgcaattgcagccttaaggcaagctccccacggccttcagatccctcccaggcagacatcctggagctgtcactgcaaagcttgtgattttgcttcaagcagcccttgaagttctcctgcttcctatttgcctgataactgccccaaggactctgaaggaacattttaaaagctaattataaaatttagtaggcctgcattcttacattgtattaagagtgaggcctttggagacagccctgggtcagagttccatctctgctgcttaattgctgtgtggctttgggaaagctgttttcttctcagattctcaatgttcttggctgtagaatgggttagtgatatttaccctgtgtgcttgttgtgagcaataagtaatcctatagtcaaagcccttggcctcatatataccaggcaaccatcagggtagctattaattacaaacatagaatatattgtggatctatgagaccattaacataccatgcagtcttagcatgtaagcagcaaagggtaaagctggtgtttcatgctctgctgtacaatgtttgcagaggaaaaaagacaatcaccctgatctattttagaaaaatgctatattttaatcgcttctctttttactttcttattttagttttgtcctttaaatgctttggagcatttaatagctcttctgctttcaacttctataaattcacaacttctataaatttaaaaagtgtctaaatcttgattaaatgctcttaatctgaggcttatgggtttccaggggtctgtgaactttttgaaattgcatgcaacattgtttgtgtctacacatatgtgcatttttgaggggaaatgattcataattgtcaacagactctcaaaggattctgtagttggacaaaagatatagaagagtccttggacaaaagactgaaaaaccctaaacagaaacattcttttaaatcttcttctacagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggtaatgtggtaaagataggaccacgtggacgaagaggtattaccttctctaattacagctaacaaagacctaggcctaacctcaactgcaccttctgtctctgggaagtcacttatagagtagacctataattaggatttggtaccggaaacataattctcaggatggtgaatctctaaattatgtccccagagacatacctgagacaaaaccctaagggctgttggccgtaagagggtgtgtgtggtattctacattcagtagggatttataaatgaggatgatatcactcagaaggggcaggtgtccaagaggcccttttgacttctgcaatggggcctgacagccccgtgaactgagctccataatttatgcctccggcatagaatctgtgcaaagcaggaatggccgtatcagcatttggggatttaaagcagcttttttttttttttttttgagatgaagttttgctcttgttgcccaggctggagtgcaatgacacaatctcagctcactactacctccacctcccgggttcaagcgattctcctgcctcagcctcctgagtagctgggattacaggcatgcgccaccacgcccagctaattttgtatttttagtggaggctggtttctccatgttggtcaggctggtctcaaactcccaacttcaggtgatccaccctcttcggcctcccaaagtgctgggattacaggcgtgagccaccatgcctggctaaagcagctttttttatccacagacctctttcccaaattgtaaggaggattcagctcattgatttcactttattttaaaagaaaataattattgatgtgtaaagtaaatgaaaacacagtcaagtgggagtgtaattgaaagtaatttaagagttcaatggttgatgacttttttcaattatgatatctctttattaataggaaattcataaattaaggagtatgcaatataatcattgtggaatatattagggaaacatttttgatccatgcaagtaaattgagatagactgggtgcacctgttcctagtcatgcccagggaatatgtgaaactctggctcaggatgaacgtctgttggtgtcagcacaacaataatgaaacaaagttggcagtagggtggggaagtgtttggtgggtgggagccaccatctgcagccagctcccagcacggctgtgtgttcggatacccatcaaccaggaaagggagtctaaggcctccagatgattttcccctttcacaaaactgttgtaaaatgaaatacaaatccttcctgaatgttcctagcttttcttcctttcggaagttttcagtcaatgggaaacaaagccttattcaaaggattaaagccatagtcattctattgtttggggcttcaataatgtggctttccttccacagacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataaggtaagactactcagttcccatcccaacccccagaagagaatggaggaagggaagcagactctggctatatttttatggctgcactccaggcagtactgcagaggcaacaggcaggctctgaaatgccttcttccccctgctatcctcaggcctgtgtttctctcttactccacccaagtcctgggcccttacatggcagagggagggagaagggccagcaacattggttaacaggaatagagaatgttcgaggaaggcagtggcaggcaatagccatagagagtcacagaaggttaaagaggttgtggaaacagtcatttgtttttcaagcagttccggtggggtttgagaaagcagcagcactcaactgtgagcagacaaactcactttggaaacctatgcagccacttctaagtaaactaccaagagaattattattttatttaggttcctcatttcagtgacaatcttttaatcctttgaactgtatgctgaaaaggacattatagatcctcctgaaagataatttttagtgtccacggttccctcaatatgatgatttttttccttggtccctatctttcaccattccctttaccttttatccatgcttttccctgattgaaggaagacagagtctatttgcttcctagcatcttcttctatggctcttgctactgaaagtgtgatctagattccagcagcagaacagcagcattttgcttctgagaagtgcagaatctcaggcaccatcctatgactactgaatcagaatcagcattttaacaagatccttggtgatttgcatgcatgttagtttgggaagggctgatctgtacagatctgccctataggcctgactcataacccacactccccaaaacctgcaagatcctacatttctggccctgtatacttctctagtctcatcccatgtcactctacctctcattcactagttccagccccactagtctttctcgttctggcctccaagcctttgtacttgctgttctctctgcctggagtgctcttgtcccatctagtatggctgactcttttatttcagcttaactgttacttctggctgtgagcggtggctcacacttgcaatcccagcactttgggaggccgaggtgggcagatcacttgagcccaggagtttgagaccagcctgggcaacatggcaaaaccccatctctacagaaaatacaaaaattagtcaggtgtggtggcacacacctgtggtcccagctgctcaggaggcttgagcctggaaggctgaggttgcagtgagccaaaattacaccactgtactccagcctgggcaacagagcaagaccctgtctcaaaaaaaaaaaaaaatttacttcctttgaggatgctttcctgacccctctatatgaagaactacctccaacccagctactctctattccattaccctgttttatatttttatggcacttactgttatctgaagtaattttattcattcatttttgggtctattttattcaggattgtgtgtccagtgttcagaagagtgcctggcacatcaaaagtgctgagttaatgtttattgggtaaatgaatacagttttgggaatcatgaacattgagaacctaggcccagacaattctaaggtaaaatatgtcaccctctgaaccaacccgacagctttcagctgattgacctaagaccagtgcttttgggtgcccggatgagcatatcaaagcctggtcccctgagcagttgcatcaatatctcctaggaacttgatagaaaggcaaattcttgggccttaccacagacctactgaatcagaaatcttggcaatagggttcaccattctatgttttaaggagcctgccaggtaattctgatgcactgccccacacaataccaacatcttaccagtgtggagaacccacagtgttcaaagctctcttacatatatcgctgttgttctggacttcataaaagccctgagaataggcatggcaggtgtcattatttcccctttacagatgaagaaattgagccctaggaaattattccatttgtgttggtaatacttgctttatcagaatcacttggaacgcttgttaaaattgcagatacctgggctctaccctagacctactgaatcagaatcattggggctggggctctggaatctagatgaaaaaaaaaagaagctcctaggacattctaaagctaaaagtttgagaaccaattgcaacaggaaacagtggaatagatatcagagcttatagcccctcattcctaaggcatgctcttagagagtcttgagaagagtaagtaatgataaagaatgatattgatctttagtatcttttagtgaaaatagttaaaacaaactggcagtaattctttcacctttattagaccctaaccctacttgctactgttgtaaaccagggagaatcaaactccatgacaatggactgtttctttgtatataatttagttgtgtatagaaccaactaactggacatcaactaaggggtggcaggttttcctgattagtttgtgatacaggaatttttatttattattaaaaaaaatttttttttgagacagagcctcactctgttgcccaggctggagtgcgatggcaccatcttggctcactgcatcctcacccactgggggcgatcttcccacctcagcctcctgagtagctagaactacaggagtgcaccaccacacccggctaatttttttttttttttttgagatggagtctcactcttgtcacccaggctgcagtgcaatggtgcgatctcggctcactgcgacctctgcctcccgggttcaagtgattcttctgcctcagcctcccaagtagctgggattacaggtacgtgccaccatgccaggctaatttttgtatttttagtagagatgggatttcaccatgttggccaggcttgtctcaaactcctgacctcaggtgatccacctgcctcagcctcccaaagtgctgggattatgggtgcgagccaccatgcccagtcctggctaatttttaaaaaacatttttttgtagagactgagtcttgctacgttgcccaggctggtctcaaactcctgggctcaaggggtccacttgccttggcctcccaaagtgctggaattacaggcatgagccactgtgcccggcctaaaaacagtaacttttaaaaatacttctccaaatgggcaagtaactcccaaatctcttctcctgccccagcttccctggctccaggcccatacattgaactgcatatggaacagttctcttctagatgacctgcgggcatcttcatcttagtatgtccaaattcattactttctttcccaccccatccattcttcttcctggctacactctatcagcgaatgactacatatatcacccactgtgtcatcttagccaggaatccaggcagtttctggattccttccatcctgtctctggatagctaaccagtcatttcattgtactccttagattgctctcaaatcaccaccccttccttcatctctactcaactccagttcaagccctcatcatctcttgcttgggttgtcatgatggcttccaaaatggtccctttgtcggtgcttctagttgacctcatttctcctcttccttccttttggctctatgcttcagtgctgtcaaattgctttcacttttttaaaaaagagttttccattttaatttctgagacacatgacacatctttgtcaatgttaggtctgggaaagtttctattaacttcacaagacagaaaggacccttctctccagcagtgaaaaattcaaaagaagagagcttcagggagttcagttgctacccagcagaagcttcaatttctaacaaaactgtgaagtttcaaataatgaaggggaacttcaccccaagatggtactcacttaggaacattattttccttcagctttcccttgaaatattcaacagcttttttttttttcgagacagggtcttgctctgttgcccaggctggagggcagtggcatgatcttggctcactgcaacctctgcctcccaggttcaagcgattctcctgcctcagcctccctagtagctgggactacaggcatgcaccaccacgcatggctaatttttgtatttttagtagagacagagtttcaccatgttagccaggctggtctcgaactcctgacctcaggtgatctgcctgtctgggcctctcaaagtgctgggattacaggtgtgagccaccgcgcctggcctcaacaactttcttctccccattaggattacctccattgtgggctcttttcgagggaggaggcactgcattctcactcccagtctaaagctgctttcccttctcggtgatgttttctgcttccatgcctttgtacatgctgtgtctgttctattgattttccttttcccatctcctgtgtatggcaaactcccacttgtttttcatgattctgctcaagtgttctttcctgtatgaagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattgttgtttgaagccactctgttttgtggtggtttgttaggcggcaataggaaactagaacaccatagcttttttttttttttttttttttagaaaataacttgatattcataagcacagctttttaagctgcttttattatttttccctttatacgagtgcattctgcaacataaggagatttctatctcagccctgaacaagatttatgatcttgatcaagtctctttataataatgtcacagaactttacttgcttcaattctaatatgaaggattgaactagttaatcactaaggtccactctagttccaaaattgtggcattctcttctaactatcagggaaaaattgacttattctttgttaagttgtagcttgcagtaaagttttttgggcatgagaattttcagcaaggtggtgagtgccaggaaagtgctgactcagcacaatgctgtctgttagccaggaacaaaaatgaggagcaaccataaatttaatcctttagctccttctccctgcaaaattcagaagatgttttatctgtaacaaaagacttgaaagaggattctcactttttcccttaaaagttgttactcaagtctgtaggtaacttcaggatttttgacagaagattcagatttgcatagttgactcagtctccggaagatccctacactcaaattctaagtttagggcaagtgaactgagtgattcctagaggaaataaactctcgcctgagaacaacagctgaaataaaatcccataagccaggaaaacagccacacaattacagtaacaggtggtcagtttcaaaacaaatttcaaggtctgactcgcctggcacctgctctagaaccacagacagcagtttgacactgtctgggtccaagttaggtcatccctgccacaccataaggaagattaactacctttattagcagagctaagtcatggtaggttagaggactgcttctctgtggtagtaacccctgtgttccctgtctgagaagagggaataagagagaatttgggaactggacaggaccttgcagattaaccattaggttggtgcagaagtaattgcagtttttgtccttaaaagtaatggcaaagtgaagccgaggggagctaagcagagatttgctcagaatcacatgacctgtagaagcagaacatccccacccccattttattgtgaaaaaattcaaacacacagcaaagttgaaaggatttttacaagacacagctgtatatgcatttcctggattctactgttaatattttattaaacttgtttattttctaactatccctctatccatccttctatcaccttatttcctggatgcctttcgaagtgaattgcagacatctgtactccttcccctaaagcagcatagtgttttatcatcatttaataatttaatacctcaattttgtatacattatggaaccaggaaacattataagaaatcactggaccccaaaaatgttaattagccttggctagcctgaaagagaacacaatttcctaaggtcctaactttaaggcacttgaggattcttactaagggcaaattcctgagatgacagaaatactagtcaacacacatcaatgcctatgtttttccctcctcctggaatcctgtgctttccccttcctgctccacctgttgaaatcctctcttcattcgtccaagaatgatctcagatgtctgcaaggaacataaaccactgttacacacgtattgttttaaggaaaaaagttactgaagaagtctgaactgtcacctccttcccaatccctttcctaaaccccgagttttaacttttctcattttaatgcccataaactttcattgctatttttcctccctcattctaccttgttgcagtttagtgtttatttgtttgtttatcacgactactgctcctcctcctaataatacttatggttaatttctttttaagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggcttaaaacctagatgatgggttgataggtgcagcaaaccaccatggacatgtatacctatgtaacaaacttgcatgttcagtacatgtatcccagaacttaaagtaaaatataaaacaataataaaaaggaaatgctcattcaggagttttggggtgggggttcaggaggctgcagccttaacaattacctctggtgattttgacacaggtagcacagcagccaaacttggagagatttgttcacagcactgcatcaccaaccttactttctgttaggcctttaatcactttttttttttttttttttttttttttctgagacagggtcttgctctatcacccaggctggagtacagtggcacgatcttggctcactgcaatctctgtatcctgggttcaagcaatcctctctgccttggcctcctgagtagctgggaccacagacatgctccattatgcccaactaattaaaaacattttttttagaggcaggctggtctcgaactcctgagctcaagcaatctgcctgcctcggcctcccaaagtgctgggattacaggtgtgagccactgcgcccggccttttaatcacttttaaaccagcaaccctaatctgcctgtcccttgaatggatccggataaaggtgtggcaaacaagcctcctgtcacagtggggtgtgacagtcacggcatcaccccttcaccacatcatgtgctgccagtcatcacttctgctgttgccaccaacccttgcgtttccctttgtcacttcccccttgccaccaccaacggccactgtccctctgctcctcaccctccatagctgagtcagatccagcattgggcacttgaggaagaagccactgtggaaggcgggatgagggtgttcccattctacattcacaagcccacagcttggagaagaagcacacctaattctgaccctggcttctgaagaagctctgcaaacctggctagaaagttgggcctgtggtttgaggttcctgctgcctttgattttacaatgagtggaaattgaggttgagtaacaggtctcttgcccaagtattaagggccaccacgaagcatacagcaatgaaggcaggagctgatgacatgtggttggttcccccctctaggccaagtatctttgtatagggaaggccgacatggccatcttcacggtttggtattagtggagtgtcttatacatactgaaatttgtttttgttttcaggtgctaaaaggataataccaaggaaaactatgggtgggggcagtgaatggccagcatgcctataatcccagcacttgaagccaggagttcgagaccagcctgggaaacaaagcaagaccctgtgtctaaaaaaatttttttaaaaataagctgggcatggtggcacgtgcctatagtcccagctactcagctactcgggagaccaaggtgggtggatagcttgagcctaggaatttggggctgcagtgagctatgattgcaccactgcgctccagcgtgagtgacagagtgagatcctgtctctttaaaagaaaaaactatgattcaaagtgttgttttatgaagcataacctgctttatgttttgagtttaatataacttgaaatcagtttctctaagacagtgccagccttgccatttttcagttcaacatagatttctctattacagtggttcccaaactttaggaggcatcaaagtcatctggagggcacaaaaacacaaatttatggatgtcacccacagttcctaattctctctctctctctcttttttttttgagatggagtcttgctctgttgcccaggctggagcacagtggtgtgatttcggctcacttcaacctccgcctcctgggttcaagtgcttctcctgcctcagcctcccgagtagctgggattacaggcttgcgccaccacaccaggctaatttttgtattttagtagatatggggtttcatcatgttgttcaggttggtcttgaacccctgacctcaagtgatccacccacctcggcctcccaaagccctgggattacaggcgtgagccaccatgcctggcctgtttctgattctctaggtctggaaaggggcccaataattttcacttctaacaagtggcaggatgctgctgctgctgctggtccagggaccacactttgagaagtatggtactgtgtggtacttaccggaccatttaccatacttcctgcctgcctaattgtgtcacaatatagccgtgcttctcaggcctagcaattcattagaattacctgtgaagcttttaaaatgtaaggtttggatggaatgctcagaccctaccttagacccaattaagcccacagctttgagggtgaggcttgggtattgttcagaaagatccccaggtgattctaatggataccgagggttgagaaccacaggcatatagcaaactctggccctattctaccttaacatatgattctcatttgacaaatacatattgaccacctaatatatgtcttgaaaatgataaagtatgtaagaaatggtccctgacctcaagcagagatacatcatatgcccaaatatttaaacaaaaagctggtgtgtggggtttgtgccaattagaggactaaaccattactgaaaacagaaggctggatgattcagggtaaatcaatgctgcacttgatcctcacattgtttgagataagttatgtatgcctctgctgcacatgaaacgtatccctttggtgggggaaattgctcatttattggttcgttgaggatgttccaactgattcaccatggtaggtgtgattgaaccatggaaatgatggaacattaaatcaatagctagtcagctggtgactattccttggctaagtatgctattaaggttctgtttcagaagtccctgtgctcaatggaggtgaacctttccagtggagaaatacaacatgaattatgtttagaaaatgcttcaatctggggttttaaataaacagtccttaaatatgtataaaaatctgaaattattttagaatcgaagggaaaaaacaaccgggtccaaaaaccaaaccatatttagcttaaaaacacgttcttatttgcatccactagaatacaatataatttaatgattcaatgacagctggcccatgaagggcagagtttctagaaaggaggaaataccctctttgggtgttacttaggtattaagtgtattatttaattcattgttttatttaatttggttatatcttttttttttgagattttgttttcatgttgggtgggtagtttttctaagaataagaaatcccaatgacaacaaaatgtcattgtttttaagagaaggagataaatacattttaaactgttatatttatttattttcaaaaaatgctggaggcatcatgttagcaattgcaggggataacatgaatatgacaaagctgctctcaaaaaacttaccactttgtagaagggaaagctaagtgcctattccaagcaaaatatgatatgatacatgcctttagagaggagtaaattttaatgaggcttcaaagagctggaagaagaggtcaaggttcaaagagcctaagataaggcacagaactggggttctggtacaatgcattacagcatggccaattttcaaaggccagctgttcccagtcaaacgaagatgaagctgagggcaggtgcaatcaatgggaaaatcaggccaccctctcctattttcccatagatgcagtttcatgatcaatagttttataatctcattttgggtagcaaaatgaaaatgaatctgaagcattctttctagtttatttcacactaataaaatccaacctgaaggattttatatgttggctctatggccgttagtatttgattaaggtgtttagcctcattagtaatcaaaggaatgaaaactagaataaaaattcagtcattgtttttggtttatcaaattgataaagacttaaaatggccaccaagcattggggaggttaggagtgataggctctctccttctatctatggaatattccttggctcaccatggctggagaacaatccacatccaatagctcatcaagtctacttccaggaatgtattccagaggaatagtatggacctatgcaaaaacttgtgtacaaaattattcctcagagctttgcttattattgggaagaatgagtaaagaaataaatgcccggccaggcgcggtggctcatgcctgtaatctcagcactttgggagccaaggcgggtagatcacctgaagtcaggagttcgagaccagactggccaacatggtgaaaccccttctctactaaaaatacaaaaattagctgggcgtggtggcaggaatctgtaatcccagctactcaggaggctgaggcaggagaatctcttgaacctgggaggtggaagttgcagtgggccgagattgtgtcattgcactgcagcctgggtgacaagagcgaaacttcgtctaaaaaaaaaagaaaaaaaaaaaagaaagaaagaaatgccccgaaacaggttaataaatttaaaagtattatgccaggaagggaacagtagcagtccactatgcctagaaactaagcctagtaacttagaaaaaaaaatcttccaagtgttttaggtaagttagtattaataattctacccaaggtcaatcccctcccctccatttcctcctcttcagatattctgtgcttctgccaaataggacaacttgctatttgtgtcctgaactgaccttatacactttcttgcctctctgcctttgctcgtgctttcccactgtctcaatggctttccttaatctctgaggtctcacctcttcaagacccaattgtgtaagccaccttacataatgttattatgatgtcccccttcctcatccagccagaaggatttacttccttctctgtatgctcatagcaatttgttcattttctattcttctcacccttgtcctgtgttagagttaccgaaatatatgtatatgtgtgtgtatatattttttgtcttgttttgttcctgttagattttgaacaacttgagggcaggggccaatcttgttcagatttataccccccagagttataaagcatgctgtgaaaatgattgttgactgaataagcgagtgagtgaatgcaaaagtacacttggagccaaatgcttatattctctgcagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttggtgggctgaagagttaaactgtggtgaatgctgttagataggaaggtaatgaaaacttcagttagcttaggattattcttaccagcaagcattagttaaaagttaaatttagcaagtggttacccaaatgttaaaggcatttaaactggctgggcacagtgagtggctcacgcctgtaatcctagcactttgggaggccgaggcgggtggatcatatgaagtcgggagttcaagaccagcctggacaacatggtgaaaccccgtctctactaaaaatacaaaaaattagctaggcgtggtggcaggcgcctgtaatccagctacttgggaggctgaggcaggagaatcacttgaacctgggaggcagaggttgcggtgagtcgagattgtgccactgcactccagcctgggcaacagagtgagactccctctcaaaaaaaaaagtatttgaaccattctttctgtgctgcataaggtattaataataaaacattacatgactgcatgtataattctacctaattgaattgagttttcaaattattttttgtgtgtgtcttagacagtggcgcattgaaagtactgcctgtccaaaatcaggaacagaaaagtatttcaattactcagaaagtagacatggctggaaaatcataagtaagtggttattaatgtcaagtttaaagctctcaggctcttctgtcaggccacgcagggcaaatgagatcaacaggatggtttcttgtttttttttgagacggagtcttgctcattgcccaggctggagtgagagcagcggcacggtctcggctcactgaaacctcctccgcctcctgggttcaagcaattctcctgcctcagcctcctaagcagctgggattataggcaagagccaccacgcccgactaatttttatatttttagtagagatggggtttcaccatgttggccaggctggtcttgaactcctggtctaaagtgatccacccttcttggcctctcaaagtgctgaggttataggcgtgagtcactgtgcctggcccaacagaatggtttctaataaaaatatttattaccattgcatcctaccccattcccactcagtgtgccccttacttaaatggccgccttcacccaggccactacagggagggcactgacttggaaggacagaacactcaccactacctagccttcaccctggtcatcagttgcacttgatatggctatagctggtatatttctataatgatgggaatcatagaaattgttagtattgagttgcaagtcattggtaatgttttccaaggaatgaccaagttctgtgataatatatgcacagacaggaaaaaatacaaataaatttaacagcacatataaaaatactatcaccttatactgttcattttgtgccatccaggcatgtaagggagagagaaataagataaatttgctggtgggagaagcaagcaaatagagagaagtttagaggcaaagaatttgggaggggctggtgaaaaagaaggggaaggaggaagtacaacc

SEQ ID NO: 179 - DNA, 1637 bp, Homo sapiens
atgcgcagccctcgctctcgcacgcaactcgtggccacctagcctagaggcggctgccaagcgtcctggctgagggatggcgggaccccaggcggctggagtggagaaagttgaccgcccccgtcttttctgccccgtgggtggctactgcgtgcccccaagtaacccagaggttgagggccccccagtgcgcggcggccgggggtcaggatgcgggactcccctccaccgccatgatctcgcagtgtgggggagcgctcggggacagaaatgaggcccgagatgtgtgccttctccttgctcctgaccgctgacttcgttattccaaatacgcagccgaaaccatcgctcttgcaggtgcagcttttctctgcctctcctatgtggaaagcagcgcagcgtggactccagccaaactccctcgattggattgcagctctctggctctctgtccctgtgaccttgggcagtttacctcctctatgtctcagtttcctcagctgtgcaaaggggttactgatcctgcttaatggggtgggttgttgtgaagaggaaatgagttaacataagtagagaaagagactggtgcctggcaagcactatgtgagtgttttgatgttattattgctgtttttattagagctgtgtgtaacgggacgtttaatgagccttttcctgttaccctggaattagtgagtcagggcacaaaggtgagtacccagaggcattcagtatcccacactgtaaaggcagcacaacatggcagcacccagagcttattgttagagggctgaagagccagccctgccattctgaaccaccaccaccctaccctcaggcttacataactggacaacgggggagggatggggcgggaggaagggtaagagtttccctaagcagcttcctgggtgcagaaatagggagggtgcggtgctattactaaagccaacagggtgtagctcaaagagagttaccataatgacttcagatgcctaaaaaagagaggctggcatcttccctgattggatgtctgcttggacagtgtgagcttgctagactgcctttatacctggctttgaagaaatctagaaaactcagagacctctgggcaagggtcttcagggggcttccctgtcattgcttgtgctgtccaatgccagaccacatccactaggcaagaggctgtggagcaaacagcaatagggagtaacactgatggcaaagctagttggagttgggagtgaaggaggttgagctagagctcgtttcccatatcagaacactctatactgaagataccctgcagagcctttggaaaaacttacatgaactccccatgaaagaaggtcagtggggctgggcgcggtggctcatgcctgtaatcccaacacttcaggaggccaaggcgggcagattacgaggtcaggagttcgagaccagcctgaccaacatggtagaaccccgtctctactaaaaatacaaaaattagccaggcgtggtggcacttgcctgtaatcccatctactcaggaggctgaggcaggagaattgcttgaacccaggaggcagaggttgcagtgagccgagatcacaccactgcactccagcctgggtgacagagcgagactccgtctc

SEQ ID NO: 180 - DNA, 2839 bp, Homo sapiens
agatcagcagcaacacctagccaacccacagcttacttacagcagacatgtgaatcaatctagccaagactaaaagaatcactaaaccaatatgtcatcctatgaataatagtaaacgtttgtcttaaactatcatattataggaaaaaaacctgatatatgaaattaccctgtgagtttatattaaagatacacttaccttctccaacaagagttgtaacaatttttttcttattgcaaacaatgctatggggatacttatagtagcatttctgctcaacgtaatattttattgtagcactgtttgcaataagaaaataattggaaactgcagaaacgatcactaatgaggtatgggttaaaaatcttttaagttgaaagcaacaaatgtgacaattaaaaggcataaattagacatatattttacattatcacaacttgtattactaaatgataaaaatgagttgcaaaataatatatagaactttatattttataaatatgcacatgaaaaaatgtttgtaagtatgcacaaactgttaacagttattacttcagaggagtgaaaaataggttgaaaatgagaatgactttcatttttagtatacttaagtacattttcaattttcaattatatgcagtgattttgtcctttaaaaaataggatggacttttttaaatataaggaagacattttctgtgaaacaataaattactcagtatatacttaatgtgcatgaagtatgaggtaggaatacatccactgacattcttgcatttgcataccacttccccaaatatgaactcacttctctgactttgctagggctgaggaatcatcattacaatatctgtaaaactggatttattaagtgcatccatattgtttatgagtcatagaaaatatgttcattttcctatccatgttaaaggctgcttggaggattgacggagcattgcttagaaaatgttctggaattcagatgaagctgtgttagtataaatcattactggttaccatatactcacacatacttaggggataaagatcagaaattacttaaatgtactttgtcttcttcaatctttccgtagcagcacatgggtcaaaatctcctgaaagttgagcaggggagctgtagaagaattcctccttttctcgcagatgaaatcttatgatatagcaggggttacctggccaagaaggtaagtctgtcatccagcagtgcttgcagagggactaaaatgaattaggatgttcagagttgtatgttaggtgctgcagaaaggaagaaaagatctcatccataaaggggtctttgaccctggggaatggcagttggcaattacgctgcttctcagttccatcctgtgttgccccaggtttacttcatggtcacccaaactttctttgccatgtcttttgtaagacttctacttattactatgtatcatcatcttttggtaaatataaattctggctaggagaactaggacagacaggggagctgtctgcacactgtgattaggcatgcatcaattcagagctccatgctgctagctcctgtattctgctgagctcccagggaggaaataggaaaagggaggagaactcacctgtccaattacaacctactctgcagtacaaagtactgcaaattccacacagtggatctctgtgattgaaggagcacttgtaaaatctgagacatcctagtttttgatttggtatccaaaacaaatctgaacttttaattaaatattgttctttttccttcttgtttccaaatgaatagttacaccagcaaacttattggctgaaaagttgtttcctacatttgcactttgaagtgcatcagacagtggtgtgtttggatgtgggtcttgttgagtttggttagtgagttattattggttgggattgcagtggtcctgccaatggaagagaagtaggtgtgccgagtactgtcatgttcacctccgcctttcacagaggcatatttagccctcagttggtaagtgaactttttgacaaaggtttaagaggtcgtagagtctgtgtaaaagacaaaagtccaaaagtgaagcagaaggaatccagcttcttatttatgtctggcatgggaagcttctggatttgatagtgggtgcaccgaaatttgcatcccaagtcatagcctttgctctgccctaccttctggtatgttgtttttcaagttacttaacctctcagggctgcaacttacttatttgaaaaatgaattctagaatcacagagttggatacaatcttaagggccaattagtcaaactttctttccagaggtattctgcatgatctgaaatgtgtctctgaactatagcttcctgaaatttcattattcttgtaggaacacagaggagaacaaagaaaattcaaggaactaaattccttctccacctcaaccaccagcattgatactccatcacttatgtactgcatcaagccgtcctcagaggtgaggaaggtgctgtcaagactagaagcatgtgtccctctctccattgcaagatgggacatagagaggagaaaagtggcagacagaagtcttaggtatgtctttatcagcagcatgaaaatggactaatacagggaccaatgattgcatctacctcatggactttttatgagaattgactgatttaataaatgtaaaagacttagaacactgcctcatctattgtaaacagtcaataaatattagtatcaattttcattgaatcctaatcagtataactataatgttacattcatgaataagacaaaggctgggacaaaataaatgagacacttcactcag

SEQ ID NO: 181 - DNA, 23424 bp, Homo sapiens
atgggaaagatctaccttctggaagctactactacgtggtgcttggaaaggtgaggatgggggactgaccccaggaaattgctcgaaactccgcatctggtgggatttccagaaaagtcagtgggagacgggaggtttggaggccccgggttagaaaggtttgtcagtctagggaatgaggagaatcagaataaaactagggcagcaggctgtccgcctttggttgggggagggaggcctcgaaaaatcagggtcccggctctctaacctgtctttgtcgcaggtctcacgtttgtggggagggggtttaccaagccctgcgccatgcgcagtggcccccacccgtgactgcgcatctggaagcgcagtgcgccctgggtctctggcctaggacgagcaccgcccttcttattacataactgagggcatggcacgcgccttctcggcccttccttgcaaccctaccttcttgctccccagggcccatagagctggggagggtctgactgggtagcagtgaaggactgcaatccctgggagggctaactcttgtctagttactggcaggagccaagcttgaggacaaaagtggtggttttctagcctcatcttggggaagaggctacagaacatccttctgagtgccccataccacctatggcccctagggcctctctggtggagggggtggcacccttctttcactcatgtcccatctgatttttgagaggatgtttctgaaggaaaagatgtgatgattatcgggggcttggttgggaggtagttttgacagtttactccccttgtcactggcttcccctcttttccctgggtgggtttatgatctttctggactcctctgatgagctgccattttggagccatttctgctggtctccgacatggtggcgttggtttttctgtcctgctgtgccagttccgcagagtgggcggggggcgggggctatgacggaggaggggaagggggggcaaaagcacagcagaggcaggcacagtggtggctgccgcaatgaaggtggctctaggggcagagccgcctagtcccacccttggacacagtcctgggtggggattcaggtggaaggcgtctgggtaggggttcaacacctgggcccggctttgccagagcgtgggtttcccatgtcctcatcagcctggtgcttggagtagttcggaaaagctgagtgtctgaatgagagtggaggcagaggctcggcagctcatctcagacgtgtcagacccgtggtttgtgttccccaaataggctctgtctccagcagcctccctgtggggacagggaagtgaggtccatggcagctttgaggatctgttcggatggtcctgcctgcttactgtttttcttctctttctcctccatgccccctgccagtgccatggttccagctgtagtcctcttgtgaggctccccgctgcccgttccccctctctccaggcccttctgcgtgcagcggccatcttgtctttcttgctcagaaacttaaaatggtttctcataattcccagagtaaaattccttccctttagcgtgatgctcaatgctggccgtaactggccttaggtttcctgtacagtcttacctctctcagtttcttttggtggaccataggttccaacaaaaccaggcaacttccttttcctatctgttttcaccagtgatgttttccatgcctcttctcctctgcatccacctgtggcagtctcactttctccgtggacctctcctgatttccttggcaagaagcagttctcataaccacccctgccctttcagccaaacttccatacagtctgtccctttttatggtacttttgttgtgttatgattatttgtgtataagtcttatgtcacctatcagattgggagctccaggagggaggctagagaaaggagaaggaaaacaaatacctatttggtgccttctgtttgacagataccatgttatacactttccctgcagttacttcatttactcctttccacagccctgtggggagcatcccatgtctagtaagtggcctggtcatgactagagccctggtcttccaaagcctttacatttttcctctctgaattactggtgtttacaagatggctgttatgaagtagatccccaaaatttgtctatttaaggaattttgtaagtccctaatgctctgagggagtttgggtggtcaatcttgtgtccatggtctgggtccctcagctgttccttgacactgtcattaactttctcctcttcctttgtggtcaggttcactcaagatgatggcttttttcttgtagctgaaattgatggattaactgactcagttatcctggttgccttcctcgtacaagaggagggagaggtggagtgggatacagcatcttcaaagccagaataagctccagaattagagagcagggagcagagacactggacttgaacagacctaggttttcattgtgatccttcttcttagctgagtgactttagacaagtcatatgatttaagttttcagtgagatggagctactacaactgttatacagaaatgcctaatatattggcagcaaataggttcccatccctacccagtggtttatcagggacttaaaatgggagcatagcagggggctagagaagaaatgggggagacaggagctcctgtgccctaagtggtatcacagcaggggcgcagaggaggtaacctaggcgttacgcccttcaagcctgcaaggtgtactgtcccccacctgccataaatacccctttacttctgcatcaggaacatgccatggcatctgagtggtgggggctggtgacggcagagggagggtcagtgagctttcctgggagccttttgatgccaggttagtttcccttctttctgaatctcagcagtggctgcctgcttccctgacgctgctgagtcccacgggaggggagctgggcaccctgaagcccctcgttaccaattcgggggccgcggagcagagtgtgacgacagccagtgagtcgtcagtcgacggcaatggggaccctggtgacggctgctttgttgttttttttcctctttggaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgagtaagtgtgaaattgagtgcagcattaaagcacaaaaacaatgatttgagacgtcttttctataaaagaagtttatagcactctcattgaatgcttaaatagtgccacactgctaagtcgtgagaagcaaaatgtaactgcggtgcctcaaacaggattattttgttttattcatttggatgcggacagctctttatctaaaattgccattctgaggtggttttgcacaataaattggtaattatgtagactgtttcttccagagacagcatcttgaatcgggtttatgaagccatgctatcaacctaggtagaaaatgctttgtaggacatgggtcctgcttatctaaattttaccagattttattagctgtaaatttataagcgggtcttggtgaatagataatgaaaaaaatattgagtggggaggcttattagactgacagcaccttcaagactcatgcaagttggactggaaaatcccacctgtggaagtaaaacactgatgagtccttaataaatatggatgagacaagtcaaatatttggccaatttaggtgaaacagaaataagtctagaactggacaattatttgtgtaacatactggcccagaccttcactttgagaagctggtgtgtagtttcaggagagtacctggcagactagtgtgtccatacttcgatggagcttgagagttttccttgaacacaaaagttgtatttttgagtttattctagtatgatggtgccctaccctatcttcctattcagttcacccaaagagcctttaaattagtgttcccttggtcccatccctacagtctctggttttgctggtctgggaatgggtctggacatcactgttgttttaaagttgagagcctctcttctgtggtcttgttcctaaaacgctttactactcactgtggtctgagggcccccagcactggtgtgttagtttcctgtggctgccctaaaaaattaccacaaacatggtgtcttaaaacaacacacatttgtacagttacagattccagaagcctgcaatcagctcactggactgcaagggccacccgccctctcagaagcgccgggagagaacaggttttcttgccttcttcagctgctagagctgcgttctttggcttgcacccccttcctctgtcttccaagccagcggggcagtcttttgcttcagtggccatgttgtcttctggcacagtcacatctccccctgcctccctcttagaaggacccttgtggttacatttagggcccccacctggataatccaggataatctccctatttcaattttcttaatctcatctgtaaagacccttttgccatataaagtaacattcacaggttccaggtattaggacttggatatctttagaggccatcatacagcccaccacaaacagctccttaggcactcattagaaatgcagaacctcaggccccaaccgataccttttgaatcttctgattctaatttaagaagatcaccatgtaactcactagcacactaagacttgagaagcacgatgctatgggaacctaaccaaagaattctcaagtcccaacttaaatacaaatttacagagtatttttcctaggaacgctttcaggtggaggagattaatcagacgatagataattttcctgaacaccattctgaagtgcttctctaagcatttgttcctgaattctctctcaatgaagccacaagccccaaacaccaggattactgtttacaggggttcctgtttacagtagtttagcacagggtttgccacactgcagcatattattatagtttagttttgtaaaaagctacatgagagaggtaaatcttataaatggaggtggagtctcctaacaccagttttaccacctctgtacaggtttccctgggctatgtactatcgaatcaggaatcaggaagggcggctttttcaaatgttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacctgaggttgggagttcgagaccagcctgaccaacatggagaaaccccgtctctactaaaaatacaaaattagccagacgcggtggtgcatgcctgtaatcccagctactcaggaggctgagtcaggagaatcgcttgaacccagaaggtggaagctgtggtgagccgagatagtgccattgcactccagcctgggcaacaagatcgaaactccatctcaaaatatgtgtgtgtgtgtgtgtgtgtgtgtgtgtgtgtgtgtatatatatatatatatatatacacacacacacatatatatataattttcacctagtgttttattaaacagaatgcttctgtatttttatgtttatttgagacaatgcttctgtatttctaaacaacagctagccttgttcagttagccaaacaacaaaaccttaattcaagtcttcaatgaaattttctgatttaataggctgaattaagaaagccataattttcttctataaatataagcctttaacttctatctttacaagtttatatagaaaaatttactgtggggcttgagatttactaatgcatgggttttcaaccttagctgcactttggaatcatttaggacgcttggaaatccctacacccaaaccacatcccagatcaattacactagaaatctctaggggtgggacccaggtgtctgtaaatatcccccggtgattgcaatgtgcagccatggttgagaaacactgaagcctgctctgagaaatttagcaatccgacttaattcaaatctgcagagagagcaacaatgatttttgcagaaacaaccaaatcctactagttacataaattttatactttgttaggacttgggtttttatttagctctacatatgcgatcataggatgcagaagatatatcttctactggacacgtatatatagatgcttaaatgtggctatcccaaggttaggtaataataaagactataagagctgggcagaaatcaggcacagtttcatgaagggtaatatctgagctgggccttggaagatgcataggatctcaacaggacagtaggtgtttcaagcaacaatgaactaggaatacagcagaaagcacaggggaaatggtcaggcttgactgagagtaggttatttgaagaagtgcaatagaaaatgcttggggaagaaagttgggatttaattgtaaaaggtcttcaagtatcaggctaagaaatgtggacttcatccagtaggtaatgtgatgtcactggatatctgtgcagtatctatgtgatgggttgggagtggagaagcctggggatacttaagggtctgagctaggagggacaggaggaatggctgtgggagtggaatggttagaagatgggcccaattagaaacatacttcaatttgagacaaaacccactagaaataaacacatcatcatgaaacatctccaaatgtacaat

SEQ ID NO: 182 - DNA, 1470 bp, Homo sapiens
ctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatcaaccatctttcctgtgaaaaattccctctcctagtactttagttctgtggatccaaaatttatagcattcttctaccaccacaggggtgagtatataataaaaaatgtcagttattcaagtatgtaagaaacttgaaagtcatcactcccatccttacaacaagaaaaatgctgtacaaacagactatcaacaactcattttagatccattagaggactgaggtcacagaaaaactgctgcgcccaccctaaatccccattaaattagagagatgggaaaatgcaaagaattatagcctagtggagcaaaagcccaggagcccccacaggagttagtaatggagtagaaaactttaatatgcagttgattaatttctggaagcacattgtggacaagcttgagaattaactttgaaaaatatataacatgataatactaattaaaagaaagctggattaatatattaatttccaacaaaaagacttcagagaaagaacaattatagggggatacaaaggggtattacatagtaacaaaggatttaattttccaagaaaacgtaacaatccttaatgtgtttgcatgtaacaggctgtcaaaacacatgaggtgaaaacagatagaactgcaggaacagacagataaatccactatgataattggaggtgttaacacctctctatcaataatgaatagaaccagcaggtggaaaatcagtaagggcatagttcaactgaatagcaccaaaatcagtgagtcccagtctctcttcccggaagttgattcttgagcagggacgtcaggagtagagtgatgtccaggccatatttaataacaaataaatcagagtctggacatgatatgtaggcattcgtttctttaaaaaaaaattgccccaggtgattccattgtgaatctaatgttgagaagaaatatgtgcagtcgttttctttgaattcattctgcctgagatatctagagttgttctggttgttgacatcgttttgtttagcaattcattcattcaattttgtgaattaactttcaagaaatgcct

SEQ ID NO: 183 - DNA, 3504 bp, Homo sapiens
gatcgtacaactccgtgaatatactaaaaccccagagttgtataccctaggaaatttttttttttttggagacaaggtcttgctctgttccccaggcttgagtgcagtggcacaatcttggttcacaacaacctccccctcctgggttcaagtgattcgtgtgcctctccattagctgggactacaggcgcatgccaccacatcccattaacttcagaattttttttttttttttcagatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgctgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggctcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtca

SEQ ID NO: 184 - DNA, 11580 bp, Homo sapiens
ctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcaccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggg

SEQ ID NO: 185 - DNA, 10304 bp, Homo sapiens
agtcctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggtaaggcagtgcctgttcagggctgccgacctgtctccccagggctgtcattctcagcaagtactttaggagtgccttagatcggcacattctcccattgaaatatttttgttagtggagacaagggaggtaatggcaaggacacggatcatcacagcccctagggatttgttgaatgacctttggcaaatcacttcccttctctgggcctgtagttcttggctgaatatgagggaatggatttcaaattatgctccatgtaatacccgtgtttttacctctgtaaacagatttttttgttttttttgagacggagttgcactccagcctgggcgcatggtggctcatgcctataatcccagcactttgggaggctgaggcagtcagatcacttgaggtcaggagttcaagaacagcctgaccaacatggtgaaaccccatctctactaaaaatagaaaaagttagccaggcgtggtggcaggcgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggccattattttactttttctataggaaataagatatgtgtttatactctgaagactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctcaaaaaatgtattccctttatctaactgaaacttcgtactctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatattgctaatgttttcttttgtttcttgaattgtctgtgttgaatttttaaggcttgtttctgttttgtgttggaagcttttcttaaacgtctagagatccttggccatccattcatatgtaagagtggggcactagaaagccaatagaaagttctgtgtacactggccagtgaggtggctcacacctgtaaccccagcactttggaaggccaaggcaggcagatcacttgaggtcaggagttcaagaccagccttgccaacatggtgaaaccccatctctactaaaaatacaaaaattagccgggctggtggcgcacgcctgtaatccttgctacttgggaggctgaggcttgagaatctcttgaacccgggaggcagaggttgcagtgagctctccagcctaggcaacagaccaaaactctgtctcaaaaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatagaaagagaattattttatgaaactttggtttcttacacatatcatatatacatattatgtactggtttgatcccataaaatgggagttttttttttttattgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgggaggctgaggcaggagaatcatttgaactcgggaggcggagattgccactgcactccagcctgggcgacagagcaagactccgtctcaaaaaaaaaaaaaaaaaaacggagataagttctcctggagtaaaattctctaaacttttgcctgcatgctagtctgatagacagtactcattcattcaggtattggttgaggacttactatgtgccaaacactgttccaggttctgggtatacatcagacaaaactgtctcctgggactagattctagtgagggagataaacagtgggttatatagtatttagatcttgcgctaggtaacacagcaacagaagggaaagctgaacatatgcatatagatgctggtaagagggtggatgtggtggatgaatgaagtagaaaacaaggtcatcatctgagagtgaaaatggggaggaagtgttggaagaaaagagaaggtgtgaaataatttaggacacagcacagcaaactatagcctttggtcaaatcctattttggtgcaatccacaagctaaggatacttttttacttttaaacggttgggaaaaaaatttaagatgatattacatcatagcatgtaacaaataaatgcaattcaaatttcatttatttacatattgcctctggctactttcatgctacagtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccagcactctgggaggccaaggtgggcagatcacttgagtccaggagttcaagaccagcccaggcaacatggtgaaatcccatctctacacaaaatacaaaaattacccaggtttggtggttcatgcctgtagtcccagctactcaagagactgaggtggagaatcacttgagcccaggaggttgaggcagcagcaagccatgatcacaccactgtactccagcctgggcaacagagtgagaccctgtctcaaaaaaacaaacagaatgctgagttttaaatccctatattcagtaggatgtctcccctcagctcccagttgttgttggtggcttcaactagttcatcttccccaggagataatgaatgaacaaatgaatgaatgaatgaatgagtttataaggggcgaggatctcaggacttcatagtctttcaagtaatcatcttgtttttagccctctacctactacctcttgcttttcagataactgatgcctccaattcctaagccttttctggggttctgtggtacaaacatgcttgcttattgctagtaacactccaccagcccctgccccagacttctgctttctctggtctactcagtttgttccttgttttttgctttccggattcaaagattttgttgacattgcctggatgctgccatcttttgtctcatattctttgtccttaatcatttaacattcctttactgtcattttaatggcatttcaggaggaagccatgtttctagtccaccgttcttttttgttgtttttgagacagagtcttactctgtcacccaggctggagtgcagtagcatgacctcagctcactgcaacctctgcctcccgggttcaagcgatcctcccacctcagcctcccgagtagctgggaccacaggcatgcgccactacaactggctaatttttgtatttgtaagtagagatgaggtttctccatgttggccaggcttgtcttgaattcctggcctcaagtgatccacccacctcagccttctaaagtgctgggattacaggcatgagccaccacaccgggccaatccactgttttttaaaaagttgtcaagagttttgttaaggggtcagacatgtctgactggttgacttttcccagaatgctgcttagtccctcaaacacacaaattcctgatgggtccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccttgtgctccaactggtctttatgaaacctgttcacttcaatatacttttaggccaggctcacgcctgtaatcccagcaccttgagaagctgaggccggtgcatcacttgaggtcaggagttcgagaccagcctggccaacatggtgaaaccctatctctactaaaaatacaaatatatatacatatgccaggcatggtggcatgtgcctgtagtcccagctactcaggaggcagaggcacgagaatcacttgaatccaggaggcggaggtcgcagtgagccgagattgtgccactgcactccagcttgggcaacagagcaagactccgtctccaaaatatatcttatctatatatagatatagataggtatatatagatctatatatagatatatactttcaattctccaattgttcccgtataccatagagaaactcttatgagctcagtttctgcaggacttacaaaacagggtaattgcctcctcattatggtcagctccagcaccattcaaattctctgtccttacccatttccagaacaagcaggatgaaaatcacttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccagaaaagaatgtaaaaaaggtactagaaagaaagaataaggcctatagccatcaggctgctagaacctttggacaagtcactatctaaaagcaggtaaagacccagctttttgtccatctggtcaggcacctggtggcgtgagtctttcagaacatactggtcaggcggtggctcacgcctgtaatctcagcactttgggaggctgaggcaggaggatcacttgaggtaaggagttggagaccagcctggccaacatggtgaaaccctgtctctactaaaaatacaaaaattagccaggtgtggtggcgggcatatgtagtcccagctacttgggaggctgaggcaagagaatcgcttgaacccaggagtcggcagttgcagtgagccgagatcacaccactgcactccagtctggatggtaaagtgagaacccatctcaaaaaaaaaaaggaacataccacaacccttcaataaaaaggtctctgagaaaacagttgtcacaatgtccatgtacttgtacttgacaccatgtgagaaacagcctccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcagcctctgagctcctgggctcaagggatccccctgccttagcctctgaagtagctgggactacaggcatgcaccactgtgcccagctaatttttaatttttttgtaaagatagggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaaaaaaaaaaaaaacaccttccacatgacaactctgaagacaataatcacactaccattgtgtttttctggatgtgccacacattgtatacatgtccctgccttacaaatgacatctcctatacacagagtccttaatatttctacatgcaatgtataatcaattaaaacatcagtatcatcttaatgtgaatttctgttaatccaagttctcccccactatgcaagtgcaataaatatttaaaaatgaaggtaacaatatatatatatatttttttgagacagagtctcgctctgttgtccaggctggagtgcagtggcgtgatcgcggctcactgcaagctccacctcccgagttcatgccattctcctgcatcagcctcctgagtagctgggactacaggtgcccaccaccactcccagctaattttttgtatttttagtagagacagggtttcactgtgttagccaggatggtctccatctcctgaccttgtgatacacccctctcggcctcccaaagtgctgggattacaggtgtgagccaccgtgcttggccaacaatatatattcttaactgtgtaaattttaatttgttggttttattcttttgagattattatgaatattgattctgtcattcatcgcttaaggaccaggcaggtgaaccacttgacattttttatcatcagaataaattgacaaaaacaaaacaaaatactttgaggtggaatggaagtatcttgagtagtagtaaaaccatagttctagatggtgataatcattgtcataatgaaagcgtgttgcttgttgactatttaaccatgctgtttaagtcatattaaaaacatcaatacgtccctctccctctcccctctcccctctcccctctcccctctcccctctcccctctcccccttcccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgttttttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatcttggctcgctacaacctccacctcccagccgcctgccttggc

SEQ ID NO: 186 - DNA, 2770 bp, Homo sapiens
ggaagaggggctggctctcagtccctgcctcgtggggggtgcctcccccccctgcgatgggggtcctgagagccggggaggatgaggggctggctctcagtccccgcctcgtggggggtgcctccccccctgcgatgggggccctgagagccaggggggaagaggggctggctctcagtccctgcctcgttgggggtgcctccccccctgcgatgggggtcctaagagcctggggcggaagaggggctggctctcagtccgtgcctggcggggggtgcctccccccctgcgatgggggtcccgagagccagcgggggaaaaggggctgactctcagccaccacaacatggggggcctttatgttcaggttttgcccaagagtcagctgatttgcttcttgtactagcagggcagttgctgccaaggccctcaaacaggggagccatccttcagaaaccctgtctagttgttcagagacgtaggccaccggcctcagccagggccccacagtttgggttaaaagtccagctgccatcttttctgtctataacgcatacaatggaaaaggctttgtcagatcgggtatccccagggctggggctgccagacatttttcctttaactcatgaaagacttgctgttattgggttccccattccaaaggttccggtccacgccccctttgtgacctcatacaaaggcttggctaatactgcaaagtttgggatgaacagtctacaaaaccccacagcccctgagaattccctcacctgccttctgcccttaggctccggtagattgcaaatgacctgctttctttctgttcccgggcggcatcggacccgtcggagagtaaatcccaagtaaggtacctgccgttggcagatttgagctttcttcttggacacctaatacccacagtcctccaggtgagtcctaagtatcttaggatccgcgatgggggtcctaaggcagggggggaagaggggatggctgtcacccaacccaaaatgggcggcctttatgttcaggttttgcccaagagtcagcttatttgcttcttgtactatcagggcagttgatgccacggccctcaaacaggggggccatcctttagaaaccctctctagttgtttagagacgtaggacattggcctcatccagggccccagagtttcggttaaaagtccagctgccatcttttctctatctgacgcgttcaacggaaaaggctttgtcagatcgggtagccccagggctggggctgccagaagtttttcctttaactcatgaaagacttgctgttgttgggatccctattccaaaggttcccggtccctgccccctttgtgacctcatacaaagacttggctaatactgcaaagtttgggatgcacagtctacaaaaccccacagcccctgagaattccctcacctgccttctgcccttaggctccggtagattgcaaatgacctgctttctttctgttcccgggtggcatcgacccgtcggagagtaaatcccaagtaaggtacctgccgttggcagatttgagctttcttcttggacacctaatacccacagtcctccaggtgagtcctaaggatcttaggatacgcgatgggggtcctaaggcagggggggaagaggggatggctgtcacccaacccaaaatgggcggcctttatgttcaggttttgcccaagagtcagcttatttgcttcttgtactatcagggcagttgatgccacggccctcaaacatgaggggccatcctttagaaaccctctctagttgtttagacaactaggccaccggcctcagccagggccccagagtttcggttaaaagtccagctgccatcttttctctatctgacgcattcaatggaaaaggctttgtcagatcgggtagccccagggctggggctgccagaagtttttcctttaactcctgaaagactttttgttcttgggatccccattccaaaggttccgttccccgccccctttgtgacctcatacaaaggcttggctaatactgcaaagtttgggatccagtctacaaaaccccacagctcccaagaattcccttacctgccttctgcccttaggctccggtagattgtaaataacctgctttctttctgttcccgggctgcgttcggacccctgtcggatagtaaatcccaagcaaggtacctgccgtcagcagatttgagctttcttcttggacacctaatacccacagtcctccagtaaatcccaagcaaggtacctgccgtcagcagatttgagctttcttcttggacacctaatacccacagtcctccaagtgggtcctaaggttcttaggatccttgatgggggtcctaagctgtgggggacggggggctggctctcagtccctgcctcccggggggtgcctccccccctgcgatgggggccctgagagccagggggcaagaggggctggctctcagtccctgcctcgttgggggtgtctccccgccttcgattggtgtcctaagagccagggggagaagaggggctggctctcaatccctgcatcgttaggggtgccttcccccctgcgattggtgtcctaagagccagggggggaagaggggctggctctcagtccccgcctcgtagggggtgcctccccccctgagatgggggtcctaagagccgggggcggaagaggggctgcctctgagtccctgcctcgtggggggtgcctccccctcccctcctgcgatggtggtcc

SEQ ID NO: 187 - DNA, 1955 bp, Homo sapiens
atttactttgcatcttgtagtgtctctgccagctttattaatagcagtcgcagtataccaggcagaatcttggctgacagtggaatcgattttaagggcagcttctcccttggttccttcaattctataaaaagttgggggagggaataatcaatatagtggtatagcttccctggttattggatttgtataatgagcttagctttattatttccatacttacctgattttgggatatttatgaggcacaatgatgtcactgtttttcaaccatacaatgtcagggttggggttacccgtagctctgactttcatttcaagtcgggaaccttcctttatattgacatttttcagtttttctacaaacatcggttttacctgatgttccacagctgaaagagaaaggtcatgatttagagggagtaaggctgaaatacctgtttataacccaagtgataagaaaattcatttatttttattttatctcattttaccttccacagttaaaatcactgaaattgaagatctgcctgccctgttttgggcaaccacagtccattccccagaatcactgggtgtggcagggacaataattagtgattgagtaccatcttctttaatgactactttatgggtatagtcattgacaatttgctggcctgtgaaaatatgtttaaaagaaagtagattttaaaatagtttttaaaaattgttagatgcatacataagcttgtttttgtgtttttatgattcatgagcaaaaacttatcacgcttaccatcatgaaaccagaacgtctctggcataggtctaccaacaacctttaagtcaaatctggcagtttgcccttctaaacatttgaaagaaacaggttttaacacaaagactggtttatatagtctctcaagttgtgactcatctgtctcctccagcctacgtccaggggacattcttgcaggggacatccgtgcaggagacatccttgcaggtgacatccgtgcaggagacatgcgtataggagacctgctcactgaacgtggagagagagatctgcaaaacaaagacacacaatactttcgtgaggcataaagaaaactcagcaaaacaaacttcattttgtcttattcattattcatgttattttagaatttacttcttgcacgtattagaaggcacctcaaactcattcagatctaaaatagaatatattattgttgcccccacaactatgtttttcctatattctcaattttagctggtagtcattcagtatatccaggtacccaggctcaaaaatcttggaataatcctcaatactctcttttccttaccacttggatttaatcagtcactagacttttttgatttaactactaaaacatcctaataaatgttggttggataagtaaaccaatgaatacatttatggaaaaataaaaaatacacattctttatctcagaggaggaaaacatagaaatgaatttggaaacaaaacaaagcaaaacaagactccatctacacattgcagccagactgacttggagtttgaatgctggcaccaccgcttacaggctggatgaattaagacaattttcatagattcccagggcctcagtgttcctatttccaaaccaataatagtcatctttttattgcagggctgttgtataaatttacatatgtaaaaatcaggtgtcaaataagagctattgtgatattagctatagcactaggaaaataaacagtatgttacactgatgaaaattctttgctcatcttacacaggggcaagaaataaaaacttctggcaattgttggtgttgccaatggtgcaacataccatgaagattaaggaaacttagcaacagtgaacttggaccttctaatagctgtctaaccccgagctcatcacttgaaaatgaaaatatcaaataaaaaaaggaaagtataattt

SEQ ID NO: 188 - DNA, 1956 bp, Homo sapiens
atttactttgcatcttgtagtgtctctgccagctttattaatagcagtcgcagtataccaggcagaatcttggctgacagtggaatcgattttaagggcagcttctcccttggttccttcaattctataaaaagttgggggagggaataatcaatatagtggtatagcttccctggttattggatttgtataatgagcttagctttattatttccatacttacctgattttgggatatttatgaggcacaatgatgtcactgtttttcaaccatacaatgtcagggttggggttacccgtagctctgactttcatttcaagtcgggaaccttcctttatattgacatttttcagtttttctacaaacatcggttttacctgatgttccacagctgaaagagaaaggtcatgatttagagggagtaaggctgaaatacctgtttataacccaagtgataagaaaattcatttatttttattttatctcattttaccttccacagttaaaatcactgaaattgaagatctgcctgccctgttttgggcaaccacagtccattccccagaatcactgggtgtggcagggacaataattagtgattgagtaccatcttctttaatgactactttatgggtatagtcattgacaatttgctggcctgtgaaaatatgtttaaaagaaagtagattttaaaatagtttttaaaaattgttagatgcatacataagcttgtttttgtgtttttatgattcatgagcaaaaacttatcacgcttaccatcatgaaaccagaacgtctctggcataggtctaccaacaacctttaagtcaaatctggcagtttgcccttctaaacatttgaaagaaacaggttttaacacaaagactggtttatatagtctctcaagttgtgactcatctgtctcctccagcctacgtccaggggacattcttgcaggggacatccgtgcaggagacatccttgcaggtgacatccgtgcaggagacatgcgtataggagacctgctcactgaacgtggagagagagatctgcaaaacaaagacacacaatactttcgtgaggcataaagaaaactcagcaaaacaaacttcattttgtcttattcattattcatgttattttagaatttacttcttgcacgtattagaaggcacctcaaactcattcagatctaaaatagaatatattattgttgcccccacaactatgtttttcctatattctcaattttagctggtagtcattcagtatatccaggtacccaggctcaaaaatcttggaataatcctcaatactctcttttccttaccacttggatttaatcagtcactagacttttttgatttaactactaaaacatcctaataaatgttggttggataagtaaaccaatgaatacatttatggaaaaataaaaaatacacattctttatctcagaggaggaaaacatagaaatgaatttggaaacaaaacaaagcaaaacaagactccatctacacattgcagccagactgacttggagtttgaatgctggcaccaccgcttacaggctggatgaattaagacaattttcatagattcccagggcctcagtgttcctatttccaaaccaataatagtcatctttttattgcagggctgttgtataaatttacatatgtaaaaatcaggtgtcaaataagagctattgtgatattagctatagcactaggaaaataaacagtatgttacactgatgaaaattctttgctcatcttacacaggggcaagaaataaaaacttctggcaattgttggtgttgccaatggtgcaacataccatgaagattaaggaaacttagcaacagtgaacttggaccttctaatagctgtctaaccccgagctcatcacttgaaaatgaaaatatcaaataaaaaaaggaaagtataattta

SEQ ID NO: 189 - DNA, 24910 bp, Homo sapiens
aacccgtgattgctgggactggctcaagctccaccaggagccgtcgttcttttacaaagaggggtggaggttccagtggaggctgttgttgcctttttttttttttttttaatgaatggagggcggcggcgactgctgcagctgggccagctgcgcgggctgcaccccctcccagcctgcgagaggagctagtagaagatttgtaccaacaaaaccaaggagtaaacaacttgagaataactgcatgagctcagggcttggactgtcagattccatttctaagcttccagaagagcgacacatagacactggggaagtcagagcctttgaactccaatgccatccccgtcacccacctccaccaccagcaccaccaccgaatggcactttggacaatttttccctctcatgtgacttttgtcatttcttacgtcagttggagccagcacctctcaaatccatcttctaaaacccagaaaattgtgtgtaacacatgatgactgaaagggagtaggctgaccagttaagagcctgccactggaatggaaggctgtgggaaggtgaggggacggtggacatcaaccgggaagagctgaaagatggcgttaccagataaggaaactgagtctcagggaggtcaagagacatgccaaagcacagcttggaagtggtaaggtgaagaacagagtgctggtgttctgcttcctggtttgtctctctccctctggtttatgtcatccagcccatttctccctgtacctggagatgctccctaagcaaacttttctgtgcagatgcagattgaatacagatgttacaatagggttagtcccacatagctgaactctttctaaagaaagacagaatcgtttgcagagaaaaccagagcttgtttcctaaaaacttccctggtagagggtgggtttttgtctttttggcccaagacagagatggtggatgaagcttctccttcaaatcttcaagatttaaagaaattgctccgcctctttgcctggaggaatgccgtgctgctcaaaacacacttttggacacggcacatttttctgtcacagtggaaagacctgactccctcaaaagggtgtttgcaaaaagcatcgcgttctcagaatgacaaaacagttttaaaagaaaaaaacattgtgtcagccctgcagcttatcaatataaaatgaagactaagattcatttatgtgaatggatcattttttgggggagggagttgttaaaaattcatatatcttggctaatggaaccacttccatatccacaatgaaaaaaattaaaaaggaggcttataaaacctttcctggaacaaccagaaaaggagtgagtccctgaaaatacaaattggtggtgttatctttgcatatttgcaaaattctttgaacttctgaatagtctgttgtggacctagtctgctgttactttgacacagggtcttgctctgttgcccaggatgcagtgcagtggcgtgatcctagctcactatagtctcaaattcctgaggtcaagcactgcttccacctctgcctcccaggtaggtagaattacaagcatgtcaccacacctggctaattttttttttttttctttttgagtaagtgtctcacactgttgcctaggctggagtgcagtggtgtgatcttggctcactgcaacctctgcctcctgggttcaaatgattctcgtgcctcagtctcccagtagctgggactacaggcgtgcaccaccatgcctggctaattttggtatttttagtagagatggggtttcgcatgttggcacaggctggtctcgaactcctgtgcctggccctagttatttttatattaacagtaatgaccaagctctgagaggttccttaatattagtagcaaaggtaggattcaaatgcaggtctggatgacccataacacatatcgttttgcactactcggtttgccttaaattagccccttctttggaataaagcaccctgttaagaagacaagttgaaggccgggcgtggtggttcatgcctataatcccagcactttgggaggccgaggcaggcagatcacgaggtcaggagttcaagaccagcctggccaacatagtgaaaccccgtctctactaaaaatacaaaaattagccaggcatggtggcgcatgcctgtagtcccagctacttgggaggctgaggcagtacaatagcttgaacctgggagacgcaggttctggtgagccgagatggcgccactgcactccagcctaggcaacaagatcaaaacgccatttcaaaaaaaaaagaaaaaaaaaggcaccttgaatgtcacatttgtcctcttcaaggtacttgctatctaaggtgggggtggagaatcctttattttacagaaacagtgattagttcttaagccttacttcatagataaggaaactgtgaatcaaagaggtcaagtggggcaggcgcggtggctcacgcctgtaatcccagcactttgggaggccgaggcaggaggatcacgaggtcaggagattgagaccgtcctggctaacacggtgaaacctcgtctctactaaaaaatacaaaaaattagctgggtgtggtggtgggcacctgtagtcctaagtagcttacttgggaggctgaggcaggagtatggtgtgaacccgggaggcggagcttgcagtgagccgagattgtgccactgcactccagcctgggtgacggagcgaagactctgtctcaaaaaaaaaaaaaaaaaaagaggtcaagtgatgtgttcaaggtcacagctatgaagtgacaagaccttttttttttttgagatagggtcttgctctgtcacccaggctggagtgcagtagcgtgatccccgttcgctgtagccagcgtcaagctcccaggcttaagcaatcctcccatcttagcctccccagtagttgagactacaggcacttatcactgtgcaccactaattaaaattttttttttttatttagagatggggtctatcaatgttacccaggctggtctcaaattcttggctttgtgatcctcccacatcagcctcccaaagtgctgggattacaggcatgaaccaccacgcccggccttcacatattttacttacttcccacttccctccttacctcccttccctcttaatttctggctggtcagtgagcccagtagggctatcctgctgcaatcacatctgcagtgacagcgtttccctgcttcacactctgggctccctggtgactgtcctgctatgtacgaagttcattggaggtgcacacattaagggtgaaaaaatgctgggacctcctaacatacaggggaggtgggctagtgaggccactctgtatttgggctttagagtcacccagcctgggtgttaatcctggcctgtgccacattggcagtgtgaccaaaggtatgttatttaatatatctgtgcctctgattctgtatttgcaaaatggggatgagaccagtacttacctcgtagagatgcaggaagttttagaagcattagttcatgacagccctggcactgataagtgttagggactattatccaaaacaaacacaaaacattaggtcctaccttgttagttttagagttaattgatttaattaactgacaataaaaacaactaataataacaatagctaacatgtgcctggcatagtgccaagtacctttaattattaacttgtttaaaaatctgaaggtacaagagggatatgtctccctcctaccctgtattatttagggttctacagagaaacagaaccaataagatatagagagaggctgggtttggtggctcacacctgtaatcccagcactttgggaggctgagacgggcagatcacctgaggtcaagagttcgagatgatcctggccaacatggtgaaatcccatctctacaaaaattagccgggcatggtggtgcacatctgtagtcccagctactcgggaggctgaggcaggagaatggcttgaacccaggaggcagaggttgtagtgagccgagatcacaccactgtggtttagcctgggtgacagagtgagactttgtctcaaaaaaaaaaatatgcatagaaagaaatttattatgagggattggttcatgacatggaagcggagaagtcccacattctgccatctgtaagccggagaatcaggaaagccggtggtggagttcctttccaagaccaaaggctggaggaacacagagcaatggtgtaagtcccagtctaagtctgaagaccccaaaaccaggagtgcagatgtctaagggcaggagaagatggatgtcacagctccagaagagagaattaactcgtcctctgcgtttttattccatgcaggtcctcaacagattggaggatgccagtccaccctagtgagggtgatctttactcagtctactgattcaaatgctgatgttggccccagtacagtggctcacacctgtaatcccagcaatttgggaggctgaggcgggcgaatcgcttgagcccaggaggttgagaccagcctgggcaacatggcgaaacctcatttttacaaaaaatacaaaaattagccaggcgtgctggcgcatgcctgtattcccagctactcaggaggctgaggtgggaggatcagttgaggccgggaagtaaaggctgcgatgagctgtgattgcaccactgcattccggcctgggtgacagagtgagaccctgtctcaaaaaaaaaaaaaaaaaaaaaaagctaatgttttctagaaacacagacacacccagaaagtattttgccagctatctgggcatcccttatcccagtcaaattgacacataaaattaaccatcacgcccccatggtttcctccatggaagcagccattattaccaatactctgcgtatcttttcagatatcttctgtgcagacgattatttaaatatctttctaccccttcagctttaaatgtaaggaaacgggctcagagaagtcatatagtgaattgtaataatagctcctattctgtgtgtgaggctctgccctgggcactgtgtgattttgaatcctggctacaaccatgcagcatgagacttattgtgtagaatagatgctccaggcctcagtttgcctcagtgggttgactgaggattaaatgaaataatccatgtagaggggcttctcagatcctggcacatcataactgctgagtaggtgatgactgcaggggaggggaggatccgaggtttttttttttttttttttttttgagacggagtctcgctgtgttgcccaggctgatgcacttagatcctcggccgggtgcggtggctcaagcctgtaatcccagcactttgggaggccgaggcgggcttatcatgaggtcaggagatcgagaccatcctggctaacacagtgaaaccccatttctactaaaaatataaaaaattagccgggcttggtggcgggagcctgtagtcccagctactcgagaggctgaggcaggagaatggcgtgaaccctggaggcagaggttgcagtgagccgagatgacgccactgcactgggcgacagagcgagactccgtctcaaaaaaaaaaaaaatactaggaatgtaagtgaatatttatttcaagtgagaaacagagctctaacaatttacacattttatcttttttttttctttttaaaagttttttttttttttggctgggaccggtggctcatgcttgtaattctagcactttgggaggccgaggcaggcagatcaactgaggtcaggagttcaagatgagcctggccaacatggtgagaccctgcctctactaaaaatgcaaaacttagccaggtgtggttgtgtacacctgtaattccagctacttgagaggctgaggcaggagaatcatttgaacctgggaggcggagtttgccatgagcagagattacaccattgcactctggcctgggcgacaagagactgtctcaaaaaacaaaatttttttttttttcttttgtagaaatggaaccttgctatattgcctgggttggtctcaaactactgggctcaagcattcctcccacctcagcttcccaaagtgtccgggccagtttacacattttaaaagccaacaaatacctcaaacactacacactccagaagaataataggacattttttcttaatttactgcctgacacacttctgtagcactttttattcctatattatccagcttcatactctttgatcacttcttcatatgataatgattttctaaaataattttctgtagagcgaataaaagataattcagtcttttctctagcatgggtgatcaaaatttgcttttagttattgatagtctagacgcaaaaaataaagacattcatagacacaaacactgtctgtagtattactacgtgtttgtgtctctcagaggaattttagtaaattcagttttgtgttattcccaccaaaaatgaaaaaagaatctaaggtgggccaggcgtggtggctcacgcttgtaatcccagcactttgggaggctgaggcaggtggatcatgaggtcaggagatcgagaccatcctggctaacacggtgaaaccccgtctctactaaaaatacaaaaaattagccgggcgtggtggtaggcacctatagtcccagctactcaggaggctgaggcaggagaatggcgtgaacccgggaggcggaggttgcagtgagccgagatcgtgccactgcactccagcctgggcgacggtgcgagagtctgtctcaaaaaaaaaaaaaaaagaatatgaggtgcattacaattaaatgcacgtgttaatagagtgtatttcttttttattgttattatttattgaggcagagtcaggctggtcttgcactcctgaccccaagtattccatccacctcggcttcccaaagtgctgggatgacaggtgtgagccaccaagcctggcctagtggagtatatttctgacagacgagaacttccattttgattgactcttcacctatttttcatgtctaataacgggaagcatttttcacaggcgagcatctaactatatacattttaaaccttccttcttccccaccacatccttcaggattgggccctgtaggatgtgttcatatggtgatacaacttctgatgaggtgtcaggaccttggtggggggtacttgctactggagttttactgggagctgttcctaccctgggagggttagcaatactcagcttaatgatctgctaaactcaatgtaccagcgactcaactcccatgtgcgtgcatccctgaatgcccgtggccactcttaacgtcacacaacaggaagggagaaggggcagaagggagactggagtggagagagatggaggtctttccacttgtggttaaaagacttgatgctggcaaatgttagagaaaccaaagaccatccgatggatgcttttctttccgggccctttgcaagaccttggaaggggctgatccaagcagggatcctgaagcttcagctgtgttagcctcacggtggacctggttagttatcacttatattcatggttcagggcagtgtcatttgagagcgagccgtggagcccactcaggagctgcaggcctcgctggcatgttaacatgctccataaaccttggttcctcagcaggaagcatgacactattaatagtctccacctcactgggaatataaagtccacgagggcaggcactggtctgcttattgctgtgtccttggtgtatagaacccatgggccgcactgaacatatggtatgctaggtgttgggtggctacccccaaactctcagagaaaaggaaactgaggcacaatgagcttacataccttcacttgaagccagacgtgtccagctccaaattccttttcctgtacaacatgctgcccctagtcaactggatggagatccggggtctcggcctcctttccttcctgcatattctcccatgcaaactgaacaagcaggggaaacttagcccacctctgagttcctgagatcatcatctgagttattctctcccttatggatctgagaaggagtccctgggatttgttctgatccatggaatacattgttctagagactctttggactccaacctgagtccctgggaatgatgtgaggtaggagatgtggaagaacaaaaatgaatggttttgagccataaaatagtgagcctgaaaaacgagtttggaagatgaatggctttggggcttctggaacttagcaggggctatcctgggaattactgacatttctgcctcagacctctgggaggccactggtaaaccagaggccacccccctcccttcacaggtccattggattcgaaggggtcctcacacgaagcaggaagtcaccctgtatctcagaactgtggagatctcagtccgtggtcatcttgtcatacatgacatggcaggagccatggtccagggaaccaggtggctgccaacttgcagaacaggcgacaaaaccccagcctggacccccagaccatgcacttctccctttgccctgcttctcctctgcctggtacaggtttccagccaagctctgcaccggcttctatgtctgtttgttttccttagaagcttcctatagaaagcaccaggtaaggctgaagatgctcacttccccctgttgtttaacaacgcaactgggattttgcagcctctgcttccagcctaattctccattgagccctgggataatatttacacacaaatgctggctctaatctccacccaggaaaacactagctgctattgaaaatcttttcacccgtgatagaaagcagagcggccaggcctcacgcaggcaccctcgagcttctctggagagtgttagggaacagcaagtgtgttttatttatatttttttaaagtcatcccagggctgtgtccaggcaactgagggcctgtcaaagaaccgaatgtctaattccctttagaaaaaacaaagggattaggtgtccctgggactttaacaaatgcattgttggtggttttgatttaggtttcatttagggaaggcaagtgcagaaacgaggatgccaaagatccaggctaccagtgttgcgaagatgcctggagacaggcatgcataaaatgttggcggggatgtaaattagtgcagccttttggagggaaatttggcaacatctttcataaaaaatgagcgtgacctttgatgcagtaatttcatgctttgtaaactacactacgttaatagttgcacgtgtatacaaaaacctatgttaaaaaatgctcactgcagtgacaaataggaaatcaccatgaatctatcagtaggggcctggtttgataaattatattttatccacagagtggactactacatggccagtaaagaaaagaacaaggtggggccgtgtgcggtggctcaagcctgtaatcccagccctttgggaggccgagacggcggatcacgagatcaggagatggagaccatcttggctaacatggtgaaaccccatctctactgaaaatacaaattagccgggtgtggtggcgggcgcctgtagtcccagctactcgggaggctgaggcaggagaagcgtgaacccaggaggcggaggttgcagtgagccaagatgacaccactgcactccagcctgggtgacagagcgagactccgtctcaaaaaaaaaaaaaaaaagaacaaggtagattataacaatggccaacatacatatagcacttactgtgtacacactagtctgaaagttctatgtattttagaatatctgcacatttataatattaactcatttgattttctcaacaattatctggttactattactagaatttttttaaatcaggaaagagatgttaagtaacttgtctaaagtcacatagctggcgagtcggggagctgggcttcaagtcatctggcctcagggtctgggtcaataaccactacccaaatgcctgtatgtacaggcatggaaagatgcttttgacatatgattaagtggaaaattcaagtagcagagaagtaggagcttatctttttcaggtaaaaagaagctgcatgtgtgcatgcctacgtgaatatattttatatatttgtaatagtaaaggttctggaaaaatacgtgttcaatcagcaattctcaaccaggaagggaggtgagatgggctacataaagaggattttggctgggggcagtggctcatgcctgtaatcccaatactttggtaggccgaggcaggcttgagcccaggagttccagaccagcctgggcaacatattaagaccccatctataaaagaaaaaaatttttggctgggcgcagtgcctcacacctgtaatcccagcactttgggaggccgaggcgggcagatcatgaggtcaggagatcgagaccatcctggctaacacggtgaaaccctgtctctactaaaaatacaaaaaattagccaggcttggtggtgggcacttgtagtcccagctactcgggaggctgaggcaggacaatggcgtgaacccgggaggcggagcttgcagtgagctgagcttgtgccactgcactccagtctgggtgacagagcgagactccatctcaaaaaaaaaaataataataataaataataaataaaataagtgcagtggcacaatcttggctcgctgcaacctccatctctggggctcaagcaatcctctcatcccagtctcctgaataactgggactgcaggtgcaagccaccacccctagctagttttcatatttttggtagagacgggcttttgccatgttgctcaggctggcctcgaactcctgggctcaaagtgatctacctgcctcagcctaccaaaatgctgggattacaggtgtgggctactgcttcccgccaaatttctttttttttttttttgagatggagtctcgctgtgtcaccaggctgcagtggtgtgatcttgactcaccaaaacgtccgcctccgaggtttaagcgattctcctgcctcagcctctcaagtagctgggattacaggcatgcgccaccacaccctgctaattttgtatttttagtagggacggggtttcaccatgttggtcaggctggtctcgaacttctgacctcatgtgatctgcccgccttggcctcccaaagtgctgggattacaggggtgagcaatcatgcccaaccatttggttttcttttctaaatggtcctttcaaaagaagacttcctgttaatcgtgggctcagagtgacacttttgattaacaccaaagtaagagatgtggagccaagcctaataagtcttgcaataaattggatgaaggtagaccaattaattgttgttctgattggctgaagggatcctgagataatgactcttgtcctcattaccctctagtcttgccttctcctggaagctttggcccagatgttggaagagtaatgttgattttcttgacatacagcccctccacattccatcttcactcccatgcccccctgcatttaatgtgttcatttaatgcattattgcacctcatgtaaatacccctggtactttacttgggctgttgtttaaaccactgtcccttcagggtcatccagtaaaaaccggactcaggctgccttccatttgcaggcactttacaatctcctaatcttgttcccattcattattttggttaacggggtggagccttgtcactttaatgcaggttgtgcaatatctctttcaaagtaaaactaagcagggtcttaggagagggtctgatgaggacaatgagggttatcaaaattttaatccccatttttaaaccccagtgtttaaaccttgctttgtgaagtgtaacctatcacagtgaatatagaaaaatgacataacagcttctacttactgtgtcaggtcaaaaagcacccaaagtttccatgtgttttctcagttttgttcttgcagcaagtttagggggtactttttttttaaatctcccattatctccataaggaagccgaggctccaggagactaggtaatgtcctcaacaatacacgtgtggaaagtggaaaatggatttctcaaccaggtttgtgtatctgtctgcaattcccagtgctgagcctctcaatggatgaaataattgagaaaagaaaaaaagtgtaactcaaaaaccacccccctaatagatagtagtactcatataccatctccctaacatactgttagcaatttaggtttatttcctttgtgttatgtatctaaacaaaatgaaatttaaaaaaacaacttggtaactagaggatatgtaaaatgtttatatcctgttttgatttttttttgtcctactaacattgtcatcgtaaccatcttccttattgcttcgtgtcatcattttaaatggttgcactctatttagagagtggtggccttgggggagagattcctagatgtggaaattggtaggtccaagagtataaatgtttttatggtttttgatacacattgctaaattgctttctaaaagatctattttaatttgcacttcaatcaacaattttgagagtgtcattttcatcacattcttgctggcattagttattgttagaaaacgaaaccaaggccgggtgtggtggctcacgcccgtaatcccagcactttgggaggccaaggtaggtggatcacgaggtctcaagatcgagaccatcctggccaacatggtgaaaccccgtctgtactaaaaatacaaagaaaattagccaggcgtggtggtgtgcctgtagtcccagctcctcgggaggctgaggcaggaggatgggttaaacccgggaggcataaattgcagtgagctgagatggcgccaccacactccagcctgggcgacagagcaagactccgtcttaaaaaaaaaagaaaaagaaaacaaggccaggcatggtggctctggcctgtaatctcagctctttgggaagccaaggtgggtagatcacttgagctcagcagttcgagaccagcctgggcaacatggtaaaaccctgtctctacaaaaaaatacaaaaattagccagacatggtggcacgtgcttataggcccaattactctggagggctgaggtgagaggatcatttgagcctgggaggtggagactgcagtgagccacgatcacaccactgcactccagcctgggcaacagagcaagaccatgtctcaaaaagaaaatgaaaacaagaaaaagtcctaatatctaccaaattgttcacagtagttagtgtcgagagtgggctggggctggtgaagtgaggaggtgtctattttcttttcttttctttttttttttttttttttttgagacagagtcttactctgtcacccgggctggagtgcagtggcatgatctccgctcactgcaccctccacctccaaggttcaagtgattctcctgcctcagcctcccgagtatgtgggattacaggtgcgtgctaccacgcccagctaatttttgtatttttttagtagagacagggtttcaccatgttggccaggatggtctggatctcctgacctcgtgatatgcccgccttggcctcccaaagtgctgggattataggtgtgagccaccgtgcccagccaggtgtctattttctcctgtatctaatgtggtattattaaaaatattttattataggcacatattacttttgtgttttttatatatatacgtatatatatacactttttttttttttttgagacggagtctcgctctgtcgcccaggctggagtgcagtggcgccatctcggctcactgcaagctccgcctcctgggttcacgccattctcctgcctcagcctcctgagtagctgggactacaggcgcctgccaccacgcccggctaattttttgtatttttagtagagatggggtttcaccatgttagccaggatggtctcgatctcctgacctcgtgatccacccgtctcggcctcccaaagtgctgggattacaggcatgagacaccgtgcccggcctgtcatatatattttaaactttattttgaaataatttgtctcatagaaaagttgcaaaaataatgcaaagaattccctgtataccctttgtaacacatatttttttgttttgttttgtttgtttgttgagatggagtcttgctctgtcaccaggctggagtacagcggcgccatctcggctcactgcaacctctgcctcctgggttcaagtgatcctcctgcctcaccctcccaagtagctgggactacatgcccgcgccaccatgcctagctaattttttgtatttttagtagagacggggtttcaccatgttggccaggatggtcttgatctcttgacctcgtgatctgtccacttcagcctcccaaagtgctgggattacaggagtgagccaccgcacccaggctgtgatacatatgtttttttgagatggagtctcgctctgtcgcccaggctggagtgcagtggcgcaatctctgctcactgcaagctccacctcccgggttcacgccattctcgtccctcagcctctggagtagctgggactacaagtgcccaccaccacgcccagctaattttttgtatttttagtagagacagggtttcaccgtgttagccaggatggtctcgatttcctgacctcgtgatccacccgcctcgcctcccaaagtgctgggattacaggcgtgagccaccatgcccagccacttatttttaaatataaagtaattaaaataaatgttttctaaatgtcagtccttacatcaacttgtaagttgagatttcttcataggtaggctagggctcaacagcaacttggggaaatgcttattaaaaatgtaaactcttaggcctgagcaagacatcgaatcagaatgtttgggggtgagcttggaaaatctttcagtagcccttctcctgccctctgaggcccatcaggggctgagaaccagtgtcagacaggttcctctttatttcctccagcaatattgtggcttcttcaccttgagagccctccagtgtgcaagggtttggaaaagtgagtgaaatctgagcatctttgttgtgacttttcccacttggtgctgctactgctctgctccagccaagctgtctgtaatttgttttcacaagagcctgctctctccctcaaactagaaaagacccctccacaggaggccaggtccggaacgcaggtttaggtggtgtaggcccttctcaccctcaccccttctgtcctgagtgttccaggtggatgccaaggaggtggaggaggcttccctgtctcctggctctcctggaggagcaactgtgaggccccgagatggggagggagcccagattctggcttttggtcttcctgctgtttcttttgtctgatgctggtgcatttccatggacagtttatttcccttggacactgtgggcttggtttttccatgagtgtgtgacgctgtggtcattcaccaggccctgttggtggtctcggtgggggccacaaggctcagatctcacctgccccttttcctacctcctccactctttgctcagccatcaacattcctttctgtcccagaagtgttctttccaaaatgcagatctgcccatgtcccctaatgacgtcacttattgacttcgctatggaaaaggagcgatggggaatgtggccggaaggacagcagagagccagactgtggagacctttgaattccagaggaacaaaagtattttgggtggctcacacctgtaatcccagcactttgggagaccaaggcgggcagatcacctgaggtcaggagcttgagaccagcctgaccaacatggtagaaccccatctctattaaaaatacaaaattagccaggcagggtggggggtgcctataatcccagctgcttggaggctgaggcaggagaatcgcttgaacccgggaggcagaggttgcagtgagccaagattgcaccagtgcactccagcctgggcaacagagtgagacttggtctcaaaaaaaaaaaaaaaaaaaaaaagaccgggcgcagtggtggctcacgcctgtaatcccagcactttgggaggccgaggcaggcggatcacgaggtcaggagatcaagaccatcctggctaacacggtgaaaccccggctctactaaaaatacaaaaaattagctgggcgtggtggcgggtgcctgtagtcccagctacttgggaggctgaggcaggagaatggtgtgaacccggaaggcagaggttgcagtgagtccacatcatgccacagcactccagcctgggcgacagagcaagactccgtctcaaaaaaaaaaagtgtcttatataaaaatatatacataaaatataaaaataggcggggcacagtgtctcacacctgtaatcctagcactttgggaggccaaggcgggcagattgcctgagctcaggagtttgagaccagcctgggcaacacaatgaaaccccatctctactaaaatacgaaaaatcatccgggcatggcggcgggcgcctgtagtcccagctactcaggaggctgaggcaggagaatcgcttgaacctgggaggcagaagttgcagtgagccgagatcgcgctactgcactccagcttgggtgacagggcgagactccgtctccaaaaaaaaaaatatgtatacacacacacacacacacacacacaatatacaaaaaatatactgttttatgtataaacatacataaaatatacatatacatgaaaacatacatatcaatatacataagtatattatggactaatacaggcaatttggaaaaaaagaaagtagaaagtagggggaaaaaagttgctagtcgttctgctagccaagtaaagctgctggctgcatttgggtgtggtcgtgtgcaggataagggcacaggccctgaatcaggtgagtctgggttcagatgccttccttcttccttattagctgtaggcaaccatcgggcagcttaattatcctctgggtgcttcagttttctcattggtgaagtaaggataaaaaaaagttcctaatgtgtaggcttgccttgaagatgaaatgaggtaagtatggaaagcagttagctggctgcttcctaagtgttagttctgtttaatcttgttcatttcctttcagtccttttactctaaagaggggtgtgtgtgtttggtttgttttcacatagttgtgatcacattgtctatataattttatttactgcttgcttagcataacatctgtagccaagcattttccatgttattttcaactcctcataaacatgcatcttaatagttgcataataatccgatggatggatatatcatagtttaaccatttccttattgttggccataggaattgttccaggttttcattgttacagaaaactcaaggcatgactgggcatggtggctcacgcctgtagtcccagcgctttgggaggccaaggcgggtagatcacttgagtagatcaggagtttgagaccagcctggtaaacatggcaaaaccctgccccgtctctactaaaaatacaaaaattagccaggcctggttgcaggtgcctgtaatcccagctacacaggaggctgagacaggagaatcgcttggacctgggaagcggaggttgcagtgaaccaagatcaagccactgcactccagcctgggcgacagagtgaaactccatctcaaaaaaagaaaactataggcatgaacacctttatgtgtcagatatcaccagcaaaaccagccccacttttcccagcctgttagaacaagttccttgagaaaaattcttagaaaggatgttacaaagtcaaattatatgaatatttatcaagatttgtgacttatcctgccaaattcattcctgtaaagtgagttcccacttctatttccaagacagtggatgagactgtggctgagggatgtggattttgttctgcagtgctgctggtgagggcatgagaccagggttttgatggattcatccagcagccattgggtgggtggctgggcagagtcggcgttaggaggctctcagcggtgacttaactatctgcaaacctggccccatccccatgatgactagagctcccatccgtaggagagggaggccctgtggtcacagtgtcacattccttttcagtccagcataagcactttcacattgttttttccctccgtgattcaaatgacaagaactcttcatctttagggatcacagtataagacagtgaataagttcatgagccttggtgttatcctgcctggattgggatctcaactctactatttattagctgtgtgattctggacctcagtttctcaatctgagacatggtactcacctcctaggattaaattaaacaggtattttatacacaacataataagtgctgaatgcttcttagatcttcttatctatctccctctttctaaatgaaagcgcctggttgaaagaaactaattgaacctctgtattcaccactttcctcctcttgaaaatgcaacaagggaagctgtataaagaaacaatactgggccaggcgcggtggctcacgcctgtaatcccagcattttgggaggccaaggcgggtggatcacctgaggtcaggagttcaagaccagcctgaccaacatggcaaaacctcatctctactaaaaatacaaaattagccaggggtggtggcacatgcctgtaatcccagctactggggaagctgaagcaggagaattgcttgaacccaggaggcagaagttgcagtgagccgagatcgcgtcatcgcattccagcctgggcaacaaagagcgaaactccatctcaaaaaaaaaaaaaaaaggaaaaagaaacaataccagaaagcccatctctacattgctaggcaacctttccaaggtgtgtacccaccctgaaaccatggggatgaagggaaggaggttgggaggctacagtggtgcatgaccaatcatctcgggacatggtactgtcagtgctaagactgggacagtccctggcaaaccaggagtgttagtcaccctggcatggtgagagtgggtgaaggatctggtaaagttgtccaagggtgggagaacaagactctggagcatttgagaagggtttgcttttcctttaattattgtttggcaaatccccttgaagctcatttcacctgcaacttctgggaatgaattggctgccaaaaataagacccacgtggggtgggggcaggggggtaattaagtgcctcccaggaagcaggggcaaggatacttcaatatcttccagattcctagagtgtgaatgatgtgagcttgccttggggtgaaggctgctggagtcagctctttccgatcctggctagttttctgctcctaataaaggcttctttcatggctgggcaagaggaagactcagatggccctccgtggacaagggttggttcccgaatctgtcccaggtaacttcttgttcctctgggtctctgtgtgtaatatccccagagacagaggccaagagaggggaaagtgactacacttacactgcaggccagcggagggggtggtcaatagctggtacttcctcttccagctcttttaaagcattttaaaattggattagtgtttcaacaaacacttgaaggtttgctttcctcggagaggcccgaagggctgaggaagagccttcatctgtttactttttctttatgtggaaatctacttgggctgtttctacaactagcttgcccctctcccttggtgccccctccaccaggtaaacctcaccccctaacttccaggcaggtctgcattcaccctcagggccctggcccaccatggctttctgggttggctgaatcctcgtgccctccaggagcactttggagcagcagggctcaggcagctctctctgacctgtgccagccttgaaagttttcctggaatgaagaagtgagctgacagtggacagtcctgtgtacttcatctgcttcttgcagggaaaccaacagaagcggtctctttcctcctgtgggtagagaaagccaggaagatggggcaaagccttgggaaaacaggtggctctcagccccaccagagctctttgtcctcatcctttttatttaagcccctgcttggagccaggcagtgtgtgtgtgtgagagagttgtgcaaacagatatgtgcatggatgtatgtacagaggaaaaaaagactggggcagggcattgtggagctctgaaagggaaggagggcaggcggtcaaagtagacttctatgttttattctgtgtattagtatattatatatgaacacatttaaagtacatattgaataataagagaattatcctctgagatccatgtgatcactgttaactgaagtacagggtcaagccttggaagattcaggaatgacttcccagaggaggtggcgggcaaacagagatcacaggataagtggaggtagctggattcattttatagacatttgttgagtgtctgttgtgtgtcagatactatttttttttttattttttttgagatggagtctcgctctgtctcccaggctggagtgcagtggcatgatcttggctcactgcaactgccgcctcccgggttcaactgaggcaggagtgcctcagcctcccgagtagctggaactacaggtgtgtaccaccacgcccagctaatttttgtatttttagtagagacggggtttcactgtactggtcagactggtcttgaactgaccttgtgatctgcctgcctcggcctcccaaagtgctgggattacaggcgtgagccactatgcccagccccagatactattttagaagcaaaggatctagcagagaataaacacataaagatcttgccattgtggaacttacagtccagtggagggagaaagatgaacaaaaagatcatatgatgtcaggtggtattaaagaagaattaacacttatggtaaggaagactttattcaagactattgcaacaggagttgactttttttcttttttttttctttgagatggagtctctgtcacccaggctggagtgcagtggtgcgatctcggctcactgcaccctctgcctcccaggttcaaccgattctcctgcctcagcctcctgagttgctgggattacaggcacataccaccacacctggctaatttttgtatttttagtagagatagggtttcaccatggtggtcaggctggtcttgaactcctgactgacctcaggtcatccaccctcctcatcctcccaaagtgctgagattacaggcatgagccattgcacccggcctaggagttaacttttgcaatagaggaaggaggttgagttcatcactgaatccagcaaagacctagttgggcatttataatcagagtgagggggtcattgggtggaaaatcactaagagaagacacgaagggtaggggaactcttgctaaaccaactcaacaggattctgtggaaggcaggccaaggacttacacattaaaagtgggggatgaggaacttggtcagatattgagggtgggggaatgactcagctgaattatttgctaaaggcaggccacatgaagaagaggatctagaggagcctgtctaaagtttggtcaaggagagagtctttgttggtgctgtgaagcaaatgaagcagctgtgggatagtgaggctacagagtgacaggttaggccctttttttgtttttgagatgggtgtcttcttctgttgcctgagctgtggtgcaatggcttgatcatagctcactgcagcctcgaactcctgggcccaagcaatcctcctgcttcagcctccttactagcagggacaacaggcacctgtcattgtgtttggctcataggggtgctttttaaatttaatttagttttatttttgaggtgaagtgttcactgtgtagcgacacgatctcggcccactgcaatctccgtctcccaggttcaatcaattctcctgcctcagcattctgagtagctgggattacagccgtcctccaccacgcctcactaatttttgtatttttaatagagacagggtttcactatgttggccaggctggtcttgaactcctgacctcaagtgatccacccgccttggcctcccaaagtgttgggattacaggcgtgagccaccgcacccggcctgcagtgctttttaatactcagtgttagcaaggtctttagggctgaaatctggatcatgtgtcagagccagactttcaaatggcccccctagagggtgtgttctgggtaaaggaaacagcctgtacaaaggccctgaggggtgtgttcagtgtgtttgagcaacagtgaggaggagggggtttgtaggggaagagtgataggaaataaggttgaagagggtggggtgagagtagatcatgcaggccttataggatgtgataaaaaaggatgagaaagaaagctgggaggaaggataatttggatttagggtaagggacagcgttgctcatctacaggaccacaaggggttctgtgctgcaggggcataagaaggagcatgtgccatgtggggaatgcagggaagcagggcagagggacgtaggagaggaagattaagagccaagggggaggggcaggcaggcaggtccttttccatcttttcagtcagggtttctcaatcattttaatgagagcctcagcccttgcgtaaaaatcaagcaataaagggaggaatgcctctctgtttaacttgaaggagagctacagaagatggaaaagagggttagttgaaataaagttggagctgatctcgcttggctggctgccctttctataaatatcgccctcccagtcctggaaatgcagcagttagggtccttgtgagctactgaggaacatccttcctgttcaaatgcccaggacttggctgcctgtgcacttccatatgcaaagtgcctagaagctggggagagggagagtgcagggtcaaaagtggggaattctgagcccactccttttaccccctgggggtggcctcacttcctctgggggctctgacagctctctggcctgtcttcagcttagaaatctgcaaaagtcattggccaggctcaggagaactaatcctttgtgccagaggtatggtggtatggtggggagctagctcctcgctggtgctgagccctgctgcccctggggttttactgggagagagggagagggtggaggggctagtgtaattcggcaatttgtgagttaaaaagcagatgagaacccacagagtaacgagacattcttctctttgcatgcaagattctgctgaatgttggaagaggaaggaatatttttcttgcttttcagacatgacatcctgtgaggggaagatttggaacagatgggggccaggggagcctcactgtatttgcttgtttcaccaccacctcctccctcccacaaccagaaatgtctttttcttcccgcctagggaagttaatgtaaaggcaggtaggggggatgtcctgtagattaggaaagtaagttatcaggggtcagggaaaaataatccattaggtttccagaaagaatccacttttcattgcagtctccttctaggtccaaagatagacaactaactcaaaattgtatcttcgctttaatcactgctctggtgatatttgcattaatgaaagagaaaagaaagcatccccaacagatggaaaaggcggctctctgactagtgaaaggtaaggaatttttctgaaatcttgggtgcacaatgtgggaaaaacaaaattggtaatgtctcatgggatcagcgcaggcatctgcacagttttcactccgacttctgtctgtcagattgactgcattagagaagaccgtaaatgtggtgatggaagtgggctgtgacacacttgactggctgtagcagtgttcctggtagagccacattcccagcacagctgtgggtagctgggcagctagtatgatgttagtccccaaatcacagccgattctttctgctgtcaaatatacagcccctgagcccccttcccctgaacctggaagggggttctgctggtgaagtcagatggccttgttagccagggtgggccagtctaactgcctgttgcatcttgtctgttccccaaagacagcttggcttgatgtgatgtgaaaaggatggggcagaaggagaaggggacagattctgtgctttccttctgtcgttcttttttggctggtgggagcctgtgttgtttttctcttccttcgtaggaggggattttgagttctggggtctggctgaggagacacgtgccagagtgtctggcccttttgggtcaggctgcctgactctggcacacagttctggaaggatgtcctggagagctggtttactgaggcaacagctgcaagctaactagggaaagagaagaggaaagtactaggttgctgtgtgctcaggatccccggttgagatatggagaattatgtctggggaacaaaacctaacaggctgtcctcatcacatgagatatgttcccaggctggagtgcagtggcgtgatcttggctcactgcagcctctacttcctgggctcaggagatcctcccacctcagcctcccaagtaactgggactacaggcacgtggcacaccccatgcttggttctttctttcctttcttttccttcttttcctcccttccctcccttccctttccttccctttctttccctttccttccctttccttctctccttccttccctccttccttccctccttccttccttccttccttccttccttccttc

SEQ ID NO: 190 - DNA, 2810 bp, Homo sapiens
ctttctcctgtgatcatcggcatgataggaggcgagtgaggaactcagtgtcttctgacacaggcatctcacaacaccagtgcagccggaccgttgtctggtaggtctctgtgcacccaggaggacctgggcctgcgagaagtctggggcccactgctgggtatgctcgtttcttgagcatccgagtcacctttacagtctgcgatgattgacgaggtcaaacaggactcacttgcattgccgggtctctgtggcgacagggaggacttggagatcaaagaaactctagtaacgtggaaattcatgctccgagtagtgacaagccagtgactttttctatagaaagggtacaagactccaatttgaaaatctcaagcagctttatattcaagcaagttcaatccaatctcttcctgactcactgtctcatcaacatgcaaagctctcgaagagaaatcatctcttacttgcctgagggagttctggcagacgttttgaatgtggatgtggaagttctttcctcgtctccatcctgtcaagagccgtggagcaaacagcaggatgaggaagacatggaagacaaaactgataacgcacgtcacctcgctgcagcgggagacagaatgtaacttcaattcagcctctttggggtttgggttctgaccaagtaaatcgggaatgttgttaacatatcaagccagcctttattgtttgtcttaacccaagaaaacacaaaatgacacttactttgttgctcatttaggttttaacttgttgatgtcctccccacaaaaatcaaacttgaaaatgcctggcagggacccctgagatctagggtttgaaatgctcttttgacaagttaagaggttaaaaagaattcaggaacatactgtagagtctcatgggggattttagaaaaaaaatatgcaaagcatctttaaatatgtggaaaatccttaggagtgaaattgcactgaagtcagattgttttcctattgaggttgcattgctcggctgcaagaggtggggtgggcacatcgtggggggagagcagaagtgcctgttagggtgctgccagacctcagtgtggaattctgcttctcacagttggccataatcaatcaatcagactctctctttctcctcccttctccctctccctttctttccgtggttgaagggcccctcttaaatcgctcttgagcctgcattctaatttgctctctctcccacgtgaaatccacttctcccagctaagctgcgttttgcagctttatgacggtactgaaagcactttatttccacttaaagagctgcctgttctatttaccatcactctcggggtacttaacctcatttaaaaggctaacttttctcctgcattataaagttgctcgggagtctcaaagcctctttctctgcccagcccgcagccagccctctccagccaccccagcctcgccctcacccctcccagcctctgttccaaggcccaggcgcgcccgcgtggggcacgtgtccctgaacgccccgcctccggccagcctgaccgctcagtgctcggtgtcacttctggcacgtctccacattcctcaaatcccagagaggacctcgaaataggatagaaaacaagaatttaaataagaagcaacagggctgcccgctctggctggggagggcctcggcccccgcctgcacctgcggcccttgtttcttgcgcggttttgcaacgtcagagccgtccacactcgcaggccatttttagcggcctgttggaaagggaagacgatgaagtcgggctaagcagggcaacgccttgccctctgagaggcgtggagggcccttgggaagctcagagagctacgataaaatggctaaacgaccttcctctcctccaagtcaccaaatacgaggcaggagaggtgcccgatgagctcccagtcatgtggttcagggcgggctctggaagactcacagaggagactcctccgagaaaccaagaaggtttctgtccaagtcgggatctgctctgctcaggatgctcctccaacacacacagtgaaaaactgagcacctagagagcaacaccaaaaacccatggccaataatggagagccaaatcaggagagcattcagcaaagcaattcttgctgtagaaggaacagcacaaaaagctggaaggaaactgaggcatgcgtgaaagataacttgtcagtgtttgcagtctactgagatccccgctgcaagaaaaggcaggatttccacttgcttcttggcccgcctctgttgtccagaatccaggacaggtgacaagagaagcagatgtgatctgcacaagctggctcagctgggttgggagttgctcttcctggacaggccgggaagggtgctggaggggagggaggaggagagaggttttaggggaggggtgctgagcagtcagggacctgtaaggtcacatttctttcaggtattctttctaggtgtactgaatgggaacattgtctgtcatccctagactgcattaaagacctaaactgcttccatttatctttggttgttggactgaagtttctaatgtacctggtgacacagagcacagctctgtgtttttatgggttgcttagttcaagatctggatgaaagaagcctgaacccatttttgtgcaaaagcctaagggtgtacagcagggatgctcaaacttttgtttttataagaacccacttttatattaagtaggttttctgtgtgtgagaagaaatgcttgaacatggaaatgaaaagttctaactgtaggatggagtttaca

SEQ ID NO: 191 - DNA, 2007 bp, Homo sapiens
aatttagatattataaagggcaagccagtacatatcacaaaatatcagtataactcactgtttcacaaaaggggaagacgtaacagtcatcaatttaggaaaacaattgatatagagattttatgataagctttctgtttaagacacgtccttttatgtaaggtgatttttttggtgaaaatgtatcaaaatgctttacatgtctgtgtcttcagacacagaaagtagctgaaagagcttgtaaaaagtgaattaaatgttagccaggcgcggcggctcatgcctgtaatcccagcactttgggaagccaaggaaggcatatcacttgagtaggagtgcaagaccagcctgggcaatgtagcaagaccctgtctctaccaaaaatacaaaaaaattagccaggagtggtgacgttgatcacaaaaatatcttctgaacaatttaagttgtgtaaagaatgacattcttccagcttttcttggagctagggaaaaggagctttccatgtctagaacatagggacgatgagcactataaatatatctgcaaaatttggactgggtttaaggtgaatataatgatcaaaaggtgaaaaatccaaagattttaggtttatcagcttcaaatggcccaaaatacatagagcataatggatgagatgaatggaaaagagaataatggaaaacagttttactgtttgttaaacttaactaaaaagtgaaatgggagacagaacttaagtgcaaggttcatcatcagaagtagaagatctctggataacaggctattaatattaatcagtaaactcttaactacagtactgatgaacacctccagaaaacacttcctttagccagtgtattatacgatgatgatgtgcaatggccatggcaaagggtttgtaggtccttcttgcccagatgcagccacttaagcagtaaaataatgaatggtataaattcagccatcaagccactgtacacacattaactcaatagaaagaagcacattagggtcacctcagcaaccagtatatgcagaaaataacagaagtgagaggtgtgtccaccctgcaatttctacaggacacctctccttcaggttacttaccactcagatacaaaatcaggcctcactattctctccctggccaagctgctcaactgacaccaagtccctaaaatatatctcagggtgccagaccgcatgccttccaaattatgtctggcaccgtctaccagatgtacctagaaaaccattcagggctaaggatccatgaatcacgtcaaagagcatggggctaacggatcacagacaatggcccacatgttacggggcccacaaccaccctcaaccctgctgcttacaccacaacacacttcaaatgtgctacacaaatctgcaatcctcaacaacttaatgaacaacttcaaagtaccatgtagccatccgatgtgcctgcactaagtaaggcatttcactgtctgtgttggcctcagccttcccccaagcacaaaaacagatgcaggattaacagtcaactcctctactctaactgaaatccctgccacactgtcagagactaagaattcagaaacttctttgcagatctgtagtctctctattccaaggttagagaagttgtcactgttccaccagcccaccaggctaaggtactgctcagcaagtacttaacggtgccactgttaaaaaaaaaactgatcaggagccacagaaataaacttgtgcctcatcagagaaaaacatctaaatatcaaaaagccaaagcactgtagaaaaaaatctataaaataaaaaatatattaaaaaggcacatgggccaggcatagcggcacacgcctatagtcccactactctggaggctgaggtgggaggattgcttgggctcagaggattgaggctgtagtgagctgtgatcgccccattataccccagcctggacgacagtttcaaaaggcacatggaacatactgagccttatgtatt

SEQ ID NO: 192 - DNA, 3007 bp, Homo sapiens
aagaaccttttattaacacaacaatgatattttaaaaaggaagaataataatttccaagaaaaagtacaggaatttattttatgtctttttgaatttagacagagaattatttcatagacatcatttagacaaagttagactggcctgaatttaactgcaggtcctgagacttattattaagggtcatatttgccaatgtctggtgagaaatagactgggaagatgaaaagcatcaaaagatttctaagggctaccaagattattgaggggatactgaagaacatgttttttatttaaatatttcctaggactgaccttcactcttttttcagtgaatctaccattaaaaaggggcttgagttgcttcaaagactgagtcccttaaatggtacctcatctattacactcaggagcagctacagctagagtcaccaagaagggtcgctgacatggtagttgatgctagcaggtcagctgggaggtcagctgcggctttctggcagagtatctacatgtggtctctctctcaaggtgacttggacttcaaacaggatggtacccatgtcccactggagaacaactcaagcatcaatattccaaaatttgtgatgcttcaagattgattgaggatcaatcacagtttcccagaactggaaaggtcctacttttcccctgctctacttgttaagctgcctccacagcctgctcatgttcaagggcctggagaaataaaatgtttcttcatgaaagcatggcaatgtcacattgcagaagtgcatgtgggaataaacatattgttgtggccaactttggaaaatataaattctcaaaatcactttggaaagggtttctcttttgacagaaatcaaaaggtaaccatctaaaagcacttctcctttcattctgggcacagagctggataatatttctaatttctgtaactcttaggaatggctatatcacttacatttagccaatggaatgcacacacaaatgtgtattccaccccctggtctgagccatagttctccgcagtgatatccctcatattatttctcttttcactttactattgtgacaatgcctagggaaacctagggaggcatatgttaaagttggcagaatttctgtgaccctgagtctaatttgatcctcaatgactttcatccctgtgttgagtgtgagcaaaatctatcaataggatgagatagtacttccatgagtacgttatagtttatagcaaatgagatttttacagtgtaattagagttggaaatcactgctttttaactgtgtcaaatgagtcattaaacttgtcctctgtgtaatttttgttgttttttgaagaatctgtggccatcctggaaataaacagagtgacatggtgacaattgtggatcctctcctttgggataatgcactgtgtatcccattgcaagtgcttctcagacatcagtgcaacgacctcttcagtaatctgacctaaaatgtaagagacttgagagcaaagatcatgttttgttcattattttactcctagtacctaggacagtccccaccagcaaatgcctgttcagtgatggatatgctaaaatctcctttattatagatgcatttatttcatggaaaaaggaactgttgagcaactgatttttgattatttcctgagttgttctgcaggcttgaaaggatagtttcttgttggtcaaatcacagaaaagtcttatacaagaattatcatcgggtcaagttctcagacttacattgtaattaattgcttagcctcattacttccacactatataatagttttactctttgttctttctattaaactggttttactttagaattttgtttcactgtaatgaatgccataagaatattctttaattcgatcattattattattattattttgagacggagtctcacactatcgtcggggccggagtgcagtggtgtgcaatctcggctcactgcaacctctgcctcctaggtacaagggattctcctgcctcagcctcccgagtagctgggattacaggcgcctgccaccatgcttggctaattttttgtatttttgaagagacggggtttcaccatgttggccgggctagtccccaactcgtgacctcgtgatctgcccacctcggcctcccaaagtgctgggattacaggcatgagccaccgcgcccagcctcggtgtttatttttacaaacaagatagctcacatttccctccaacaccattttaaaataaagcttgtcatttctatttgaccttttgttatctcttcctgattttctgagaatgatttatactaaatattatatcttttatattgtgtacatatatatgttatttataatcccatatctgaatatctgaattccaaaatactccaaaatctgactttttgagcacagcactgacatgacactcaaaggaaatgctctttggagcactttggattttggattttcagattagggatactttacggtttcaaaatctgaaaatctctgaaatctgtaacatttctggtctccagtgttttggattgggaatagtcaatctgtaacatacatgcatattacactgtgttttctttaattaaagtaattgcattaatttgtctaagctagggatgtatcaaaagtacatatttcattttgatccttaaatcaattttgacatatttcttcttatgattaaatacacatgattcatagaagaaataaggtcctccactgggatctttttgttttgtaaaagactttcattatacagctctgttggctatttatccagacccagctcctgtcataaacctttatgctttatgttacagtaataatgaattatttgcaattcctaaaatatcacaattgcattatataattccaattgttggcattgaagccaaggactgtgatttttccatagttattgtctcagcaactagcagtatggtggcataaatatctgttgaaacaacaaac

SEQ ID NO: 193 - DNA, 3464 bp, Homo sapiens
gaaccaaagcaggaatttattgaaaacaaaagtacactccacagtgtgggagtgggcctgagcagcagctcaggggcctggatacagaatcttcctggtccaaatacccaccagaattttcccatcggccacttcatgctcacctcatgtaactgaaatggtagccgcaatcagtctgattggttgcagaaagcagccaaccagaggctgaagtgaagttacaaaagtcacactcctgtgcaaacaatctgatgagttgcaaaaagcaaccaatcagaggctaggatgaagttacaaagttatacttctttgcaaatgaagacttgaccagcaatcagtcttacttgttgcagacagccaatttcccatctgcctcacagaaaaggtcagaggtagtagcctctggttctttgttacttagacatggaaagttagggttttcttttcattttggttctaggaagtcagagcgaaagagccttaggttccctgcctccagaccctattttcctgcctcatagaggtttatgtcactgtccttttgagagaatccagattcagactttcagttctgtggctgtgggccaaaaccaacaaagacccaaatcctctgtccttgggagcttgaggagagtttaccagttcatgatcctagtgggtctgagaactttgcctttaaaatccactcctggcccctgcctactgcttcatggcctggggaatagagtggagggggccacccttggtcaccttcctttgactctcccaaggaaacagcacaaccaagaaattgtggatcaactagaatcacactagtaatgtaatttctttgctcacagcatgactgctgggtttggggggcactcagatgtagaggtgctagtctcgtcttgctgacccccagcctgggaagaaggctcaccccccaggttccacctcatccccacagggtccctgataacctggtcccatgggtgggcctgtcctggggcattggtggaattctgggggcatgtctttgctgtgccatctctgcctccccctagtaagagctctgtcttcctcttcctataggaaaagcaagaaagccagcaaaaccagggaaccctaaagaggcagttagaggtgagtggagggtgtgaagttccctcctgtcctctggagaatgttgctttccttctctttcagcacttgcttggcttttctcccaaaggttcaaattcagagaaccaacaaactgatgtctgagaaaggaaaattaaatactgaactgtatcatatgcaacgtgctgccaggcactttgaaggtgggaatctgggcaccctgtcatccttcaacctggtgctttgataggcctttggaccccatctcaacctctctcatttcaggagagtccatggatctggccagcggcctgcagtattcccagcagtgtgtgggagagttgtaatggactctttgctgtctccatgcagcagaagaacatggacagtgtgagtcctaccgcctgccccatcccttggcagcccagcttcccaggtggaggagtgagggacctttaggtcccttctgcaggatggagtgtcctgcccagaaagcagcatgggccatttctcattgtttttgtgtgtggttgttagaggcagcctgcggctgagttggctgctgtggatgagttggggagtgctgtggggagcaagcagagcttggacgtggagcactggatgcagagcttagaggccaagtgcctaccctgccttcacttggctgtggccttagccaaatcctaggtgtgggatatggtacttgcactgtgaaagtacagaagagtatctttagtatgttaccatttgtggagagagaaggaccgtgtgtgtgtgtgtgtgtgtgtgtgtgtgtgtgtgtgttgtgtgtaagtactatgacaatatacataaaacatgcttgaaagtggtctcagagccagactgggtctggctgcgttttcttgaggctcaaaaatgagaagcaaactaggaaagaaggggatttattgctgtaactggatacagagagaaggctggagataactccaccagaccaactcgaaatgttacagtattcttagtgtttatataggttggggttatgtgtctacgtacagtatagcattcgcctaagtccactgataactaattttgtttcaactagaaggtcagaggcaaaaaatgcttgctaagtctgattaagctgtgagggccctggtaccttcaaggtctgtctactgtggtacctgaatgattatttctatcttacctcccttacagcttggtctggagactgccttagaccctccgatgaatctattcaaacagctgcctctgttaccttgactcgtctcagattccgtcgacccgagacaaggaatataagactgtctctattattttgacttgctccaggttagggagaagcctatgcaagggtcctactgaccatatgtttcatttttagctttgatacctgggcacggatttccctaggtttaactatttgctcaatgttaaggcagctctgtggaaatttgtttgtataactggagtgcggtgcagggctctctgtgtgactgtcatgaaggcctgtctgtgtgactatcagggagaattggcctgccacaaaaggattcatacaaaactcaggagagagaaacagggtggctgggagatatttcacttctgtaccttctgagtttgggactatgtgaatttatcattctttcaaaaagtgaacaaaaagttaatttcctccttcctttctgtgtcccgacccccagtgaaaaaaagggttagagaatcagatatacctgggtgttcaaatcccagctctgtctgagtgatcttaggcaagcaattaacctctaataccccatttttttaatctacgcaatagaggtaaaaatagtaactgtctcatatggtggttgtgagaattaaatgggattgctagcatggtgcctggtgaagcgctcaaagcttcaaacagtggtagtaataagggtaataacaatagcaatattctctgatctctctgggcctctggtagccagctataaatttgatctctttccccgtcgcttccacccttattgagttctttgagaaacaaatgagactataggcttggaaatgccatgaaaacatgtcagctgtgattgagagtaaggaattgttgactggggaatagttattatagctattgttactggccagccagctgctcctctgcctgttttgtcctgacttaacctttctgtatttgcagtatatcaaggaggtaaccaaagacagagatgccctcaggctggagtcatacaagaataggtaggatgggggagggtgggatgggaggtgtggggcccttagcgtgggtgatgtgctgggaggtgggaaggctgcaggtgagcatggtgaggtgatcatacagg

SEQ ID NO: 194 - DNA, 3382 bp, Homo sapiens
aattgatagaggaaagaggtttaattgactcacagtttcacctggttgaggaggcctcacaatcatggaggaaggcaaggaggagcaaagccacatcttacatagtggcaggcaaagagagagcttgtgcaagggaactctcatttataaaaccatcagaactcttgagatttattcactaccatgagaacagcatgggaaagacccgtccccatgatttaattacctcccactgcatccctcccatgacaggcgggaattatgggagctacaattcaagatgagatttgggtagggacacagccaaaccatatcattctgcccccaacccctcccaaatttcatgttctcacattttaaaaccaatcataccttccccacagtcccccaaattcttaactcatttcagcataaacttaaaagtccatagtccaaagtctcatttaagacaaggtgagttccttccacctaggagcctgtaaaatcaaaagcaacttagttacttcccagatacaatgggggtacaggtatcgggtaaatacacccattccaaatgtgacagactggccaagatggaggggctacaggccccatgcaagttagaaatccagcagggcagccaaatcttaaagctctgaaattatctccatggacaccatttctcacatccaagttatgctgcaagaggtgggttcccatggtcttgggcagctctgcctctgtgtctttgtggctgctttcactcctggtgttgagtgtctatggctcttccaggtgcacagtgtaagctgttggtggatctaccattctggggtctggaggacgctggccctctcctcacagccccactaggcggtgcctcagtggggactctgtgtggggtttcaagcccacatttcccttcttcattgccctagcaaaggttctccatgagggcgctgttcctgaagcaaacttctgactggacatccaggcatttctctacatcctctgaaatctaggcggaggttcccaaacctcaattcttgacctctgtgcacccgcaggctcaacaccatgtggatgctgcctaggcttggagcttgcaccctttcaagccatggccccagctgtaccttggccccttttatccatggctagagcaactgggatgcaggatatcaagtccctaggctacacacagccaaatcatatcacaaggggtggattattcatgaattttccaggaagagtgggcaattcccagaactgggggttcctcccctttttagactatatagggtaattttctgatgttgctatggaatttgtaaactgttttggtgtgggtaggagtgtcttttagcatgctaatgcactgtaattagcatataatgagcagtgaggacaattagaagtcacttttgttgctatcttggttttggccggcttttcttactacaacctgttttatcggcaaggtctttataagctgtatcttgttctgacctcctatctcatccggtgagttagaatgccttaaccatctgggaatgcaacccagcagttctcagccttgttttacccagaccctattcaaggtggagttgttctgattcaaatgtctctgacatttcccccctcccttttacaaggcaactcttaatcctaagggttgtggaaggatgaagatccatattctgtaacttcttcaggctgaataggggcaatgctttcctgcctaactgttagggtctcttgtattcagggtagagaggagctcagaaagcataattatggtgagggtcacttgtaactccgagttctgacaaaaggtggtatctgtcttgtttattctgaactgcaaccagagatcactggttggctcacaggaataagcagtcagtctaaattgcagaagaaaaccctcaaaaacaactgatgagattagaatctaataacaggtgtaccatagttcttgaaacataatttttctctctccagtctcccattttttactaaagacaaatcatggcaaaaccaatttgctttattatacttggcctaattatttgtataaagtgcagcaataataattatttttcacagaggcttttaaaattgactttgatggaactgtgtttcataaaatgaatctcagataagactttttaaaagctgagcccagccgtgagtttgcaccctcaaatacctgagttgggtaaattcctctcctcttgaggtcccaagataacctggggctcctgggccaatcagaaagtgacattctttacttaccacaggtcgggaaccctgtacagggactgtgtagacaaggcatgaggccaggtttcccaaggggcttttattggctttataagtcaagtttgattccttaaaggaaaacataccattccaatcaaagctttggtaaaatcaccagtttctccaattgtgtctgtttgcaaaagaaaacagatccttattgtacttatgcaaataactatattgctataagttaagaatactcacaaatagtttccaaattttggagaaatcaggcagagagaaacaaatatgctccaaattttgttcacaggagttaagctgtcagtagctcaaaagaaaagtttccttgactctgaaaaacaaaacaaaggatccgcaacattttaagcaaaaagccgaaaaagatcacctcagtcctctattagttcagtccatacagataacttctgttctgtttgatattcaaagaagatccagtagttgtaagattgttcatttgccagtttgttaattggattactggcagggtggagcctttggaggaacagggccaggaaagcatgcagtttctacagcctaacaagcaggcacagctggaaggcaaaaacagatccccaaaaattaagggcctcatttttacaccaggtcctggatccccaaaagaaatgctatagaacaagacagtacaataattttaccatgcatttaattgctaggcaacccaaagtcaatcagcccattctgtgattaacccatcccccataggagtcttatgtctgggtggggggaaagggcatttccatactttttaggtggtcaagagcatgcttttctgttccaagaaaaagcaaagcgccatatattcccaaaccactgccattagttatttaccaaagtatatttcctatctagttattacacaccagagttctctcataatgcaaagtaatttctgatattcccccaaatcaaaaccatcacataacacaatgcgaaacagaacagagtcttcgatctgagcatccctcgatgagggctgttgcgtcttgatttcatctgggtagttacaggcatcatccaccacgaagtttccaacccagagtcaggatgcagc

SEQ ID NO: 195 - DNA, 1305 bp, Homo sapiens
gtctcaaaaaaaaaaaaaaaaaggtgaggtcacccagggtatcagtggacaagctgagaacaaaaccaaagtttctaacaccgaaaatttgtcttctgctcatcccagcctgaaaggaaggtgaaccaagatgcaatccatgcccattcaagtggggtctgtgtgtccaggcagaggtgtctgccctctacaaagggcacaggggagagagtgatgcttaacccaaaggaggtctcgctgatggtggaatttcaggcaccgtgtttatgtttggcctaattagcttgagaccagtgtccttgacgggaactaagacgccccccacgcccatccccggctcccaggctctctccacccaagttctgcccaccagggcacactgcttccctctgccacctcctcttcccacgagccctggtacaccctagattctcagggctgtggctccttgctttacaaatgagtaagttggtggcagggaaggaagtgggctgggccatgaccaagagtcactatgattcacggggaaaaccctgccctcccgattcaactctgtgtgcaaaaaggttttgtgcgggttcctagggtctcagggtcaatggatgtagatagaccactagaggtatacacagccactgtccaccaactctcccaccccccgggtctgcctacagccctggatggggatcctgtaccgggggggcggttggggggttggacaggtgtgggttgaggtgttgtttacatgttgaacacactggggttccaggtaagtttccgtcagaagaaagcacttcactgctgaggcagaaatttcaaaatattgaaccacttttcgatcctggcagaagggaattttcccagggtgataaaagtgttctaaaattagatttgagtgatggctgcccaaaaggaattatgatattattcaagaaatcatggctttgctgaacaacagaaaactcgaacactgagcatttgaagatattaaggaattgttgatttttatgttcactgtttaggtgaaatgatagcattgtgagtgtgttatttttaaatgagtccttatcttttaaagatacaggcagaaatagctataaaatgatctgatggctgggatttgctttcaaataatacaggagagggccgtgggtgaggagagggaaccagattgcctatgagctgagtgatgggtatgtggttgcgagggcagacaccattcttctctctgctttcgatgggtgcgtagaatttcccataataaaaagtggtttttaaattgttttgaccattggcctcgcgcgg

SEQ ID NO: 196 - DNA, 2437 bp, Homo sapiens
aagtggggctaagggcagcctggcatgagcctgcaggtgcccctcagcatgaacggcctgggtgctctgaatggtggccagaagcagaaaggctcctgggtggaaaggggcaggtccccagtgaaaccccaccttcaagccagggatgacctgaagtctgggggccaggctgccagttccgtggactggaatgagaacttaacggtgttttttctgggcctgcccatggccacccatggaccaatcagcacatacttcctcacctctgaagcctgtaacaaccctggactcagccaggctacagcagataacaggacaacctgcctgtagagaagagctacccactgtgggtctcctttccactgagggctgcacagacaacaggattacctgtctgtgcataggagctacctattctgggtctcccctcttctgagggctgcagagctattgggatgtcctgcctgcagataggagctacccactttgattctcttgagagctgtactgttgctcaataaagcacctcttcgccttgctcaccctccagttttctgtgtatctcattcttcatggacaagggacaagagcttgggacccaccaaatggcgggcctgaaagagctataacacaaacagggatgaaacacacccccctacttgccatattgcgggcaacgagaaaaagagaaaataggagagaagtgctgcagccctttggggaacccagacctaggagctccccaagctaggggtgtgacaccctctttggggctctgtggttcctggtgtctccaagcttctgggcaccaccacgttacccggtgcccacagtggaagctgcttgcagtatacctggtccagctgtagccctgcagggagccggtacccatgccagttcctggagctgcccaccccaccacagctggcatgctaggctgtgtgcagtagccagactgcatacttgctcactcacacacccattgctgctctgtgcctggcttgcccttgacaggtgtgggctctgggctggtagtgcaagctgagcacagcccaccaggccaagtgggtagaatgagcccagtaggcccaaggaaaactcagataaaggcgccactggccacagaggtttcctgctggcaaagtgacaccccaaggatcctgagacatatacatgagactgtgatagagctgcctggtctattctagtccatggtcaatttttttgtttctgcactaatgtcatattttcttaattatgagagctttataccaagtcttgatatctaaaaattaagttctcctactttttttcttttgaggttctcttggcttttcttggcccttcatgttatatatccgttaactttcatagtcaatggtatgttgatctaaataggcaagtttttcattagtggaagcagaacattcgtagtaaaaaacttttaaagattttgattgtcataacaaatggccctctggcataggtgataccaatgtgtactccataaggagattgtaataatatttgaaatggaaaatgactatatcagactatatgtgtgttttgtgatttaatttggggaaaaatatctatttcatgcctctagtatttctcaaaaaacatgttgaatatgagtcttattaggttttgcttgtttggtgagtaaaaatgccaagcctcatgagaagcagaatgtattttctcttttattgtaactgcatgtacaatacctgctatggactgaatcgtgtcccctccaaattcatatgttgaagtgctaacctccaatgtggtagtatttggagatagggcctctgggaggtaattagggttagctaagatcatgagggtgggcccccatgatggaattaatggctttataaggagggagggagaaagagatagatcgatcgatcgactgatagagaccgatcgattgatcaaccaagagagatctctttaccacctgaggacagagaaggtggctgcctacaagctgcaaaaagggctcttaccaggaactgaatcagtgagcagcttgatcttggacttcacagccttcagaactgtgagaaataagtgcctgttgttgaagccacctagctcatggtattttgttagagcagctcaagcagactaataatatagtacccatgtgactctgaatttagaaaataattgattataagttattctgaaaagaaggtctatatacacttaaaagcaaagcaaagtaagagtttttaaaagtcttaaaagcaaactgtatgcatatgtagtttacataagcatttcaaaagaattctcagttttgggtgcatagggattgctatcatattttgcaatgctcatgagccaggaatggaaatatttaacattaagttaataagaaaataacatgaaaaagttgtttagtgagctggagtcagagctc

SEQ ID NO: 197 - DNA, 1192 bp, Homo sapiens
atctgacctctaccccacccccccgcaacttcatggaaaaatgactttctcagcgttcgttcctgaaattattgccaaacccagtgttttattcttcaccctgtttgcctcctctgagcattgaatgttacctacctctctccttgaatcctggctccagctatcctggttacgttctgaatgtgcctttgcacggtattttctgactcttcttttctgtactgataccttttctttctggatactttcttctatggcagtctcatacattctcaaggatttaacatttactccacttaaaagagttccaagatcatctactgaatcattaagcaaatatttgttaaatccaggctctatgcccttccaagttgaggcaacagcagtgggaaggaggcaggaaacaaactgcatctgttggaggaactgcaagaagctagtgtgattgggagggctgtggggagcagagggaagtggctggagtctgatctctaagtgtctagccccttcctttctcccaaggccccagtccacactatctggcatcttcacttcatggctaatttaacactgtcagtgctgtcaattgctcttcccccagaactgtatttttcacatctgaagttctgttaaaggacaacgtttcacaaataaaaatgataactaatatgtccctatatgtatcaggccctcttctatgcactttatgtagtaaccccatttcatcctgaaaactaccctgtaatctagacactattattagtcccattttacagatggaaaagccgaggcatcgaggtcaggtaacttgtctaagatcatagcgctagtaagtggaagaggtccagttgaacccaagcagtctggcttcaccattataatgcaccgccttaccaccaagatcttatttattcattcaacaaatatttattcagctagagaccagtagagatagtgacatgttacgcctatggcctcacaaagcttatcttctatttttgccacgttttaaaattgtatcatctttccccagtaccatcttgatttaggcatctattacccctaactaaatgggacttttgcaataacttcctaactgtactatcccctttctcaacatttccagagcaatcttctcaactgcaagctgaatcatttctcttcactgtttaaatgcctctgtttatactca

SEQ ID NO: 198 - DNA, 3262 bp, Homo sapiens
agctgccggacaccaggagacgatggaaggtctatagtgttacagctctgacccaggaagtcccagggtcttgccttccagaagggtcgcggctcttccctccctcagtccaacgaacaggagcacgtcacctcccgcagctcggggagctggccaggaacgtgttacagcccgtttcgctcctgtccgcagctgggtgaggcagccaggaaaatattacagctcttctcacgcccgccattcagcaggtcctgacttcttgtgtgacatccagaagaaaggggttacacagacagctggagggtgagcaaagtggagaagttctcagcagagaggagactggagtgagttgcccctacccgcaggtgccaactgtaatacatcagtagctgaacagctcattgccctcaagtgttcttgctcatgcctggctgagttattgaagaaattgctcagatctcaagcccttgtagatcactggtcctggcagatgttgaggcagagcaagatggcagaatagaagtgttcaccaatcatccttctcacaaggacaccaatttaacaactatctacacaagaaaagctccttcataagaacaaaaatcaggtgagcactcataatacttggtttttaaactttgtatcactgaaagagatgctgaagaggtagaagaaaatagtctggaactactgacaaccccccagtttggccacaagatagggtactggtcagagttgcaagaccctctttccaggccctagctcctggacggccttttttagacatgccctgggccagaagagaacctgctgccttgaaagaaaggaccaagtcctggtagcattcattatctgctaattgaggagactttggttctggaataaagagcagtgatacccaggtactatgttgagggctgtgggtgaaattctgagacttgctggctttaggtgagactcagcacattcccagatttagtggctatggggcaagacttgttccacttgagaaaagcagaaagaagactaaaggggactttgccttgcaccttaggaccagaatggccacaacaggatagagcaccaaccaggctcttgggttccctgattttaaaacatggctcttggatggcatttctggacatgctttccaccagaggggagcccactgcccaggagggtgagtcccaggccagacagtattcaccacaagttaactgaaaagcccttgggacttacgggaacattggtgataggctggcaatactctgtgtgggtctgtggtggtggtggccatagagtgagctcctctgcctttggaaaggagaaggaaaagtgggaaggactgcatcctgtggagtgagtgccagctcaaccacagaacaatagaataccagatagacttctaagccttttgattctagtctctggctcccagagaggacctctggacccacccagcacctgggggtactcactgcatgaaaaggaaggacacaattctgactgactttgctacctgctgaatgtagagcctcagagccttgagcaaaaataagcaatagccagggagtgtttacagcaggacttgggtaagacccagcactgtactgacttctggtctgacccagtgcaggcatggtaatgatggccatagggttgcttgtgtcactcccctcctagcttcatatggttgagaacagagggagagactcttgtgtgtttgaaagaaaataagggaagagtacaagagtctttgcctggtaatctagagaattctcctggattatgagtagaactatcaaaatagtacctgtatgagtctacaagaaccatagcattgctgggcttggggtgcccagatacagcttcgatcacaacattcaagttttttttttttttaatatttggaaattcttcccaagaaagatgggtacaaacaagcccagacagcaaagactaaaataaataactcttcaatgcttggacacagacaaatatctgcaagtatcaaaacattccagaacaataagatctcaccaaatgaactaaataagacaccagggaccagttctagagaaaaagatatgtgaccttttagacagataattcaaagtatctattttgaggaaactcaaagaaattcaagataacacagagaaggtgttcagaattctatcaaagagattgaaataattaaaaagaaacaagtagaagttcttgagttgaaaaattacaattggcatgctgaaggaatgcatcagagtcttttaatatcagaattgattaagcagaagaaagaattagtgagcctgaacacaggctatttgaaaatatggggtcagaagagataaaagaaaaaataaacaatgaaatatgcctatatgatctagaaaatatccccgaaatggcaaatctaagagttactgggtgtaaagaggaggtagaggaagagataggagtagaaagtttatttaaagggataatatcagagaacttgtcaaacctagagaaatatatcaatattctaataccagaatgttatagagtaccaagcatatttaacccaaagaaagttacctcaagggatataataatcaaattcccaaagatcaaagataaagaaaggatcacagaagcagtaagaagaaaacaaaaacacacaatgaaactccaatactactaacatcagacttttcatagaaggcttacaggccagtagagagtggcatgacatatttatcatactgaaggaaaaacgttttaccctagactagtgtatctggtgaaaatatccttcaagcatgaaagagaaataaagaccttatctgacaaacaaaagctaagggatttcatcagcaccacacctgtcctacaagaaatgctaaagggagtttttcaatctggaaggaatgggtgttgatgagcaagaaatcttacagtgcaaaactcattggtaataggagacagaaaaacacagaatattagaacactgtaactgtggtatgtaaactactcttaacctaagtggaaagactaaatgagccaatcaaaaataataactacaatttttaagacatagtacaataacaaatagaaacaatgaaaaggtaagaagtgggggggggtgaagtaaaggcataattttttgttttctttttgttggttaggccaacagtgtggttatcagactaaaataagggttttaatatagtatttgaatgtttcatggtaaccataaaccaaataaaacatagagtgg

SEQ ID NO: 199 - DNA, 2703 bp, Homo sapiens
gtgagccgagatcatgccactgccctccagcctgggtgacagagccagactccctctcaaaaaacaaacaaacaaaacacaaagataaataatgcacattctattctgggtctcatcagcctcaaggtggccaagtttctatgctgagactatagcccacagttacaccagccatgatcctcagcagcagaggtagtgatgatgaagtctgatgcccaaagacaagcagaacagatttaggtgggcagttatatcactgtgagttttcatggactatggtatgctgaactcctttacctgcctgtggactggagttggaggactgtcattactggcttgttctgcagtgctgggttccccattgcaggagcagtgtctgcccttactgaagagggaaggattgacccagcctcctgctggtggcagaaaggaaagagagaccacagctgtccccacacatcacccttttgtttcctgaccatgaatagatatttatcaagaaaagacatacatacaaatggccaagaagtttatgaaaaaatgctcagcatttattctgggaatgtaaggttggcttaacatttgaacatcataatcaaggtaaatcaccaaatcatagactaaaaaaaacatgaatagaggcaaaatgatcatttgataaaagtcaatatttattcaggatagaagctccagcaaacttggaatagaaggagacttccttctcttaggatggggatctgtaaaaagctacggctaacattatactcatgaagaaagactgaaaatttctccctagaggagcattgggaggatgtctgctctcatctcttctgttcaatattgtactggaagtttcagtcaatgaaataagatagaaataaaagacatatacattaaaaagaagcaaaatcatcttaacttccaatgcaatgcttacttatgcagaaaatccttagaaatataaataatgctactaaaacaaataagtttagcaaagtcaacaaagccagtacaaaagcaatatgatttttatatattagcaatgaaataattgaggagtaaaatttaacaatgcatttacatgtatagttaggggtgcatttaacaaattatgtgcaagacctatatgctgaaaactaccaacattgatgagagaaattagataagatataaatatatgaagagtttccatgctcatggattgggatactcaacatagctaagatatcaattcattcccattgatctataaatttagtgccattccaatcaaaatcccaatatatatttcatagatgttgaaatactgattctaaaattaatatgaaaatgcaaagaacctagaacattcaaacttattttgaaaaagcaaaaaatgggaagacttaacactactggattatgagatttagaataaaactacattaatcaaaatagtgaggtactggcaaaaggacagacatagcactcaatggaacaaaatgaagaggctatacctaaaccctcatttatatggtcaacagaccctcattaaatgttcatgatttttctagaagggtgctgcataatttaataaaggatactctttttaacaaatggtgctgaataattggatatctatttgcaaacaaagaaacaaaaaaagaaccatgatgttttgttcactttgtatgaaggattttaatggaaatggacaatagatctaaatgtaaaaagtaaaactatgaatcttctacaagaaaacataggagaaaatgtccacgatttggattagacaacaaatccttagatggacacaaaaagcccaaagccaaatacaaaaaaatggataaactgtacttcattaaagtaaaaaacttttgctcttcaaaacatattgtggaaaaggggaagggcaggccacatgctgaatgatatttgtaaaatataaagccaataaaagactgtatgtataaatatatagaagtcatatatttcagacaatctgacaaaaatatgggcaaaagatctaaatctacttactttatcaaaattaaatggaaccatagtgagatattgctacacaaccactagtctaattatttagtctaactaaaatgaaagagtgacaatatgaattgttgtgtaggatgtggaggaactagttagaaggttacttcagtgaacctggtgagaggtgacatggcttgttccaaagaaagcagtgcaggtggtgagaggtcatcacattttgaagataaagcaataggattttctaatggaagaagtgatagagaagagtcaaggacaattccagaattttttgcctgagcaaaagaatgtaaccacagagacatacatggttcagctatacatcatgtttacataacaataatgatacaaacatgaataattatctccacaagtgtataacgattttgagaaaatgggagagggaagtaaggtgtgagggtgtgtgtgtgtgtgtgtgtgtgtgtgtgtggctagtgaatttaagagctaaatcttcatcttccataataaaattcaatagaaatataaaattaaaaatcaagtcaaatctaacattttatataaaatatggaagcatatttaaaaagaaacaaagtagctgaaagtatttctgaagacagggaattgaggttagaagtctaacccaaaagatgacttcacttgtatttaaaaactcgtgcagcctagaca

SEQ ID NO: 200 - DNA, 1194 bp, Homo sapiens
gaaaaatcaggattcccttataaagaaagtgcaatgtctgaggaaatttcaactgtgaaaactacaacatatttactaaaatgcatgaattttcttgtttttagaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccacttcagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatatta

SEQ ID NO: 201 - DNA, 2435 bp, Homo sapiens
ttccagttcattgcctttgtggggtttttttgtttgttagtttgcctgtgtgttttatactttttttctgccttctctggttttaactaagcattttctataattctatctcctttgttagagtatctattacgtttcttttttactatttttaatgattgctctagagtttgcagtactgcagtataaatttgcaactaatttaaaccaatttttaaataacactatactacttcatgggtaatgaaagcatcttataacatattatctctagttttttccctttcttatttcataactgccatttcacttcacatattcatagccaaaaccactgagtatatggtgctattattattttgacaaaaatctgtaatctgttagatcaattaaaacaaaaaaaaaaaaagagtctattataccttcacttattccttctctgatgtttttcatttcttaacatagatctgagattctgacctatatcatttttttccccctctgaagaattctaacatttcttgcaaggcaggtctattggaaacaaatgcccctagttgttttgtgagaaggtttttgtttctttttcacttttgaaggataatttcacaggatacagaattctatgttggtaatttcttctttatttttctttggacactgtaagtatttcactctaccctcttcttgcttgcatgctttctgaaaaattggatggagtgtttacctttgcttttctttagctaagctctttatttcttctgacttctttaaacatttttttatctttgatttcctatagtttgaaaatgataggcctaactgtagactttttatatttatcctacttggtattctgtcattcatttcagaaaattctctgccctatgactatgacttcaaacattttctctatttctttatctctttcttctacttctggtattccaattacacatataacttttgtggttgtctcacagttttgaaatattttgttttatcctttttttctctttgcatttcagttatcaaagtttctattgcattttctcaagcttattgattctttcttagtcatatccagtctattgatgattccttcaaatttctgatacagcatcttttatttctagcattttcttttgattctttcttggggtttttatttatcttctttcagtttctgtatgttctttcatattgttagattgtttctactttttccaatatcgccctttgcatattaatcagagttgttttaaattcccattctgatagttccaacatggctgccgtacctgaatctcgttctgatgcttagtttttcccttcaaacactgttcttaaaaatatatatatatacatacatatatatatatatgccttgtaattactcgttgaaagctggccataagctagcaagtaaaagaaacttaggtatatatgcctttagtgtgagtgtgtatgtttattcagttaggagttaccttgtatttactgtttgctctaggtgtggtgtcagggctaattttctctgatgctcttgtttttgtcttttttgttgtagttttccctagtgactcttacatgatgtttgacattttcaattccttcatctgtattatcctattatcttctaggagctccattgaggtaatgatagggtgttgggggagaaaaaatgttctgtaaaattatgattaggtctctttcttttaccaagcctgtgtccttgggctgtgaccttcacaaatgcttctcacttttactttcttttatttttctatgaaggtgaggccttttggcctcatctaattggagctgggcgtttcctttttgccatgtagaagacgagagtgggcaagagttgtatatttcccttcatacagtttgcttaggttctggtaaaacaccagtcatttaggctctggtaaaatagtttcccttgtgggcaggttttgttaaggagaacagaatattctaaacatatttttaaatggctattttccctttcctctgctggaaatactaggggtttgtttttttctttttctgattttcactgtgagaacatggtagagctcctagaagtaagcttcagaaaagtgtggaggccttcctatgactgagtctccttggagttttaactcttaagcttgtctacctttatcttccagcaattcaattacaagtttaagttttcttaaccctgtgctggctccagcaatggtttctgctcctcaacctttaccccagtaagctatgattccctttaacttcctgtctctctctctccaatttgaggggcaatagattgctctgtgagctcacatttctctaaagaatcctagaggaattgctgattttcagtttgttcagcttttttgttgttgttgcaaagatggaagtgaggccttttaaggtcattacat

SEQ ID NO: 202 - DNA, 2525 bp, Homo sapiens
cgcgcgtgcacgtgtgcgtgtgcctgccgggttgctgcgccgcgggctgcgagtgcttgtgacccgccgcaccctcacccccgggcgcgccatccctgctccgccgccagcgagggagccccggagcctaagacgcccggacccgccgcctcgcagacccacccttgcccctgcgcctcgtcatccgcccgccccagccagcccgcgcagggtccgcggcccgcttttccgcgagaagccccctgtggtctttcctcgtacccggggactcggaccgagaagccgactgagcgaggtcgccgcccggcctcacggacacagagcgactctgcacctttcgcctccaggagctgaaaacattttgtcacttgtgcagtgtactcaccagtgcccccaacatcttctcccccgaaagcgctttcagattcgcgccgagatggggcgacgcggcggctcttgagcggaataacccgaagggccacgcaaactggggcttccagccgcgagcatgcggcggggcgcccagggcctggggtcgcgcgctcagggcctgtgctgcgccacgcaggaggaggagagggctggccctgccgggcgcgggtgcgggcccgactggctgaaggaggagtggggactggcttggaagtctccgaagcagaaaagtggggccgacaggatggaattgggggaggccgattttggctcagagagatttctctattaaggaaagcagtccaagaataggccccctggaagaggaatgcgctcaaacccagagggattctccttagagctacctcttgagattctgtacttcgaggaaattagaggtttttttaaatctctatttttaataaggtgggaggaggctgttgctcctttctcctcaacaacatgaaatgatcctgtgcctctatccaacaactctacaacaaagcactgaatacttccctgactggcactttcatggctgttcatgggcatctcttggtctatgacgacgatgttggagagttcctactccgtgataactcagttctaagtgcaagcagtcacgtgaaatgagcctgatagtctgcgaatgaagaaactaaaacgaactatattatatacttcataacacaagacaacgtgctcgtttgttcattctgcaagtaaatgcttaatgcttcctaggtggcaggctaaagaatatgatcattttaaagcagtcatgctttgaaaataaacaacccatcccagctgtaagctttttgaaagtgtacaaaatatgtaattgatgactccctaaatggtttgcagctttggtatttgactgaattgtaaaccattagttaaactacatttcagttatgctttgtaggaaaaacactttcctatgcattgaatgttctataactaaggagcttagtaatctactgctaaaaatctcactgaaatctccagtttaagcgatttaagcaatttacagctcttggcaaatatttgttttgggttataaaacactttttttctgactagtaaattgttcatgttctttgtttccagtaaaatgggaataaaggtttcagtactcaaatactgcttattttttattggaaaaaaggaagcgtgggaggcttttaagagagtatcattatgagggtttcatagaaatactcagtctgtctcatttcagcatccattcctatatgaggtgacatggtaccagacttagttctgtatgttattcaacaaagtattttccactgtctggtaacatggcagcttctctcttcctcaccacccccccggattaccttggaagtgggaaggaaaatatttactttccagcagttttcattttgtgaaagatcacaaatgactgaaaatgctcacctatttggcagaacaaatttgatatttgtgagactaatcagttgagagtcataaataggtgcaaatgtttatgagttcccctcaaatttcaacatatttgtgaagatgcaaaataagcatgttagtaagttcaaacctaagacatacaagtgaaaaaaagggaacaacatactcaaaagcaggctcatcgtgttcccttaaaaccaacatatctgtaatgtggccacgcaagcttcatttgaagcctctccagtccctcatcccctggtttactcagcacacccaataccagcacagctgcaagactgcttagcatggggcaagctgttggggaaaatcttttaaatcatccttaggcaccgtaactccaaaagccggtgtgtggttggctccttccatactaataatcttgggttactgatgttcgtatctacccaaacctctttctcttccttaaagagctgtccttgaggccgggcatggtggctcacgcctgtaatcccagcactttgggaggcttaggcgggcggataacgaggtcaggagttcgagatcagcccgcccaacatggtgaaaccgggtctctactaaaaaaaaatacaaaaagccgggtgtggtagcgcatgcctgtaatcccagctactcag

SEQ ID NO: 203 - DNA, 1532 bp, Homo sapiens
tttatagattcaatgccatccccatcaagctaccaatgactttcttcacagaattggaaaaaactactttaaagttcatatggaacaaaaaagagcccgcatcgccaagtcaatcctaagccaaaagaacaaagccagaggcatcatgctacctgacttcaaactatactacaaggctacaataaccaaaacagcatggtactggtaccaaaacagagatatagatcaatggaacagaacagagtcctcagaaataacaccacatatctacaaccatctgatctttgacaaacctgacaaaaacaagcagtggggaaaggattccctatttaataaatggtgctgggaaaactggctagtcatatgtagaaagctgaaactggatcccttccttacgccttatacaaaaattaattcaagatggattaaagacttacatgttagaactaaaaccataaaaaccctagaagaaaacctaggcaataccattcaggacataggcatgggcaaggacttcatgtctaaaacaccaaaagcaatggcaacaaaagccaaaattgacaaacgggatctaattaaactaaagagcttctgcacagcaaaagaaactaccatcagactgaacaggcaacctacaaaatgggagaaaattttcgcaacctactcacctgacacaggacaaatatccagaatctacaatgaactcaaataaatttacaagaaaaaaacaaacaaccccatcaaaaagtgggcggaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttgttgggactctaaactagttcaaccattgtggatgtcagtgtggcgattcctcagggatctagaactagaaataccatttgacccagccatcccattactgggtatatacccaaaggactataaatcatgctgctataaagacacatgcacacgtatgtttattgcggcaccattcacaatagcaaagacttgggaccaacccaaatgcccaacaacgatagactggattaagaaaatgtggcacttatacaccatggaatactatgcagccataaaacatgatgaaactggaaactatcattctcagcaaactatcacaaggacaaaaaaccaaacaccgcatgttctcactcataggtgggaattgaacaatgagaacacatggacactggaaggggaacatcacaccccggggactgttgtggggtggggggaggggggagggatagcatttggagatatacccaatgctaagtgacgagttaatgggtgcagcacaccaacatggcacatgtatacatatgtaacaaacctgcacattgtacacatgtaccctaaaacttaaa

SEQ ID NO: 204 - DNA, 1905 bp, Homo sapiens
tttaactctccaggtgaccctaacgtgcagccactgctgcaatccacccccaatcaagccagtccccagtgaactgtgggcattcactcataactggcacagccatcccctgaaatctgttgcgaggaacaatactcaaaggctaactacgctgagaatgatggtttccagcttcatccatgtccctgcaaaggacatgaactcttccttttatggctgcatagtattccatggtgtatatgtgacacattttcattatccagtctatcattgatgggcatttgggttggttccaagtctttgcgactgtaaatagtgctgtaataaacatacatgtgcatgtgtctttatagtagaatgatttatattcctttgggtgtatacccagtaatgagattgctgggtcaaattgtatttctggttctagactgggactatgggcatgctaccatgcctggctaatttttaaatttattttgtagtagagacagtgtctcactatgttgcccaggctggccttgaactcctgccctcaagggatcccaaataaatatatttatttctaaattcattctaaatgtttgcaatgttaagtatgtgtggcaaaagaacagatacctttcattttttcaatcacctttcaaatattgttacaaaagcacatattactgtgaaatagtcgtaatttcagaaagaaattattcttcattcaacttctcttaagatttttaattaaactttttattttgaaaacattcagaacctacagtgcaattatcaaatttagaaaacttaacattgacacaatgctattatctaatatgtggtgaatattcaaattttgttgatggttacaaaattgccttaaaagcaactttttcccctcaacacaaaatccaatctagggtgatgcgtcgcatttaggtgtcatgtccccttagacttccttaatcaggagcagtccttagcctttctttgttccatgaggctgaaagttcgtttctgaagtgctcagggtctttttgttttgctgacgtctcagtttgggtatcacttggttaaggtggtgtcatccagagttatcttctggaaaggcaccttctatcttggataggaaggaatttaagagcaggcactaggcaactgtaaatatcaccccacaattccactgaatgatattaatattcagcgacgatctttgcccgggccaacaattattatggtggtttcaaagcacctgctcacaatgggggactagggagtgtctcaaagttatagtttcattttcaagaatgttctgatacctctgttactgtacctagatttgttttgagcctacgtttctttgaggtaattgaggggtgtcgactgagggcttcatgccccgctgctgtgagtgctgccagcaccatcccctgcctgccctctctctagacattgccctctgctgaagggacccaccctgaccatggtccctggagcagcctcagttgagtgatgtacttgtgataagagggccctgcccctctcaccccgattccgcacaaccttaaagggctgctcccactccagagatcttcctgtggggtggctgaggcttttcttttgaccacgtggaagcccagcctgtccctctgcccatctgccgctttccctccccacaggtgttggtcctgagagcattcccaaataaatttcctgaaccatcatcaccatagcaaagcagcttcctgggcaacctcacctacaacagccatttaagaataggaatttgaaagacattgagtgaaaacaatttataattcagaaaggaaagcttgccttataaataaaactattcattattacttagctaaaatagtcgtagttactttacaaatgtttacggctcccctggcttggaga

SEQ ID NO: 205 - DNA, 13030 bp, Homo sapiens
agtcgtcgtaggtgaggcagtcggcgctggcaaagagctgctgcgcggggagccagttatcgggcacatagtcggtgccgcccctgatcagccatgtgaagaccatgattgctttcccttcagccttccacctttgtaagtttcctgaggcctccccagaagcagaatcctgcatagtctgcagaactgaaactctgccaatgtgtcagtggtggacctgacctgccgtctggaaaaacctgccaattatgatgacgtcaagaaggtggtgaaccaggcatcggagggccccctcaaggacattctgggctacactgagcaccaggttgtctcctccgacttcaacagtgacacccactcttccaccttcagtgagggggctggcattgctctcaacgaccactttgtcaagctcatttccttgtatgacaatgaatttggctacaccaacagggtggtggatcatggtccacatggcctccagaaagtaagacccctgcaccaccagccccagcaagagcacgagaggaagagagaggacctcattgctggggagtccctgccacactcagtcccccaccacactaagaatctcccctcttcacagtttccatgcagaccccctgaagacggaggggcctagggagcctgacctcgtcatgtaccatcaacaaagtcccttgtgctcagccaataataataatacaggtataaagtattattgaaaaatgctaagagagtggatgttgtttgtagcacaaaatgcaactctactaggtaacgcatatattaattggatagacttagtcatttcacaatctatagataaatcaaaaccttatgttgtacatgataaatgtgtataattttatctgtcaattaaaaataaacaaatttactaatggtaatctaataaagtaatgtttaagcaggacattcagcacttataatttctgtgtgtaaatatctaaaatttttcatcttgaatgatacagagttaccacgtcatactgaatgacatagaatatcttctgtactcctaatttccctgttatcctagtaatagatccaaatagatacaagagtggccctgtttcttacacctaaataaaacttattaaacacagataatattacatacatgaaaaaggagaaaaaataaaaatattgggaaatgtaaagaagagctagaaataagacattaaaaggccttgtattttattaaaaactcttgtgaatgcgggatggtctaaaattttgagtctgatccttctagtagatcaagttaccaagtgtatggtctgtggtatgaaattaatcaatttctaggaagaaatgctattatactctgaactaaatgcaaacagaaaatgtaggattctctcaaagagaacattctgtaattcaatgtatatgtttctcacgtgaattacaataataaaaaatgtggcaagttgcaaagggctgtttcttatgttcatcaataaagacctataatcaggcataaaaaagtattctatagcaattaaatataatgtggtccttcaatctgttgatttgacttcacctaggaatagactttgaattatctgaaaaaataaatgcactaaatatcctttgagtaaccctgactatatattctttctcttgaaagggatttttagtaaatatatatttgataaatacaattcttgacgaataatgagggtgaagctctcttactggaataagattgaaagctttttgtgtctgaaaataaaggccatttactttctatactcaagtgaattttaaaatgtattcccaagacaacgtttttcaaaactaatatatagatgaaaaaactaattgatgtttcaaagatatactcagagtagcatagttaacaactacaactatgacaaaaaaacaaaaaacaagcaaacaaacaaaaaacaaacccataaacacaccaaaggaaagaaaagaaatactaaaagcatcaatggaacccagaaaagctacttttggaatagcttccagaataaacatcttgtgacatttatgctggtgaggtttattattgtatagacttcaattgatttcaatccaaatcaaatatagatttaaaatatttgatgaaatatatgcctgtgttacagataatatatgcttatttattttccaatttaagcataactcttaataatttttaaaacaattttaacatgcctttgacctgtaatgaacaactacagaacctgaaagttgattaaagattcagtagtaacataagtaatatttgtggtaaaatattgatttaaaaataatgtaaactacattattaaagctatttaaataggccatgggagtcagggaagacaaaaggtctaaatacttttctcttcaatattttgttttatggaaatatttttatattgaaataattgtatttaaatttagattttgtgataaaagttaatttaaaggtatgaactataaaaccaccacaggaaagaggataatgtttcaacagttacttgttaatgtaacagtttatacaataaaaagtaacccacagtataggatttttcacatttacaaagtgtcaagtgtttacttcttcatcaatatcgcctacattttcattatttaacatctttgcccaattcccactgtaaccaagtgtatttccatgcagtcaagttactacccagcttagtttgaggttaaatgtaaaaagctttgacgttttctgttctcagagtcctcctgcagaagcctttgttctgacctttcacccacacccccaggacttctattcactaaaaatgtggaattatccatgctaatcctggaattctggtcattaaaagaaaaaaaattgtgtatatcattctctgcatcaatttcaaaagttattcttcacacctatatttagagatgcagctgaagcttaaaaatattcaattgggcatataattttataaaaatagagcgttctaaaaagaattgagaatcatgtaaaatttaacctgtttttactggatctataagtcaatataaaatatttatttttctgtgtacattcccatatctacttaatgacactgtatcatgttgattttgtcttttttctttcattagcctatatattcttcatgagagtaaataaaactaatcgtgtcttaaatatcgacttctattgttattttgaatcttcctaagggtataggtcaaggtttattcattcttaccttaccttctgttttagcatttaagacagctcatagtagacattggaagattggttaaattgctatttaaatgacctagaatacaattgtttaagtaatttaccaacctttgcaaagctgaattatatttgtgtattctgtcaatattacataatattaaggttctgagatgtgttctttatctttattcagcttttcctatattctagaaaatttcaccttcttcataataatttcttagaaacttgtgtttttttttctttttttcttttttttttttttttagatggagtcttgctctgtcaccaggctggggtgcagtggcgtgatctcggctcactgcaacctccgcctcccaggttcgagctatttcccctgcctcagcctcccaagtaggtgggattacaggcacgcaccaccacgtctggctaattttttttttttttttttttttttggtattttagtagagacgggtttcaccatgttggccaggatggtctcaatctcctgacctcatgatccacccgcctcggacttccaaagtgctgggattacaggcatgagccaccaggccctgctgatactatggactaaattgtgtctgcccccaaattatatatttaagttctaaccctcaatctggttatatttgggcatgacacctttaaaaagtgattacggttaatgaagtaataaatgcgtatccctaatctaatatgactgatgtcttcccaagaagaggaagagatgtcagggatatgcaaacacccctgtgaggatgcaataagaaggtgaccctctgcaaacagagaagagaggcctgaggagaatccacacctgccaacaccttgatcttggacttccagtttccagaactgttacaaaataaatttcagttgtctaaccttctagtctatggctttcattatggcagcccttgcaaattaatacagttagcttgggccagctcacagaacttaacaccaaagtgaaagctggcaaaaatttcgaaaattttataagtggaattttttaaattatctaattttaaacacttccttattattgagtaggccatttcatttttttcaaagataaaaacaaagaaatatattttaatttgcagaagagcaacttatgttaactgaagaaaatgcttactgaatatgaagttaaagtaaaatgtgttaaaagagcctcccttaaattattttagctagaagcataaatctgtctctaaacattctgtgatagcaaaatgaatataaatagcatattatgccattataaatagcagttttaagtgatatgattaataactgttagttctggagtcatatgctaatctttgtggaagcagaagctggctcatatactgacaacctctgtttgccctactaataattcaacccctagttgctattgtcacattgaactacaaattcctaacagaaattactccaaaacctaggaaatgaaacagatgctaacatttcaagaaagccttcaggacaagaacattaaaaaatcattttcatgtagtgcttgaagtaaatcaaatctgctggtatttcatgtgcttaagcgatcacagctttcccagccagtgagtatctttaaaagagaggtttctgtctttcatatcaagtattattttgattaaaataatcatttaatgaactagatctggaagaagtcaaaggtcttttataagattatgacataataatatcttagaaaaatctcttatttactgaaccactatttattttcaaagaataggaaaaacattatgataaagctcatcgaaggtataacttatataggctaatagttatacttagatttcttcttctttgatttttttttcaaaagaaaaaaattttttttaagttttttaaaagaatgcattaaaaccagttataaattcttgtccactactgccaggaaaaacaataaatcagtagggcctcatgcaacttatttggaagtccaaaattgatggtaaatattataatatgaatttacatttcagaaaaatatatgttcaagtgcattgtgagtgaaaaaataataattttgaaatatgcatgtaagagatgtactcttctgagagtagaggtgtagggaacactaggttcagaacagaggaagaaagagtaaatttttaatatctagtcttggtttattgatacacaaatacagtaataatccatatctagagttttactttcaaatagatttaacatatctgaatattggatactttgcatgagttttgtgaaaagattgagttaaaggtttcaaagccatttgagaatttcctttgaacacactaaagggtatctgtgaatactggcttattatatcatggctgatttacaataatttacgtgttgcctttcttagctggaactgtatgtgccaggaatagattaatccttatggttacatagatcagcagcaagacctcccacgtggaagtacctatattcatctttgtcatctgaaaataactttattagaaaatatcacatatcttcttattgccagccaggtgactcataggaaagtacaagataactgaaatcagctacataatcctatagttcatgcactattttcaaacactttgaaacttactgttggtaagtaaatgtttatcttaattatatctaaataatctcttccataattactcttgtgattgaaaccttgttaggcctcagaagcctctcgatatcaaaataactcataaattcctacttttatttgcacctcagaacatgagacttccagcatcctggaaagttcaaggtgtttcttaaactctctaaagggatggtttgcaagccagtctctttcataggaccaccataggccattctttctctaacagtccgatttaatttgtccatgacttctgcctttatagtcaactggaatgcctttactcttgctactatgtactattttatgctgacactatctcctgatgctctcaaagtcatcaactcttgggctgccagagtcctgctacattctgtgcacaactggtgaaaaatggccttcaattttaccctctgctgtgttgccatctgggccctacggcagcacaattcctgtcaagtgttttattaattccctcataaaaacaccattttcatcttcagctgtctagaagctccaaaccagttcagtgtccagtaagcatagacaccatgccaccctttgagcctttacattctcatcgtcgcaagttggatctcccaaacaaaagaaaaccatccaactttcttttccctcttcaacaaaattcaaagcttcttggcacattatttcaagcatacagatgctggtgggagtgtaataggaagtggacaaaaggaaagatatttggaccaagtattttatcctggctccaccttatgaataaaaggaaagtagacattgtcaggaattcactgatgtagcattaaaaaatctattaccaagagatcaaaggtagctagcaggaaataagataaaggactgacacccaattgtatccacagggcaagtgtttttattactaaaattccaataaaaaattagtgtttctagaaaatagatatttatatctgtgttcaggcagattaaaaaatcaatgagttttaaaaattacatttaatgaacagagtgatttatggtttgtttttgctttactaatgtgccagctcgatgtctctaataacaagtctggcttgatagccctgctaacaaatccagcttcatctagtacaatagaatatattttttctgaattcatttccatttactatctgctcagtttcttaaattagaaaataacttgactaattcaatggacaatggattggatatgaatctaaaatgaggcagtttcctgaagcccagacttaactgtatgtggcaatttgctttggggcattgtgcaagagaaggtttctcaaatttgtctaataatagtgaggctcttatagtaaatatcacagaatgctttgttaaatttgaagttcaacacataagaaaatgtccagaagaacacattaatgtccagaagacattacctaatcttgtcttttagaaattatcagcaacattgtgttgctgataacttctaagagacaagattaggttgtttgtggacatttatggaatagtcagtacaaatgtattgaagagaaatggtataattctgattgtgacactagattactattctgtttcttttaactttcttgcttctcaatttttagtgtaaaatatgaggggggtatattaaaaagataaaaggatctttgtaatcctaaggagctaggaagatagtctactagaagatataaatatagggattttgaaagctctgtgttcagaaatggcatcaaagtaataaagttccaatagagaaaaggaattacaattcacattacagtatttagataggactgtaagagaaataaatagctcttccttatttctcgtttaaaatttcagacaaatttgaccttcaaagatatgtctgaacaataacaatagaacataatagaaaaattgttctgactgcaaagaaatagacctttcccaacagtcacttcaaaatgcaaaccagaatgtatggtctatattgtttttaatttaatatatctatgtgaacaagcatacttcttcctcattttcattgcataaatttttacttggaatgcctttgaagttaaaccaatgtgcttcaaagttacatgtatgtatggtttttttttttttaccaactgtacatatgtctacaatttcccaccaaatatggtatcaaatatgtagaatctgagatgttataaaagcattcaaaatcatattttcctcataaaggaaacacaaaattgaccttaataggatattattgaggaatattttaattatctggttataaattctaaggtttcccaagatttagaaaacttactcttggatggcaaaatttactctaaagtattttgcaattgtgtgtgtgatagtgtttgaagtgacagggaaacctatgtatcctggaaacctatgtgtcaaggcattgttttctggatcatttattggcatatccaaaggcttgggaaaaaacttaggataaatagagaataatgaactttttcagaaataaataactaagattactccatgcaatagaatcccaaatgatttgaagttagactttattattagttatacagtaaatgtgataaacaagtttaccctgtgtgatacaaaaaataaaaaactgcagcatgaccataattttttctttatagataaggggctctcatgcttaaagtctgattaacatagccacatctgatttcaaaatatagatatgcccaatgaggtagttcttcacaatgggaatcgctggttaggtgttggttacccaatttcttttatttaaagtttaatggatatttgatgccatatagacaaaacatttggaaggagtttcaaattcccatctggagataggtgtcatataaaacagcctaaaaaaaataagaatggtttaaaaggcttgcttgagttaactaatggttggcaggtccatttgccaggcttattgaatcaagctttaccctcctttaaatgaggggtctgtttttccttggcaggaatgttttagattcagcatattaaaagctgcaaatatttgtgttgggttttcctttgtgagctatctacagcaatgtgagagagcgagtacatttagccacagcaggaacttcccataaaatcacagtaaatgactgtgcttttcttataagccacacccttcctaggcatttctcaaatactttacatagaaatgtgttcactttaacaaaaatcaataaatgcaaatattatttcatttgttttcattaactagtagaaatagcagtaatatattgttaattatattagcaggaccctatagcttaatgcaacaagtcaaaaggcatctggccattcctaagtattgtgactgatggagtaatatagacaaaaaaattggataaccttggaaaagtatgaagatgtgcagtttacaaagagctggctgaaaattaaggagaaatggcagatttgaaaccgtgataggtataaatgaattgtggtatggcctgattaaaaattttacttcatcatattcatactggagtctacataatttgggaagaagaaatattttgtcaaaactgatatatcccataaaatataactaacatactttgcagggaagcttaaggaaggcctgggagacaaaatggacaacaaatgtaacaataataatatttaagtgcaataaggttttttataatgtcattttttaaaaaataaagttttttataatgtctacataagggaaatcaacactgcattgactattagaattagtttgggggtctaatggactattcctgaaatttggactgaggggtcagattattaatggtagacctgaatttgtctcaaagaacaatgttttggaatctaataaaatctcttcagatactctctatttaactgattgcttgtttcaaaggtcaattcattttggaaaaagattatagatttttctcacattttatgacaacataaatgttgacaacttatgtttttgttaatgtatagtgttattcattatcaaaaacaaaaacaaaagcaagctatttgctaatagtcatgtcacaaatataattattatacatagaattatacagacccagttgcaatggacctttcttaacttccttataatttattatccttttaaaacacaagagaaacccatttggtatcttccacccatagcttgaaagtcttatatttatttgcttattagtagtacatttccatctgatacatgtaatattaggttgcattattctagatccaatttttccttctgtaagtgaagtttatgaaataaggttagttgttctagtcacaaatgcattgtacaatgaaaagcatggcattataactcactatattttcatgataagaaaaaagtatgcatatttattgataaacgtattttaagtgtattccttatagtgcgggaagtgcaaagatgaatgaaacactctagtaaagagcagtgtgcttcaagtttttctgttgacaccttgtgtaaaataattttgaaagaacttcagccatttcaactgacagatcagttgtaaagcatgtaacttttggcacattttaaatgttgacattctaaactataactgttatatcatttttaaaaattcacaatgaaacataaatataaaagcaattcaatatctaccacattcatttaaaataaatgagttcttcacagcggttggaaatggtacttcatttctttctctccttgaaatcatatcccagtccactacccacccttcctgttatagaattttattctattaaaatttatttttatactttaaattatttttagtgataccctgaaagagagccaggaaaactcattatatagaaaaaaaaaggaataaaggtagcacggagcaagaaagaagataaagtgacagggaaatagatcattagatgagcacgtaacactttaaaatctgtgaagttatggtgtctgtcatttattattttttttttttgcagacgtgtgcattgctgtgatgtaaatctcttctaatcttttctcgtgaaaatctttaccctgctctaaaatgttttgcaacaaaatttgtacacagattaacattttattttgaaagaatcctgtccaaatggcggcaaatgaatgtttttaaaaagttcttccagattgcattatcactacaacttttataaaaaataatggcaataattatcatgttgataataatagtggctaacacgtctggaaggcttactaagcttcaagcacgaatctatacattacctatttatacctctacttgtagctatctatttatatagagtgtccaccaggtctggaaacacaaacgatatataataaatgattcactgatatatattagattgtaatactttcaaaaagtaatatttgattttctagagttatgatcaccttacaacaatcatgtaaggtaggtactatgcttaacccagcttacctatgagggacctgaagctcagtcagtttattaactttaacatgtgattaaaaattgattaattcaagagttgaatcaggcaggctggttttaaagtttacactcaagatcaaaatgcattattatagactttgatatatattttgattcataattcatcttaaacaaaagtaaaattttatttaccctatattatttaatgagatgaagaaaggggaagctcacatgtccttttgaaaggaggcttggcaaacatcaatgtatccaccatccctgtccccttgtttgtggcctaagagattgttacaccttccaaaaatgctctctagtaagattcagaatgggtgatacaacacttgtgttttttgtgtggggagggagacgtaggtaaaagaggaaaaggaagattgtgaaaagagaagtggaaaaggataactagctggaagcttgtagcttcgaagttttctctggcagatcagttttaggaaggagatcaaatcgagtttgagaatcaggaaattgatttctgtaaaagaagctgtttctgcctatgtggtaagggtatggataactcacttcataggtccttggtctagggaaaagtgtaacacaaagtaaatgatgaaactcagttctatcaaaaatgaaaatgttgttgcatttgagaaccattatggtgggcaatgtagtaaaaaggataagacattcatcctactttaatgtaaaacaaatttgaaaagaaaaaatgataagtaaagaatttcatgaaggtattatcgtcactgcatataatatgctttctactaaatttcaatggcagtttatgtttacctaccatattaaataattgctattacattggtatcataattcctcttatgagaggaactgttctttctgataaaagaaattaaaaatccacttagagtagagcagactcttggtcataaatgttatcaggtgctcaaatatcaggggaagaattctcctctccatgaatcaaattagaaaatgcattacttttactcatgcaacagaagctggaaaatgagtgacaaaaagaaagaatggggtaaagacacaatgaagtcaaaaagagagaggccaaaatagattattgggagaaataagtgacatctaaaaatggtcatttctactatttgatttgaagttgtttgcattggtagtatgtgaacctctcccatatctgctatcatgtaaatctttaatgaagtctactgtctgtgtgagtgaaattttttacagagatcaacaccagggctgtttcagggatcaatgcaaagcagaacaactatatacactaaagaagagtctgattaagggcaaattaacaaggacattgcagggaagcatattcatgagggattccaccattttacagaaataataataatatgaaaatcttttagtgatgaagaagtactggtagactttcatggcacttaagatgagaccctcaaggcacatgatcaaggatgattaccagtacttacttatttaagccagtgtcatatttaagtcccagctttattttgctgtggaacatgtaagttaacataaatgacaagtcacactgacctcatttggttgaattttaattactttaattggagacactgctcattat

SEQ ID NO: 206 - DNA, 1365 bp, Homo sapiens
tgcagtgagccgagatcatgccactgcactctggcctgggtgtcagagcaagactccgtctcaaaaaaaaaaaaaaaagattaaatgaatcataagaatggggccttaatctgatagaattgtggccttttaagaagaggaagaaagagaaaaagagaaacatctgtctctttctctctcttaaccgtgtgaggacgcagggagaacgtggccatctgcaaatcaaggagagagtcctcatcagacattgaccctgctgtcaccttgatcttggacttccagtgcccagaactgtgagaaaagaagtgtctgttgtttcagccactcagttgatggtgttttattatggcagcataaacagactactgtaggagcttagactctgggtcctgatacatatcggatcctgatgcttatcaaatccaggctccttccttgaatgtgtgacctttggccaggttctcgacttctctatgcctcagtttactcctcagtaaaatggagataataatattacttatcacctcagtaaaatggagacaataatattacttaccatctaggtttattttgagacttaaataacttaatgtatgtaaagtatttatattgtgagtgcaaaataaattaactattataatagtccctaatgtacttaatatctaactgcaaacattgccaagttttcttcttgtccaaagtcacaacagttttctttaggaaattttccatacaaagtggggcacattttcactgggttctttaagatgagataataaaaaatgatacgttagaaaattttccttatggcatcagtcttctctgacagattgcagcttcataaaggcaaaaactcttgattttctttttaacccacataagcccttaataaaatacccattacatgtagttgaagtaagaaaagctggaagtgaggaatggaggaaagaagaaaagaggggcacaaaatatttcattaaatgttttaaaaatccccagaaattcagaatacatgaatataggctgacattaaagcagatgtacgtctcgtgcagaacacacagtgaggaaacaaaatggcaagagcaaagctaaagaaaactaccaaatttgcattttcattaattcagccttaaatgtaactttgtgtcactgaataagtgacttacttcctaaacatgacggtcagacaggaaatcacttttcttgtgattagcataatgcttatattgtttttttagctacagtctaatcattacaaagaactactcgttgtgtccatattaaaattaaaagtaccttgccataacaaaagcacattctaagcctttcgaaatgtcaacatattaaaatatattaaagcaa

SEQ ID NO: 207 - DNA, 1266 bp, Homo sapiens
tgacacgccgcgcggccccccagtctcccgcggccgctcccccaggcatggcacagggcctcgcctcactatggcagcagcacggcacagcacgctcgacttcatgctcagtgccaaagctgatggtgagaccattctaaaaggcctccagtccattttccaggagcaggggatggcggagtcggtgcacacctggcaggaccatggctatttagcaacctacacaaacaagaatggcagctttgccaatatgagaatttacccacatggattggtgttgctggaccttcagagttatgatggtgatgcgcaaggcaaagaagagatcgacagtattttgaacaaagtagaagaaagaatgaaagaattgagtcaggacagtactgggcgggtgaaacgattaccacccatagtgcgaggagagccatcgacagatattggcccaccgccgatgggcgcctggttgaatatgacatagatgaagtggtatatgatgaagattcaccttatcaaaatataaaaattctacactcgaagcagtttggaaatattctcattcttagtggggatgttaatttggcagagagtgatttggcatatacccgggccatcatgggcagtggcaaagaagattacactggcaaagatgtactcattctgggaggtggagacagaggcatattgtgtgaaatagtcaaactaaaaccaaagatggtcactatggtagagactgaccaaatgatgattgatgggtgtaagaaatacatgcgaaaaacgtgtggcgatgtcttagacaatcttaaaggagactgctatcaggttctaatagaagactgtatcccggtactgaagagatacaccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgaaagaagcactgtcgctctatgaagaacagctggggcgcctgtattgtcctgtggaattttcaaaggagatcatctgtgtcccttcatacctggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaa

SEQ ID NO: 208 - DNA, 3297 bp, Homo sapiens
catcactcacgctcgggagtgagggagccatcgccaaacagcaaatcatcgtcaagtcaattggcctcgacgtgcctccaaaagggagagggatgctcccttggcttccatggaaaatattctccaagcaagctcccttgccccaggctccatcttcttcatctcctttttttttttttttctggttttagcgggaacgccgcgaacacacgtattctccagggtcctcacttggtgctggatttcaccaacagcagcaccacaggggaggtcagaggaccgtcagtcaacaggtgagccagtggaagtataaacattgccacatcctctcttcctcctgccctggagcccagagaggttttatgtccatgtcatttaaggaaaggagcccacgagcagaagagaccgtgtggtttctattcatgacgttctcatcattgtgaaatctctgcaagaacgacatggaatggaaacaggtattggagacgaaggcaacacgttgtcgtctgttctacttctgcgaaatgggcacattcatgtcttaaaatgatgcagactaaaacaaccgagcatcttccaaggaaatctaatcacctgctgttcacctgattgccacttcctagtgcttctgtgacacatcaccaccagccaggtgaccttcacctagtgtctgaatcagcaccacgctctcctgttgctattcagggagggccttggcacacgggagctttacagtaagtgttactttccatctttattttaacttcatattttctactttgaaaattactaacagccagcatgcatcatggacatcgtgttgcttctatgccctgatttgaattccttatgcattatggacatcgtgttgcttctatgccctgatttgaattcctagtgaatgaacgtgcggtcagctgtgcagaacaaggtggagtaggaaccaggagagggtgtggagctgggaggaaatcgcagggaccatgctgcccagggcctcctgaccccctcacaggatgctgtttctcccgcagggatatgaggcgctatttttattcctctcagcactattcatttacaaatattgtattgggttctgtgccaagtttaaacaattgatgaaatgtggggtctcaggggacccccgagacagaagccttcctaaggaaagacggcgtgaagctgagcggggcggcggctgtttctgggtgggggcttctccctcgtcggggtgaatgagccccgagaccctggggtgctccctgcattctgcttttccctccacgcctgtgttcatccaaaacgcggcagcagccttgacagatgggaagccacctgcgggccccgtgcagcgccgctgcctcccctttcccgaacctcctgcctcctgacccccaggggaacttttctgtgtcagcgtcagcacctcgcagggcgggaacgtttgcttgagtctatgtggctcctgagaggcgacctctgtgttgggcaggatggaggtgaagcacggaggtcttctctggcgaatctcatcactgccaggaaggcacagaggtcaggtcatgagcagggccccaggcagggctccctgtgctgtggagccacagagaaatgccacctcgctttaaaatgaggccaacctgtgttgcctcaagaaaagacctcattggttctcatgaccaaatccgtttgtaaatatttatggcatagtgtgggctgtatgaacacaaacctaattttagaagatattggaagcagggctgatcagtatttttgtcaccgcgcgggacttttttgaattcctaaagctatactttcgggtcagaagaacattgcaatgacacaggacaaaagcagtattttggcaaagattgatgaatgcgcacaactgaatttctacgaaaagaataaattgtgtaatgaaaacactgctaaaaattaaagggacgtggggaacttttccattttttaaaagtggtcatattttaagaaatattttatgaagtaaaatcacattttaagtccaaaggaatgtgtccttttaagtttaaaatcacattaaaaatgttaaatgaaaatgttgacagccacgtttacaccaagcacagggaaaaggccagcacctccccaccagctgtgcagacacttctttgtcaaaaatgtgccagagtcagaaaataatttgataattatttaggaatctgtttttcattttccttccatgtcaaaagtgtattttataataattatgccattttgactttaaaagtacattgtactttttgctgaaatgccagttcagggagcttagtcccattatgtatggtaactggtggctacaagtttatattcactttggaaaaaagttataattgtcttctagtatttggatttcagtttgtcagagataactgattgtgaacaaagtatacgctttgtcctctttatcaaactgccagcattctgcagagctgaacgcattttgcttggttgtgtgtttattgtcaaatgatggaagtggtttttctccccctagaatcaagcagatcctctcttgggctacccaagccccagtggtgaatgggcttcctttggcaggggtgtcgccaggagaagtggttcctctcagttcccggtcaggtaaacagtggctgccagggtgagcccaattattaatttaaaacacccaaaataacagcaatatgaaagatcagtaactgtcttaaagtggccaagtgtaggagtctgtgtgtaacatggtgaccacagggtgcttcgggacattctgtaggtactcatttgtcccacgacatttgtttagagctatcacggttattttttcaagtacattctctttccagttcaaacatatcatcactaattagtgtgtcttggatttgatttttaaaaggaatcttaacatctgaatatagacgtagaagccatacttcaaatacaaaaaaatcttgcattgtcaataagaccactggagtcaaggtccagagagaagccaacagaatcagagaccataatagacttcatgctgtgttctgtctcagtattaataatgctccttcagaaaccacacttccatagaatttgtctacaaatagcacatgctaaataattgtccatttgtattaaaaagagcatataaatatgtagtgtaatattatataagtgcatgtgtatgttgtgtgtgtctgtatacatatatatatttacatacatttccatcttctgatcaacttaaaataacgtgctatagaactgagctgataaaaatctgacaaaaac

SEQ ID NO: 209 - DNA, 3079 bp, Homo sapiens
ttgttcattttagagtcttacgtttgaagctcaagccacttttctagccacggctataactaataagcacctgctgttcagctccactgctctgtacttccttatcggaaactgtctcatttcccaaacaggaggatgtaaattggcaccatggcttccaagacattttcaagaataagttgggctttgcacataaaaaaaaaaaaagctccctttataaattttattttgcatttctccacctagaggaagtactctgtttcttctttggaaggtgggtttttagctgaaaaagatctgacctccacaaattgcccatagcatccttcagccaccatcccaaggccggggaaccactgatctgctttctgcctatctctataaattagtttattttctttagaatttataaaaatggaataatgtgctatgtgctctttttttttcttgcttcattcactcagcataattattttgagatctatcaaagttgttgcctgtatcaactgttccttccttttaatgtctgagtagtgttccacaatatgtttacacccagcttgtttatccatttacctattgacagacatttgggatatttccactttttggctatcacaaattaagtactcatgaacttttgtttacaaggatttgtattgcatctatactttcatttatcttgagtaaatgtctagaagcagaataactagatcatatggtaggtataggtttaactttttttttttttttttttttttttgaggcagtgtctcactctgtcatccaggctggagtgcagtggagtgatctcggctcactgcaagctcggcctcctgggttcacgccattctcctgcctcagcctctcaagtagctgggaccacaggcgcccaccaccatgcctggctaattttttgtatttttagtagagatagggttttaccgtggtctcgatctcctggcctcgtgatccacctgcctcggcctcccaaagtgctgggattacaggtgtgaggtttaactttttaaaaaagagaaaaattatcttccaaaatggtcacacaattttatattccaatcagctgtgccacacatccatatcttactactcattttaatgggaaagcatttcatctttcaccataactgtgatattacttgttgcatgttttttttcacaaatacatattaccagggtgaggaggaagccttctactcctagcttgctgaaagcttttatgagaaaatggatgctgggttttgtgaagggctttttctacttttactcagatgttcatgggacttttcacttttagtttgtcacatttattttggattgttaaactcaccttgtattcctggggtaaatctcacttgctcacttgttcatgatgtatttttaaatgttgaatttaactggtaagatttagcttaggatttttgttcttccatgctcccgaagtctgtagttttctcttcttataatgtcattaatttttttttttttttaagtcagggtaatgtcagttcactgaatgagaaacctcttcagttttctacttgagtttctatgtaaatagtatactctcttttattactgttagtagaatttactagtgaagctatctgtctctaatataatcattgaagggaggtgatcagctacaaattcactggccacatcctcactcctgtgacaacaaaacagaagattccacttcagcccctgattgactgggggccaagtcttcacttcaccctctgatgggtcatgggccaatccttcctagggtgtaaccaactggacgcctctaaagggcacttagggatgttaccaaattcttttatcttaataaaaccctaaagaacattgtaattcggggggttcttcaggcacttgcttgagcctgttcccactctgtgaaatgcacttttgcttcaataaatctgtgcttttgttactctgttcttttgttgctttgtttatctttcattgtttcattcttttgttgctttgtttatctcttggttatcagttttctatgacaatatatatgtttctgatctcatccaattctgtgtagacagcaagaccacattgttctcagcatgcatctgaaaccctgagcttggcttttctgagacatggtgtacacgtgcagttactcctcttgcccacctttggtttcttatcaaaagtgtgacatggcattggtcttgttcttgaagctcatctttgcacacaaccaatgtggatgctctctgctttaagtgtctctgaatccaaagagaacatttaaggagactacagactgattccctgtgtccttcaagttaccttcattctgttgtaaaacctatggcctctttatccactgacagaaaccctaaggacaacccaggtatttctagaaagtctgtggttcctaagtgaggatgaaaggaagaggttgtgaaaggtgagggccagcctgcggctgttgttcagagaccctactcaaggccaccacgttctggagcgccctccccattcaaaaacagcccatgcacacgactatgcactagcttgtctcagtgcctggaattttccccatgctttgcaattgcaaatgctttcctgagggagtggcagccaggcagagggggaacggcagcctttgtgtctgaaaagcaaagttttaactggaacttcacttccaattacctgatgatgaaaaataaacacaatgaaatacttaagtataaatcaaaccaaacatgaaggggatgtgagtgctaagaacatctcagagtcactaattctggcatctccttcaagttctttcctcccatgtttccagtctaacacagggtctccttgctcaacaagtcagatgctgagagactgccagcacagcctccaacatatcttgtgattcacaagaccttctgaggacatggagaagaagtaaatgcagctcccagttgtggctgtcagaaccatgggatctcaaggcactgagtatgctttccttcagaagccgaggaactactcagtgtgtctcaggactctttgatatgacaattaactcacatag

SEQ ID NO: 210 - DNA, 774 bp, Homo sapiens
ggcgcgggtgttcgcctacgtcactggggcgctacggtgcctggagctgggcggtcttctcgtcagagtggggactggtgagagcgacctccccgccaggtcctgtgtgttgccggctgaagaagggtagctgaaaaattcagacccagcacagtgtttatgttggtcaaaaatagaaaactatggcgcggccgaggcgggaggacccttcaggccaagagcagcctagcaacatggcgcaaccccatctctgtagtcctacctcagccccccagctacttgaacccaaagattcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggtaagttctcagcgaaatccatgaccttttcctttatcttctggactctcaatgtgactgatgaaagttaccacatgctctgcagggggaaatggtttagcatgtgttactacatcttaatcacatctttgtaaagccaggagcattttacaagtcatgttacagacattgtttaaacatagtctgtatttaccaaagtataggacgttgtatcatctcatattaattagttagttggctcaaaatgagtgctaatgacttagtaattcagtgatttctgttagctttaaaacctttatttcagaactatttcacc

SEQ ID NO: 211 - DNA, 1860 bp, Homo sapiens
ggttttgtatcctacaactttactgaatttgtttatcagttctaataggttttttgtggagtctttaggtttttccaaatacaagatcatatcatctgcaaacaaggataatttgactacttccattccaaattgcatgccctttatttctcctgtctgatttctctagctagaactttcagtactatgttgaataacagtggtgaaagtgggcctccttgccattagcattttttctgattttattttcatttgtaataaagtgttattattagtagtagtagtagacttaaaataggcatggttaggattggttgactttcactttcagtttccagcctctgttatggtctcatttagtagtatgtcagatgcatttgcagtaaatagacttctcactttaacttgtagttaagtctggaagataaccggcaatcaccctctctctccttgtgttctactaacacaaggaatgaattcttgtgttcattcttattaaaaaaaataatgagacagtttaagcaaggggccaagtgatatagatttatttttgaaattctataattgctctttgaagggcaaactacaggatgggagaaaattttttgcaagctattcatctgacgaaggtataatatccagcctctaaagggaacttaaacaaatttataagaaaaaaaatcccattaaaaaatgggcaaaggacatgaactgacattttttaaaagaagacatacatgtagctaacaagcatgtgaaaaaaagctcaacatcactagtcattagagaaatgcaaatcaaaaccacaatgagataccatctcacaccagtccaaatagcaaatagctattattaaaaggtcagaaaataataggtactggcaaggttgcagagaaaaaggaatgcttataacactgttggtgggaatgtaaatttattcaaccattgtggaaaacagtgtggcaattcctcaaagagctaaaaatagagctaccattttacccaggaatcccattactgggtatatacccaaaggaatataaatcattctgtcataaagacgcatgcacacatatgttcattgcagcactattcacaacagcaaagacatgtaatcaacctaaatacccatcaatggtagactggaaaaagaaaatgtggtatatatgcaccatagaatacaatgcaaccataaaaaagaacaagatcatgttctttgcagggatatgtatggaactggagaacattatccttagcaaactaacacaggaacagaaaaccaaatactgcatgttctcacttacaagtgggagctaaattatgagaacacatggacacatagaggggaacagcagatactgggacctatcagagggtggagggtaggatgaaggagagaattaggaaaaataactaatagatactaggtttaatccctgggtgatgaaatctgtacaacaaacccttatgacacaagtttacctatattacaaacctgcacatgtacctctgaacttaaaataaacttaaaaaaaaaaagaattactaagcatgctttcctgggtcaggttttctagagacataccctgaaacaaggatttacatgcaagtaatttattaaagaaatacttctaggatgaactagtaaaggagtggaaaaataggatatggaagaggaaaaaaattaagtgtagtagatgctgttagtggctgtatcactcagggttcttcaacaggaacagaaccaacagggtgtggtgtgtgtgtgtgtgtatatgtgtgtgtgtgtgtgtgtgtgtgtgtgtgtgtgtgtgtgtgtgtgtatacacaaagagtgagagagggattagttttaaggaa

SEQ ID NO: 212 - DNA, 2135 bp, Homo sapiens
tcttaaatgatttgtgcaattgcaaggcacggcagtgtattttcagtgtctaaaatgtgcttgtaaagtttagcacacgttaggtctccttggcccgaccttactggccaaagacattacagacaaaatctctgtgtcaaattaaagactacaaatgtaagaatgctttgtcagatgcccacatgttagtaaatgcttgctcagtctctgcttactctgtttgactacatttcgtttttgtacagacaccatcaatcacggaccctgtttatttaaccagggtgagatagcttcttagcctcagttactaagtctcagcagctgggccttggagacccaggtgaaatctcttctgttggttaaaacaaggagacaattaagacacttgcttctcttctaaattagataataaatttccatcaggttagtgtttcagggtttcactcaagttttttagactctaagcatcttcagtttttcagcggatggacagacaggaccagaacctggaggagaccactggggtgggttaggtggtgactgaggacccagagaggaggagctgaggggtggtccaccatcccgcggctcctgctgtgtgtgtgggcgtgtaggtacaagtagatgccaaccagctacacagtcttggaaatgaaaagagccacttctgacacacacaggaagtgacttgggagcttggaaatgtccttaatgaaaaccccaagaagcttgttgggggtgcaggcatacgcttgggtaccactgggcaacacaaacacagagcaaggaggtgggagtcaccccacagggcgtcaggcaaggcgaccattggaccccgtgacctcaccctgtactcacagactccaacactcaacaccaaaagcagctttaaatagtatagattttatggaagtcttcacgaggacgggagtacagagcttgaagcatgagatggattaactcaagtatgaaggacaaagaagaaagagtgactgatagaaatacagaagagacaccatttttttgagccttttacatgagaaaaaaatattctgggaagattccatttccccttccagaattttgttttcagaacagaaatccagaagttatcttttactcatcctacttcctcactcacaattctgtttcatttctgtcccgcaggcttctttcacgaggctgtaattactggcagggacaccttacctacctcctcctctctctccaaatactgtccttcgaggcctaattgaaggcctctctcctccaggaagtcttttctgaatgttggaggctctgataaccttccgggtttttccctccctaactctgcacctacagcagttcggcattacacaccatcctgcgttcttcatttgtttattcaaccacgttttagggattttgaaggtgaattactgttgctgtttccatcagcaataaacagacatatagacacatagttggacacatttggacacgtcaaataagtcttaaaggccgtggaatgagtctagttatatatgtttttccattctagatggcatgaaatttaatgtctattcaaaagtcgaaactataaaactccactaagtataagctttccagataactagtttattttctccctggaacttaaaataggaggaggaaagggaagtctaattctgagaaagtaggatctctttcggatgttttgtccattaaatagtgaatattttattacactaaaaaattctatgcatgtagacttacagtaagtactccatatacattttaggctgataaattggaataactggtattctaaggggcataatttcctaacataaggacacagttacctgtgctacaatgaagagattaaaaattggttattgaatgctttatcttaaaggagtgctgtgtagtaaagaagattcatatttgctaagctctttaaaaactgtaatgcatggtgcaaatgttacatatatagacgtacattctctttgcaaagagctttcacaaaggacaatgtactatgaagatggccacttggaagtaaataggactttgaggcgtttctgatgccactgtagagaatgtcaacaatggcagtattaaatttgctgttttttattatttatttc

SEQ ID NO: 213 - DNA, 3879 bp, Homo sapiens
gtaaaagcctcagccttttcccactcattttagaagggaaagggaagctggagtgtgcagaaatcacacagtgaaatagaaagcaggaatgagaaatgggaggtgccaggctctttttaacaaccagttctcatggaactaataaagtgagaatgcactcccctggaaagtaatcaaaaatgccccagtgaagaaaagttctgaaccagatagttttactggtgatttctaccaaacatttaaagacaatcaacagttgacttaataagcccatttcattaacagatgcacattgcatctattaatgaatcacttcacccatggaatggcaggctccagaggggctatgaaatggtggtgcctcaggcaatcacctgccgtcatgtcacccttgaaaggttgaatgttttgtccatctggtggaggtgagaattgaacttaaagcctagtgaagctatgtatttaccttgcccctctttgcagggacagagtcaatctctggttccccctatatttctcaggatgggaggaaatggggatccttcttcctatatcatggaagggagaatgaggacctcacaaaggaaagaaactcactacatctgtcagaagtaaggcctgcctgaaatcagtgaggctcatcgcagcccaaaattcaggcagtgagaaattcaccaaagtggcctttctgaggagaattagagaaatgtttgaggctcatagataggcacctagaaacgccatgaagaaagtcacaaataatgcctcaaatgatgtgctcaaatcacgctagagtgaaaaaattggaaacaccacctttaccatgaatttctctttttttttttttttcgagacggagtcttgctctgtcacccaggctggagtgcagcagcacaatcatggctcacagcaagctccacctcccgggttcatgccattctcctgcatcagcctcccgagcagctgggactacaggtgaccaccaccacgcctggttaatttttttgtattttcagtagagacggggtttcaccatgttagccaggatggtcttgatctcctgacctcgtgatctgcctgccttggcctcccaaagtgctgggattataggcgtgagccaccacggccagcctttaccacgaatttctaatagctccctaggccaaggtgttttttctctcctctgtctcctctctcgtagcaaattcctaccgcacacaaacagggaagaagagcccttgtcacttgtccagaacagtgtgggagctgttgggtgctggctgtgggaaggtacacaccttgacaggtttctggcctggagaacgaggggagaaagttccctccagggtgcccctcagtttgggcccttaaggtaatcagagccagcggatgttgagagtttgagaggttcagtaaggttcctagagccacaggacaggagggagctgttggtggttggggagacagttggagaaagttccaggggagttccagggaggagccgatatgtagggcaggagagaataggaaaaaaaagaatgggtgggtttgccagcattcctccttccaaggattctaaggaaaagagtggaaactgcggagacaattctcttaccgtttctcctttcaagatgcacagagagtcaggcagaagggacactagagtgcaggaaaagaaggccgcagagacaggtgcagaaggttggagggaggaaccactgagaccagcgtccgtggaaagatgtccaacgtttgaccacggagagcaacaggccctcagccacagacaggagagatcgggattgacaactatcttcagagctcccagtctgcgggcattgattgactgattaaggcggagtttcactcctgttgtccaggctggagtgcaatggctcgatctgggctcactgcaagctgtgcctcccgggttcaagcgattctcatgcctcagcctcctgagaagctggtattacaggcacccaccaccatgcccagctaattttttttgtagttttagtagaggcggggtttcaccacattggccagtctggtctcaaacccctgacctcaggtgatccactggccctggcctcccaaagtgctgtgattataggtgtgagccacccaccgcacctggccatcacggggatttagaatcatccccttccccaacaagtgtggcctggagcctgcagaataatggagaccaccaccacctggctcagacccaggtcttccaggctggctcacacttgggtaaggttctgccaatcaggtaactaagcccagggcaagtacgtggttttcaggtcctgggtttcctgctgtgttttaaatgaccacacctggaaccatctccttactttctttctagagaattcctcccaggaaaatcaacaaatcaatgagaagtcaaacacttacccagtagttttgcacagtagagcacctgaggaattcgtgaaaaacaccaatgcctggccccaccccaggtgaattagaccagaatttcggagggtgaagcctagacatggagggtttcaaatgcttcccaggtgactcgcatatgcagccaggctggggagtccttgtattcaatctagataaatagcaggcatgcggcaggtgctgaaggtgcaaagatgaacaaggtgaggatcccgctcttgataaactcacagcttagaagggagatgagcatccaaacaaacaaacagccaggtgtggtggctcaaacctgtaatcccaacataatgggaggctgaggcaggaggattgcttgaatcaaggagttcaagaccagcctgggcaacatagtgagaacccccaccaccccaccccccaccacccccaccatctctacaaaaagaaagaaagaaagaaagaaaaaaattagccatgtgtggtagtgcacaccttgaggctgaggagggaggaatgcttgagcctgggaggtagaggctacagtgagccatgtttgtgccactgcacttcagcctagagtgagactctgtctaaagaaaacaaaacaaaacaaaaaaacacagaaaacaaaatcaccaactgtgggccgggtgtagtggctcatgcctgtaatcctaacactttgggagtccatggtgggcggatcacttgaggtcaggagtttgaaaccagcctggccaacatggtgaaaccccgtctctgctaaaacttcaaaaaaagtagccaggtgtggtggcacacacctataatcccagctacttgggaggctgaggcaggggaattgcttgaacctgggaggtggaggttgcagtgagccaagatcacaccactgcactccagcctaggcaacagagtgagactccatctcaaaaaaaaaacaaaatcaccaactgtgtgctgagttcagtcatagaagcactcccagattaaagaggagggtgcgttaatcatgttttttaaaaaaatttttttagaggatagggtcttactctgttgcccaggctggagtgcagtggtgcaatcatagctcacttcagccttgacctcttgaactcccgacctcaggtgatcccccccgcctcggcctccctaagtgctgggattacaggcatgagccactgtgcctgcctatgtttttaattttctgtattttatgatggtttgacatcttgagggccctgctggcctggaagagactgtccctcccagggctagctaattcctaagatagtaaataacttgcctgtgaacttgcctttcatgtgcacatcagccaattcattccccaacccccaaccacctcctttatctactgtcacaccgagccagtattacccctgccctaaatcaccccagaccaacatcatacaaaccagccaatcctcaaccagc

SEQ ID NO: 214 - DNA, 2336 bp, Homo sapiens
aaaaattagctgggcgtggtggcgggtgcctgtagtcccagctattcaggagtctgaggcaggagaatggcgtgaacccaggaggcagagcttgcagtgagctgagattgtgccactgcactccagcttgggcgacagagctagactccgtctcagaaaaaaaaaaaaaaaaaaaaaaaaaagacaatctagtctgggctcagtctaggagagcgaatcacttgtcaggagttcaagaccagccaggccaacatggtgaaaccctgtctctactaaaaatacaaaaatcagtcgggtgtggtagcatgtgcctgtaatatcccagctactccggaggctgagggaggagaacatcgtgaacctgggaggcagaggttgcagtgagccgagatggcccactgcactccaacctgggtgtcagagcaaggttccatctcaaaaaaaaaaaaaaaaaatgaaagaaggaaaaggcaaggccaggtgcgatggctcacacctgtaatcccagcactttgggaggccgaggcaggtgaatcacgaggtcaggagctcaagactagctgtccaacatggtgaaactccatctctactaaaaatacaaaaaattagctgggcataatggcaggcgcctgtaatcccagctgctctggaggctgaggcaggagaatcgcttaaacctgggaggcggaggttgcaattagtcccagaggttgcagtgagccgagatcatgccactgcactccagcctgggcgatggagcgagactctgtctcaaaaaaaaaaaaaagaaagaaaagaaaagacagtctacagtctagtttatggaataacagaaatctttagggccttgcaaggtttttggtgaataaagtttttttaaacatgaaaaaaataaagaaatctttatggccctgtcaacctcaattataagcagagaggctctctaacggaaaatgttaatctgggaatacagtgtgcaatgggaataggcatgcttggtaaactatgtatttggggaggaaaaggaagacaaaggtttttaaaggaaagaatgaggaggattatgtaattgttttgagataattacctttgactacaaagatcaataacaagggtgacatcagtccaagctcagatagacagttgctgggcaaatgtccttgtagtagtatctttttgtataaggtttgagatggtctttgtgcaaggttgtgttttttgtagtcttttttgttattaggcataatacatgagacttctctctctctccttctctctctctctttttgtagacacagggttttgccatgttggccaggctgcgtttgaactcctggcctcaagtgatccacctgccttggcctcccaaagtgctgagattacggcctgagccaccgtgcccgcctgagaactctctctctctctctttttttttttttttttttgagacagagtctcactctgtctcccaggctggagtgcagtggcacgatctcagcctcactgcaacttccgcctcccaggttcaagggattctcctgcctcagcctcctgagtagctgggattacaggcacgtgtcaccacgtccagctattttttgcattttcagtagagacggggttttaccatgttggcctggctggtctcgaactcctgacctcaggtgatccacccacctcggcctcccaaagtcctgagaatacgggcatgagccaccgcgccccgccaagaattctctctttatagctttccctcactccctttatcagtgttttcttaatgttaatgactccattttgattctgataactttcacagccttcatgtgtgctttagggtaagaagcagccatacccagatcacaatagcaatgttcctttatcaaatgagtgtataagctaaaagcttttcatcattgcaacatcattcaaaattcgctcttcaatttaggcaattgctaccactccccatcagtaaaataatgtatagtctataataagtagtaaattgtgatcaatgtttgttttgagatactatctgttgactttacctgggcctctttcttttcttttctttttttgagacaagatctcactctgttacccagactagagtgcagtggcacaatctgggatccctgcattttcaacctccctggctcaagggatcctcctacctcagcctctcaagcagctaggaccacaggcacgtgccaccatgcccagctaatcttctttactttttgtagagatggggcctcactgtgttgtccaggctagtctcaaattcctgggctcaagtgatcctcccaccttggcctcccaaaatgctggga

SEQ ID NO: 215 - DNA, 1495 bp, Homo sapiens
cttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaa

SEQ ID NO: 216 - DNA, 1535 bp, Homo sapiens
aaaaaaaaaaaaaactactacaaaagactgtaaaaacacaaccttgcacaaaggccactgcaaccttatatacatacaaaaatatttctgcaaggacttctgcttgttcaacctcagactggtgccaccaggacttgttattaatccctggagttagggatagttatcccaagacaattacataatccttgtttttccttttaatctgtcttcctttacctccctgaatacgcatagtatggcacatggactcccactgcaatgccccattcatgaataggtatcattttcttttacggcctccgtttatttaggttgacagtatataccacaatttgtttatccattatatgttgaatattttgggttgtttccacctttgggctgttatgaataattctgctaaaaccagttgtatacaagtttctgtgtatcaaactacctttgcaaaagtgacagtaagagaaatctgacatggctgactccatcttgcttctgaactcaacaggcctacgtcttggtagaattcaggcccctctcatcctcttcacttgagggtctttcactagttttataagggcagtttagcttttgggaagagctcatcaaatcttattgttgacgagtttttatagagctttatctccagccacctctgctccaggaggctggtgggtgggagtgaaagttccaaccctctcatcacttggtctttctggtggctggccccatcctgaggctagctaggggtcccactctaagtcatgaactcacgtattatcccattacacaggaaattccaagtgtttttcagttgctgtgataagaaccaggaaaaaaggctaaatatatttcatattaccacagatacatatatctaggagtggaattgccatatagtaattctgttcagctttcaggaactgccactgttttccataggggctacaccattttacgttctcaccagcaatgcatgagggttcctgtttctccacaccctcaccaagagttatttttttcataaataagccatcctcgtgggtatgaaccggcatctcattgtagttttgatttgcatttctttaataaccaatgatgttgaaccagttttcatgtgctttttggccatttgtgtatcttctttggagaaatatctgttcaattcctctcatttttgaaaaaggttatcttttttattaagaattttttatagttcaaatagcaaactacagatatcagactatcatatcgtttgcaaaaatattctccccttccataagtttttttttcattcttcaccattcttggatgtacaagtttttaattttgatgaagtcccatttacatattttttcttctgttgcttgttttcaatgtccaatgcaataatccattgccaaatccaaggtgatgaggacttactcattttcttctagatctagctcttacagattgtttaccaattttgagttaatgagtgataaatgaaggcatatgaggtagagttccaacttcattcttttacatgtggt

SEQ ID NO: 217 - DNA, 1417 bp, Homo sapiens
agcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcgtggccagacctcctcttctaccgaaaatattagtcacatgaaaaagaatccttggagccaaaaatgagaaccattgaaaacaatgccctgaatcctagatttatgaggcaagagtgccagaaaacagaaattacgtcttaattcgtcctggttttgatgtggattacttttgtctagataacttcaacccagttaagctcaatgaaactgaacacttcgtttagtaaccggcaccaaaaataatctgacaaagaaatttcgaaatagaactattagtgtgttttcacaaacttactcgtttgcaacgttatttctagggtttcttcccagtgtcacttctctgactgagaaatgtctcccaggccggtgatttcagtcatcatctaaaaccaatctcatgtctgcacctgggaaggtagtgtgtgtcctggttaaccgcaagggcgccagagtcagataaccaaggctggatatccgcttgctaactggtgaggagaccacgggcatgttacttatcctgtgcatcaagaggagactacatgtgatagatagttcgtatttaaatgtgacaatacatatgaagccctttaaataggaccgggtatgtagtacctctcctggtacaatgttagctacagctatatttttcctcccagaactctttcctatgctcctttccccccttttcacctctgccagttccctcggatttaacatgttgcatcctccctaaatttgctgtgctccttctagcggcttacgcacccagtcagcattctaatacagtcatgccttacctagccacaaggatatgttctgaggaacgtgtcattaagcgatttttgttgttttgcgcacatcatagcgtgttcttacgcaaacctaggtagtctagccaactacttgctttggctatatggtatatagctattgcg

SEQ ID NO: 218 - DNA, 1269 bp, Homo sapiens
cagaggatttgattattgagttatctttctattctgctgctgtcagtagatttgccataaatgtttcctgagagtctctctcttgaagagattcaggccccagttaagttcatcccaattaaaaatagaaccctgagatgcagcagctgtagcacctcttaaacctcttcaaataacattgtttaggctgccaaatctcttttataaacatttcgttagctaggtaggatttttatatactttcccaaagggccaagttgacagacatgggctttcactttatttccatagagatctggatccaaatccctgggtccaaatatatgccattcacttcccatatttagtcctgttatctctctgaagactggcccaagagaggcctttctgatgagacatttagcacagcgattaatcactagataaacatgtgaatgggtccatttgcaaagtgaaagctccctaaacagaggcttgtcctttacaaaaagagcaggtccaattttccttaaaagttcatggttgcctatgtggtgtgatttgagaaatcctgaaccttctgttcccattactttccctgttgagctctacatttcatagtgtatcactcctgtggatgaaacctggcctctccagggcagtttctctaataaatggccatagtcctgggaaaggtcctgatgccttagtgtgcagtgtgcttgacaccataagatcctttcttctttgataaaaaaaaaaaaaaaaaagactaagacaagaaaactggtggctgttggggaaaggtgtggaaagaatgaaagaagaaaaccgatgcatggaaagatggtaaagtaccaatggaccggtgtgagtcaggttctgaatttaggagtgaggactcaaatatgcctgtttactgggttagcttttggaacgatcctatggaacatatatcctatgaacattatagaagtcactaaagctgactgcaaattgagtgtaagttgagagtatctttctggaaaaacaaattggaaatatttatcaaagggataaagaacttacatatatttagaaccaaaaatttcaattgcaggactctatcctaagaaaaacaattagcaatgaacacgtttcaacccaaagatgttcactgggacattatttaaaatagcaaaaatattagaacaagttacatgtttattaatagagaaatgaatactatggaaataaatttatgctgtaaaagtgaccaaataaagcttggctcaggggctcatgcctgta

SEQ ID NO: 219 - DNA, 2470 bp, Homo sapiens
atgggggttcaccgggttagtccggatggtcccaagctcctgacctcgtgatacagctgcctcagcctcccaaagtgctgggattacaggcgtgagcccccgcgcctggtcccgagaacatctttatactgtttggataaccctcctaccagcatcttccagtggttaatgataaggatcaagaagggcctcctaagctagtagctattaataattgtaaacatgtattatatacttaatgctcacactgtgttgagtactttacatgattatctcatttagtcctcacaacaaatctttgaggtaagtattactattaattgcatttggcagaaaagcaaactgaagtttagtgaaggcaaataacttgctcaagatgacactgctggtaagtagcagagctagaaggaacctggaaacctgacttcccagctcaagtgctaatgatggcattactttgagtattgttactgggacatcctcctgatctactctaaaaatctagatcaccaacatatatattcctggatgcagtattgctaagaactggttttaacctctagatctgtgtttgaggactcacagattcattactggtccacatataccagcagggcttctgcatgatacccagtaggactttcttaaaattgtggaaagcattcagtgtatcttgagatgtactagtcttatggataattcatctcttcagttctatccagaccacctcataaaggagaatatattaagcattgccaggctgcatcatcaagctatgaaaaatagcttgcctctcaagccttccctacttccccatatcattggaagctttacttctatccctgtggtatcagggaatatcttactcctagaggagccagacaacagtgacttccacaatagcctcatgtgggagtgagagttaataacttgaaagatggccgggtacggtggctcacacctgtaatcccagcactttgggaggctgaggcgggcagatcacgaggtcaagaccatcctggcccacatggtgaaaccctgtctctactaaaaatacaaaaattagctgggcatggtggcgcgcatctgtagtcccagctactcgggaggctgaggcaaggacaattgcttgaatccggaaggcagaggttgcagttagctgagatcacaccactgcactccagcctggcgacagagcaagattccatctcaacaaaacaaaacaaaacaaaacaaaacaaaacaaaaacttgaaagactgcccaagaaaggtgaaggttagatctcaggggatgatcttgaagcaactgagacagacctagaaacttgcctcatatgatacaagaagacccagcttctttgtctctaccctgtaggcactgggtagacaggtaggtgatattttacttcacaaacaagggaactaaaagtatgaacatttctctgttcctcattatctctgccctaaaatattttggctatctagccccagttagagcggactggcactgtctggtacaggaggtatgcagcagatgttctgcatctgagctccattatgactgtcccccaacaaatcatcccccagccagcccaagggaacgtggaattcagaggggaactgttctaaccaggagcagccaattagatccaggccagagaaacccatatccaggcactttatctttgtcctaaaatgaacctagctaacctcttcaggctatccaaaaccctgaccactccacatagagagacatttgctagccttacatgtcactttccactgtacacataccaatgacacctgaaccagatataaagacagacccacaaaggttctgctgagcctaaggatctgctcacctatttctgatcccgaatgcccctgggacatcttccagaatgtgtgcctccaaataaagtctagaaaattggaggaaaatttaaatgcagatgaatcgagaaggaataaaagccattagaaattctgggaaaacaagaaatatagaagaaagtcacggggctgggtgtggtagctcacgcctgtaatcccagcactttaggaggccaagtcgggcggatcacctgaggtcaggagttcgaggccagcctggccaacatggagaaaccctgcctctactaaaaatacaaagattagccaggcgtggtggcacatgcctgtaatcccagctactcaggaggctgagcaggagaatcgcttgaactggagaggtggaggttgcggtaagctgagatcgcaccactgcactccagcatgggtaacaagagcaaaactccatctcaaaaaaaaacaaacaaaaaaaaacaaaagtcacaacccaaatatgaagcaaacaaactttcagatgatgatggtacagtgtgtttataacactaacaactcacttttctccccacacatagcaatcgtaaaaataaaaacagccaggcacagtggctcatgcctata

SEQ ID NO: 220 - DNA, 3396 bp, Homo sapiens
gcttggcgggccccgcacgcgaagcagccggccggccctgccggccccgggcaatgaggggcttagcacccgggccagcggctgcggagggtgtactgggtcccccagcagtgccggcccaccggcgctgcgctctatttctcgccgggccttagctgccttcccgcggggcagggctcgggacctgcagaccgccatgcctgagcctcccaccccctccgtgggctcctgtgcggcccgagcctccccgatgagcgccgccccctgctccacggagcccagtcccatcgaccacccaagggctgcggagtgcgggcgcacggcgcgggactggcaggcagctccacctgcagccccggtgaggtatctactgggtgaagccagctgggctcctgaatttgatggggacatggagaagcttggtgtctaactcaggcattgtaaatgcaccaatcagcgccctgtcaaaacagaccactcggctctaccaatcagcaggatgtggtggggccagataagagaataacagcaggctgcccgagcagcagtgacaacccgctccggtccccttccgcagtgtggaagctttgttcttttgctctttgcagtaaatcttgccactgctcactctttgggtccacactgcctttatgagctgtaacaccgcgaaggtctgcagcttcactcctgaagccagcgagaccacgagcccaccgggaggaaggaacaactccagacgcgccaccttaagagctataacactcaccgcgaaggtctgcagcttcactcctgagccagcgagaccacgaacccaccagaaggaagaaactccgaacacatctgaacatcagaaggaacaaactccggacacgccgcctttaagaactgtaacactcaccgcgagggtcagcggcttctattctttaagtcagtaagaccaagaacccaccaagtccggacacaatattttctattatctatgtttgattcttgtcataaacatctgaactgttaaggtaattcactaatggatcacaatctgcacttcgaaaattactggacacttcttattcacacgtaatacattctgccttaacacagtgcactctaagagaattaatgaaatgcagaaaagactataggtttgtaaaattcactcagcaaagtcattcattgtgttgcttaggtacataatatttcaaaaactaagcttcactgagcatctgtattgaccactttgaagtgatagttttatagctggatcttcctacatcatgtactatctgaacacatcacactagttttgatcgtttggtctcattaactccaattatccaaattggtatgtagggaaatatacaatacggtgttgacagttcataagtatttgactattaatgtgttgtctataaaatactcaacctactcaggaaacacaattcttcaaagaaataataaaagaatgatccagcatgatctagattgtgttacattcaaataaagaaaaataatgcaaaacaatgcaacctaacctaccattaaatttctaagtaatgaccaaaatccttagctttatacatgcattatttaaaattatgaaacccaggagacttatttacaattcatccttaaatagtggaataaaaatcaatataactgttttgtcaatgcatttgacttcctgagcatattttccaacagaagcatgcttatgcaaatccagaaatgaaatgttaaaaattcagaaatcaaaatatttctttaaataaacttgttgagaaattttttactcagtaaacatttttaacatccactgagttttcttaattccactatttttctgaattgtcatttcttcatataaaaatatttgaataagtaaaactttatgttaggagtatatgtaagtatgtgtggctaccatttcaactaaaacttagggtgggaacctatctgaggatcttttttaaagctggataccttatagaacttgtaaaataaaaatctttttttcttttacaatcttttacaatttttcttttacaatcttttaaaaagggatctatatcacttaaatcctcaaaaaaaggttatatcatgagggaatagaagaaatactttctgttgacataaacagtaattgataaggttttcttgaatacttttatagaaatgctgatgtattacacttaagattactagttagctctcatttcctttcaacttttgcctctggataagctcaactattcccaggaagaaacagtgatcaagtacatttgtcatgcgagcagctataataaggtaattcatcataatctgtcagagttttattctagaaagactgctacattttttttcttacttaaaaatctgctgtcactcctgttgaaaatttggtagacattttggacatgtttaaaagcccttccaaactgatagttgcagataattaagttattggctatcaaagattctttttctctttttctttttctttttttttaacaatatatatgacactatgaacccttctagctagtttaatctgacctgttcacagagcatgatccctcattccctttcctttttcctccttaagagtagccaacgaccaaagtaattcacaatgacaaatgaagcctttctcaagagtctaattgagcaattttgttttcctttgcaagacctgaaatctacagcattctgaactccattcactgaagtggcaagagatagtggtcagaaggaaactaggtggattaaggggtttctagaaaacaagtaaataaactctacctaggtgtgacatcttacatctcagtaatatttcaattcatctactcaattacttactccgtgtatcctttactttaagccatttttaataaagtttcattgtgatgtgtactttattgaatcctaaagtctcagtcactactctctcattcttttgtaatacttcctgcattttttcagcgtttaaattcatgctttcttagaagaagaattatattagtcttttctctagccaattgtgtgatatccttttgtactaccttagagatagactgtgtttggcttaaggacaagaaaggagatataataaatgttttaattggcttttcaaaaaatttacattattctcatacaatgtacattttatacattaactgattatcaaacccaagagcatgttctcattggtagcaaccactggcaaagtattaaacgaagatatacatatatgtgcatattcaaatatatatgtgcgtatatatacatgtatgtaatgttttaatgactgctaaatacaaaagaatatgtaaatacatattgaagtataaattatgatataaatatattgttattctcttctagtaatttgaatttaag

SEQ ID NO: 221 - DNA, 1549 bp, Homo sapiens
ccccagttcccaccaccactcccagcctctggtaaccatccttctactctccagctccctgagtccagttgttttattttttagatcccacaaataagtgagaacatgaatgtttgtcattctgttcctggccggcaaattcttgatatctaatagcaaagcttcctaccttccctccttcaattttgtatgaatcaaaattaatatctttattatatcttcaaatctgtgtgcttggtatattctccatttaagttttctttaatggctttcataaagttttatgatttttcttgtacatcttttgttagatttattcctagacacttgtattctaaatgttatctttaaatttatttattttaccactgttatcagtgtatttaaggagattctaacactatgtctttcatccaacatatttcattgctaaagttatgaaatctgtcacattttaagtactacaaaatattagctgatattaatagtaattaaattgaagacaatttatctcaagaagtatagttgaaaattagagaaacacttgtaatgccctgcactttcaaagaagtcttttaagttgaccaaggttttgaaaaactgcagatgttacaaatgaaacctttagaatgttaacaaagtcaattatatttatatttactgcttccttaattctctctgtataattaaataaattgtagcgtcaaataaattttaaatgagggcattaaagtttccctgatttttttttcccccaaagaaaaagtaggaagcaatgtagcaatttgtttacagattctccttcatttgattattttggattatcaggtcttttcgtggttaaagtttcaaaggtgtcaggagaggttatttttttttctcttttgaaattctgaatttagtctgtttcctgttcctgacttagtacacttttaaatttggagggcccttagatggttgtccctctgccttccctctggtgcaaggccccagcatctcagtagatactgccaaaatgtttcccaagacaggacgtttactgctccttaatagggtagaattctaattttaattattggtccaggaggaattttaaaagttatgggactggctttagagttttaaatttgctgaaaacagcagtcttagagttgtgttcaaaatgctttgaagtttgttaggcaatattttaaatattgaatttctgatttccaaacttcatgaatgtgtggaagaaaattggaagtttaaattgcattcaggtgaagatttagataattagaacgctagaagaagactatgagtgatttcatagtactcataaaaaagtgagttcaacttgcccacttcaaactgtagactaagatctgtttcctttgaaaactaaattttattttaggaaaaaatgccatagacagtgtcagattgaaggactaccacccctgggctcagtggctcacacctgtaattcctgcactttgggaggctgaggcaggtgaatcacttgaagtcaggagtttgagaccagcctggctaacatggtgaaatc

SEQ ID NO: 222 - DNA, 837 bp, Homo sapiens
aaaaattgtgcgagaaggcaaaggaaattttaacaaaaggatcagatgtgcaagaggttcgttgccctgatactgtctgtggagatgtgcatggtcaattacatgatcttatggaactctttagaattggtggaaaatcaccagatacaaactacttattaatgggtgactatgtagacagaggatattattcagtggagactgtgactcttcttgtagcattcattatccagaatgcattacaatattgagaggaaatcacaaaagccaacaaattacccaagtatatggcttttatgatgaatgtccgcgaaagtatgggaatgccaatgtttgaaaatactttacagatctctttgattatcttccacttataactttagtagatggacagatattctgcctccatggtggcctgtctccatccacatacacactggatcatataagagccctgggtcatttacaagaagttccacatgagggcccaatgtatgatctattacggtcagatccagatgatcgtggtggatggggtatttcaccctgtgtgctggctacacatttggacaagacatttctgaaacctttaaccatgccaatggtctcacactggtttctcgtgcccaccagcttgtaatggagggataccattggtgtcatgatcagaatgtggttactattttcagtgcacccaattactgttattgttgtggtaaccaggctgcgatcatggaactagatgacgctttaagatattccttccttcagtttgacccagcactttgttgtggcgagcctcatgttacacagcacaccccagactacttcctataa

SEQ ID NO: 223 - DNA, 13939 bp, Homo sapiens
gccttcagactcaaactaaacgtcagcttttcccggctctcaagcctgctggtccctgaactaaaactcacattatcaactctactggttcttaggcctttggagtcagactggaactacagcattgactcttccggaactccagcttactgactacagatcttggaacttttcagcttccacaaccataatgaaagccaagcatattccatcatttcctaaaaccaagatagagcacatatgggaacttgtgaaataaggatgccctgcggttgttttcaggactgaagacaacagctccacgatgtatctttgcataagaatacacttgtataataagtttttttttttagagaaattgcatgtatctgccttataaactttttcattcattcattttctttcttcctaatctgttccataaagcaaatttctaacttattgttaatcaaaataattattgaaataattagtactttcatatgataaagattattttaatctgcagctacaaaatatgtaactcattaatatttaaacaatcacaattttctattaacattatagcattttatctactactagatcaggaattagctattttttgtaaaatttctttgtaaggcaaagcaatagtattgtatatactttcctaaagattgtcaagttcagttttgcttaaatttaacagtacatgtgacactttctgtttgaagaataagttggttttaagtttataccaaacaaaagcatctcttttgttttgcaaaatctgaaactttgatctttctagttgtgacttcttgtaaatatgttttatataaatattctatgaattggttattaacaaggtaaagaaagattgatatgtaagctgattcttaaacattaattttctggagataaacttttttaaaattatgctttaaaaatattttaacacatgttatcaaaaaggaactgaaatatcttaggcataaaagacatctctagaggtcattattcagtttccagaaagtactgaaactatctctgacagattgatacgttttctgcatttatagctctctggagagaggttctgtatatttaacaattctcactgtgagggatattttaagtatttcaaatttaaagtgctcatgtttcagattcagattattattatcatcatcattattttggttctggcttcagtaaaaatgtgaaaaacacttttccatcttctgataatatttcatatttataaaattattattaagttataactcagctttttcatttatgctttaaatccttttattatctcatcacaaccatctttgactgtttatcagaaatggttctcttttgtacattgaccattattttatagatcacatttaagttaatataaatcatgcctataaatttcagcctgcttattttttataatctagtcagatatcagctagacatattgttaccaagtttggagagccttgggataagctagtttcaaaactggctgttagcatccctcagttgtgttttgggagcaaaggacacccttaaaaaagggaggcagttatattttgtgagcattataaaataaacttaaattctcataaaattagtgaatatgtttggaacagtgtgaattacgtgtgtgctacatgaagtatatagaattcatttgaagtaggaagtctggccttacctcaaaagacagtcattcaattaagcagttaaacataagccaccataagaagtttttttgatacttagagagagaaaggcaacgtgtattaaaattccgggaccattatctcaggagtgctgtgttattattgactgggggcctgctgggaagctagaaatatatctaaaatgtggcaggtggttaattagagcatatgaataaatatatataaatttgttaaagcgttcacttatggtaaactatacctcaattaaaaagaaaaaatatgcacaaagaaaataaataatgaatggaaatatgagcctctaaaatcaaagttagaaaagcagatattcaaatttgcagagctgattgtcaactggaatgattgtgatagaatcaagtctcactagctcattggaaataggatttgttaaggtaatgatggttaatgatttttcagcataataacagccaagttaatgtatgggtgcgtgtgtgtatccataggtgtatgtttttacatgcgtatttttattgtaaaattaacatgtttattgaaaacaagaaagcacagaaaatatcaacttaagtaaagatcaacataatttagttcaaaattatattcaacagtgcattatttcaatgttttttatcttaatccatttgcttgaaagcattgatatatgctccaaatttcctcccagattccacttggggaaatatttagtatattggattatgaaatgatttatctttacctatattattagtaaagttcttaaaatttttagcctgttactgtctatgtgattagtgatattgttcacatgactaaaattcaaagataaaatatgattatattttatgggtgaaagttaggaagcaaaatagcatattaatacatttaactaaagtagtattcatttggataatcaaggtcaaacacttcaaaaataataattttaaagttaatgctttcaaaaaataaattagcaaaaattatttactttgtttcttaaaaagaagaattattgaaaaaaattctaccatcaaaaaatagttgttctatgcctagtttattttagtcactgaataagactgagcccttgacctcatattttttcctgcctcaccattagcagttaggtttagctatgcaaacctttatttattcaacatatataaaatacttagtatgcagtagatgttattctaagtgcttggtagatatcaacacatttaataatcaaaacaactctaagaggtaattagtactattatctccattttattactgaggaaaccaaagcacaaagagagaaagaaaagaaagagaaaaaaggaagaaagaaaagaaagatgaaagaaagaaagagaaagaagagagagggagagagagaaagaaagagaaggaaagaaagaaggaagaagaaagaaagaaagaaagaaagaaagaaagaaagaaagaaagaaagaaagaaagaaagaaagaaagaaagaaaaaaggaaggaaggaaaagaaacacatggaaagtgcttctttggaccttttaagttgcattatcccataaaatgtggtggattcaatgttgtatggcctgtaaaactaagtaatgaaggctgatatgtacccacctggctctgtcttgggatcacacaacttgggagccaaaacagtgagacttataagaatctcaaggatggtgtcccaaggcaaactcatggcaagatcaagaaagagaatggcctgtcttgacaagatttgtggttttggctttcgtctgatggaatgaattgtacacaaatacacagaaatcccacaaatattaaaataattgtatcaacttgtaagaaaaagggaaagaaatagcttaaaatggaatattgctaagccctcaaacctttacaagcaggaaataggtgtaaacaggcttaggaaaatggaaggtggactcagggcagattgaggagatcttggagtgcagcaaagagccatagagagcaatttccagggagtaggactgaactctaaccaaataattggcagcatgtgcctggcatttcaggattgacatggaccggtgactactgtgttccttcccattccccacccttttgtgtaggattgtctgtagcagtttcccaatgcctgttcctccacttgacgttgggtatttggagaacaagaaaaattctctttttaggtcagatgtgtgacatgtatcacattgtaaaaaagagtgctcaatgagctgtatttcaggaattgcacttaaggggaattatttttacctatattggattaatatgataagattttgaactttgagcttatgtaattatgaagtgagacctttagtcttggggaatgactgtattttatatgcgagaggtatataaatcactgtggcctgaagatagactgtggcagattgtatttttcaaagatttcctgtcacactttttttttattctttatttttctctttctttctctttcctctttctctttcccttcctcccttccttccttctttccttccttccttccttccttccttccttccttccttccttccttccttcttttctttctttctttctgagagggtctcactctgtttcctggctagagtggtgtcacattcatagctcactgtagctcaaactcctgagtgcaaacaatcctcctacatcagcctcccaagtagcttggaccacaggtgtgcatccactcctggctaattttttaattttaatttttgtagagacggggtctcactttgttgctcagactgatcttgaattcctggcttcaagagatcctgctgcctcaacctctaaacttgctgggattgcaggtgtgaaccaccatgcccagctactttctttttcttacaatatgcctttgatgctcttcccatcaagaggtattcctttcccttgaatatgggcaaggctgtgattattaatgctatatgacttttgagagtaggtcatgaagcatgatacattttcctagttcatttaggatgcttgctcttaatacctagcccctatgcttgtataagtccaagagacctgttgtggggaggctcacatgaagaagaacgcaggcacctagcctacagtctgattgagctctcatctgataacccataagaacttgagagccttgtgagtaaaccatcttgaatctttcaggacccagttgaaacacttcagctgatgctgcatggatcattgcggatttgtgagcaaaataaattaatatagctttttgttttaattaaacaatattttttgagacaagatctcattttgtcacccaggtgggagtacagtggcacattcacagatcactgtagcctcaaattcctaagcacaggaggtcctcccacctcagcctccccagtagctgagaccacagcatgtgccactgtgtctggctaattttttatttttttgtagaaacggagtcttgctatgttgcccaggctggcctcatgtgatccacttgcctcagtcttccaaattgttgggattacaagtgtgaggcactgcactgagcccaatattcctttttaagctactaagttttggactgatttgcttcccagcagtatacgattgataaaacacagaatatagaataaaattaatctcttatgttgtcctatgaggctttgtgagatttagtttctaccaacaccccaaagtcatgtcataccatttttcactgtgcttactttgcttcactgacttttctcctgttttctaaaactagctagttcttatcttcaggctttgtcattgtcattccctgctgagaatattgtctgtccaaatcttgtaattcagactcaaaaatagtctgtggccactcaatctaaagtaacccaccacaaactctagcccatctccctatttattttcatcatgatatttatatctatctcatctaaattttatctatttgtcatctatctaattgaaatttcatgtttctttactactaatacgcaagctctgttaagacagaagtatttagtttaattagatcccatttgtcaattttggtttttgttgccattgctcttggtgttttagacatgaagtctttgcccatgcctatgttctgaatggtattgcctaggtttttgtctaggatttttatggttttaggtctaacatttaagtctttaatccatcttgaattaatttttgtataaggcgtaaggaagggatccagtttcagctttctacatatggctagtcagttttcccagcactatttcttaaacagggaatcctttccccgtttcttgtttttgtcaggtttgtcaaagatcagatagttgtagatatgtggcattatttctgagggctctgttctattccattggcctatatctctgttatagggacacttttacactgttggtgggactgtaaactagttcaaccactgtagaagtcagtgtggcgattcctcagggatctagaactagaaataccatttgacccagccatctcattactgggtacatacccaaaggattataaaccatgttgctataaagacacatgcacacgtatgtttattgtggcactattcataatagcaaagacttggaaccaacccaaatgtccaacaatgatagactggattaagaaaatgtggcacatatacaccatggaatactatgcagccataaaaaatgatgagttcatgtcctttgtagagacatggatgaagctggaaaccatcattctcagcaaactattgcaaggacaaaaaactgaacaccacatgttctcacttgtaggtaggaattgaacaatgagaacacatggacacaggaaggagaacatcacacaccggggcctgttgtgaggtggggggagcggggagggatagcatttggagatatacctaatgtaaatgacgagttaatgggtgcagcaccccaacatggcacatgtatacatatgtaacaaacctgcacgttgtgcacatgtaccctagaacttaaagtataataaaaaaaaaagaaaaaaaagaaagacagaagtattgttcatcttgttttcttccctaatcacgttacctagaacagtgcctatcagatagtaggcactccacaaatatttgttgacttaatgaaccagtggaaataaatattaattcagttttacattacacagcaaaatagaaatccaatatttaatccagttcatattacaaaataataccttctttttaaaaattaaatccattaaattgacatagaaaaatcttcaccatctcatgactttataaaaacaaaattggtttctataccacttggattatttctacaaattctatttatatggtttgtgtcaataaaccatagaaaataaaattttcaaataaaacttatatatttgttatttgatcttgttctacttatatgaatcttttatttcatgcaaataaaacccaaaatatgattcagcaactttcagtctgtttttagaggcagagtcttgatatttcacccaggctggagtgcagtgtcacaatcatggctcacttcaggctcaacctcctaggcccaaaagatttattcacctcaacctcctgagtagctgggattacaggtgtgcaccaccatgcctggataagttttatagtttttgtagacacaaggtctcgctatactgcccaggctggtctggaactcctggactcaactaatccttccacctcagcctcccaaagtattggaattacaggtgtaatccaccatgcttggccaattttcattctttaatgttaggctttgagtttagtatcaaactttaaaacaaaagcaacaacaacaaaaaacaaaaaacatttccaaaaaagaaaaaaagtactggtagcagtcaataaaagaaaagactccaatttccaggaatttggaatgtggaatcctggcattatagagatacagctttttcatctaattaatgtataaaatagtcaatactttcattttattttcttggagtttactccttttcaccctgaagcctgggtaacaaagcaagtgcacaaaaatcgttagaataacacttttcaacaagaagcagtcccaaagtaagtgaaaggaatttctttagtgattttctccctgagggggagcagtagtctgaaatctcactggtatctattctgaaagaatcaggggatttatttatgtcataatctagtatttgcagcctgctttgattttcctcgggatttccttggatatattttactgagagaagtgtgaaaagtacttctgatttgagaagcatgaaaagaaagcctcaggccaggagaccatcttctactctgagtcatccatttgcctgttctgaacaacctctactattggctcttgcacaaagatctcctgagagtagttgttggtagactctaattgcctactatttttaactcattcccttactcctttgataagagttgagagcccaagactttaatggattttgcacgtatgtcttattctatttacctaatcataatgcaatttcacttcagcacaaacacagccatagcaatcatgacttaattttaattcctaactcactgtaagtaagccagcttatgcttttactaaccaatttccaatgcatataaataataacacatatttggcatatcacagtgcttagctctttctgatgagcaaaagattatatatttattggtgcttatcttgatgtttcacaagatttttcatttatttctatactgttcccttaggttactaggtgcagtcactttccctaccacctgctttccactatctgctccttatctttttctttagaaccttgcttcaccttcttcctctatttgtgaccgctctgcaggtgatcaggcttcctccactttccttaccttctgattgtctcataccatcttccatcattttccacacatattacttgctttataccatactgtatttgtaaaacacataaaagattgctagtatttttattttatagatgatgaaactgaagtatgaaagataaatgactcaccagaggctatgatttgtgggccttttagtgggtttaataggaggaaagcaaaggtgaaatgccagaatagcgaaggtggagaaatttgagatgagtgatagagacctaagaaagtggcagttaaaatggtccagggcataaaatgatgtgaggaatagtagaaagaaaaggagaaaaataccttaaaattgatgactcttctgtcctaataacttcaaagtgcatttcaatttgaaacctttatcacctcattgcgtggaggagacaaaggaaagaaaacatacagagcatttgtctcttcctgaagtttcctcaattcataaaatccctaagacactaagagaagaaaatactgtgaacatgtttagtttgatattggttattgtcatttcttttcattccttcaaatacattttataaattcaatttcacatattatttaacctcatctacctgacatgatattgttctcctgacacatcctgtttattaaatattaatcacatattttactggttccaaattatgcttttattatacttgcttatttgcaggcgggggctggggaaagggggagtgactttcaatagaatcgggatctctagtatgatcacccgcatgatgacatcatcaacagtagacttaagaatcctgttggctccacttgctctaaatttatcagtttcctctggttctctctatcagccttaaggttgggttcctgttcaatactttctttcttttttttttttttcttacttgtagggccaatgtgtagagctgccgactttcttaataatgcaaatccaaggggtgcccctagcattctgaaatacgcaaacttcaaaaacatatctaataaccctgcatcagctccatataacagttttaattagggcccttagcagggcatacactaattactgcaaagagcaaacaaaactaaaatgagtaataaacagaaaatttatttgatgagtatctacaatggggcaggttcaaggtgtgttataaatgttgtgaactcaaaagtggatagtaaagagccagccccactctcatggagcttacattttagtatgggtaggggccaataataatcaaatcaaaccaaatcaaacaagatgttgaaaagtaataaatgctatgaagaaaaataaaatagtataatatcatagaatagagagacatggacgctgttttagggaaaaaatgttacgggtatataagcagaaaagcagatactctgataagaggatatatgaactgaaatctgaatgaagcgaattaagtgagcctgccatgtaagaagtaggattttgggacaggggaatagcaagtgcaaatatcctgagacaacagtgtgctgagagtgcttaagaaatagcaagggggctctgtggcaggggtgaagtgggcaacaagtagaatgataagaaatgatgacacagaggaagccagagataagaccgagttctgacattcttataagccataataagaattttattcaatgtatgataggaaatcattgaaagattttaagcaagagtaacactatctgatttgccatttagaagtcattaagaggtcaagaaattctataattgctggtatgttcagaatagactgagtgatacaatagaggaagcaatgaggcaagttaggaggctacagaagttgtccaggttagaaatgatggtgtgacttcaatggtagtggaggtagggagaagggtgcaataagaacatatgcttaaggtagctcttgttacctttactctgactgctattcactgagggattagttatgaggtaggagagaaagagggatgaaatgtgattgtaaggttctaaccctgagcaactagatgaatggtgataccattttctatgatgggtaacattgaaagacgaaagtttgaaagcagatgataataggaatcaatatattatgcctggagatgttgagttgagtttgaggtgcttacaagacaatttaattagagataattgtggtttgtaacagggaaagaggtacttttgcaatgtgcatgtggtcacttatctgctgactcaacttgctggtgtgaggaagcagctaactctcagaaatttaggtagtgtgaaagagaaggcaagtatctagtagtagagactattttcactgtttgaattattatggatagactgacagtgggaatattattaaaatatgtgacaaggaattccagtcataattaaagtaaatattttgccagaaatgataacaaatacctttgcacagagttcccattggtcccgaaacctgaaggtgctggcagtgcctttaagaggctatagaatatgatctgctgtagttttgctgagcttgttaaaaataacccttggccagacacatgccatccttcagaattaagtagatccctcagcacctgcttcctgtaccctgtcttctgttaccatgtgctttctcagatactaatgggttcttggcttttgcttctaggtataattgtgatctcttcccaggaaaaaggtaatgatcctggaacaagatatatatgcctggtatatatttattatcttacaattgagctttcattaccaataagagttctcttaccttgagtcctcaccctgtgctaagctcttgcaaaacacatcccagattttatctcatttaatcctggcaacagtggtacaaggcaaaacctggtattattctcattttttatttagagaaatataattgtaaagaaattaagtaaattgtgcaaggcctcacagtaagttgtaggacaataaagacgcaacaggtgccatctacctctaatggctgaccacttactatattaaattgttcttgtgagcatgggagaatcttggggaaactattatacagactgctggaggtatgtgactggttactttgaaattgaactctaatgtggtcccaagaatttttgaaatcttgaaagagagtagaacttccagtaacccttcagatgtttcagagaaaatatcaggtttctgttttaaaatagaggtaataaacacatttttaagacaggctcttttattctagaaaaatctcttgagatatataactaaacaaataaaagacagactccgatatcagaaaagcaattacagacccttcattataagaagtaaaaattgctctatacaatagtagaaaatatggtcactgtggtacatctctgcagcctgacatctgatttttgttgctgttaatagaatgagacttggctgttctaaaaaactacagcttgtcctgtggagaactgtgattacttctgatggaaaatgacaggctgaatgccagaaggcaaagcaactgttttcctaagagtcttaagaccctgaaggacttgtgcctcctttggtgatctaggggataaagaagtggaatggaaatggagaggaatagctggaacaaaaaggcaaagaggtataatctatcataaatatgccgcctttataagcatgtgtgtaccaaaaaaaagccacaaaccatataaagtgagcctatattagaaatagaagtattttatgaaataatatatttaaaatttccagtaaacagaatataaatttttcccaaatacccataatatatttacaatattagaaaaaaatgcaagcagaatttatgtaaattatattaatggaattaacggaataaaattagaagttaaaattaaaaatagccaaaattaatatttgaaaataaaaatattttgttatttgtgttaaaggggaaatcaaaactaaaattagatattatttaaaaatgaatcttactatatatcaaatcacataatatcaaaatcatactctaaagaaattttgtagccacagatgtatatttttagtctgataaatgaaatctgcattcacctcaagaagctagcgaaacaacaaaacattaagaactaaaatcaacataatttctggtcactttgttaaataaaattgaaaccagaatatttccttgtacctctattaagttaataccaagaacaagcaaaaataaagcaattacttgttctagaaaatattttctctttggaaataagacgaataaccagctaaaataggtttttaatcaaaactaacaaaagtgttgatcaatactcatttcaagatcctggcttcatggtgcccatcaatccaaaactacttcctagaccctgttgaatctcaaccaacttcccccctgtcaagactagctttaaaatcactcatgaaggtatgagattctaataaacatctccctttccctctgacttctccttcttgagacactacacttgtactctattaaggtgatagtttttcttcctgcaataggtcacataaacttagctgtcttcatcaatatttctgaaggtattttgtgaagttaacagcaatggaagagaaataaatcataaatatttgaaaaccagttattttaataaaaaaagaagtgtctttttttttaacagaattgcaaataacatatggagatactgtgctcccaggaggtggagatgaattattatcctttcttcacaccttcccattgagattgggctagatttgctgatatttttcaaaaaaatagtgcagtgaaaaaaaaaaaggtgcattgttttagtacaagaaacttggcacattctacctcaaccaaatgatgaaagttaacatcacagattccatgtggacattactacctccctggtatgatgtgatgagaaaggcatttccctctgtggtattatttcaaatgactgataattctggtctaatcaggagaaaaacaacacagatccattggagactttcaacaggacacctgcccagtatgcctcaagactttcaaggtcatgaaaaccagaaaggagagataaacaatcacagattaagacattgtggaaattgaacaatcagaagcaatgatgtagcctagattaaatcctaaatctgtaagaggacattgatggaaaaactggtgacatccaaagaagtcttgaatttagttacagtaatatcctaaaagaaaaaaaattgaaattgaaagcaaaataaagtacttcacaaataaatgagaaatacatcagataattcagattataaacaaagagaaaaaatcaattag

SEQ ID NO: 224 - DNA, 1490 bp, Homo sapiens
gtaaaaggcagggaactaggatgacctacagtggaatcagtgactccagccaggtgaatcagtctagctaataacagctcatgttcgttaaacaagtcctatgtgccaagcattttgccattacttaggtacaatattacatttattcctcaaaataaacccttagagttaggcaatgttataattattttactgttgaagtcttctgaggtttaagaaagttaaagtcctttggacgtgattaccaggtaagaagtagaatttgggtttaagaagtctgattccagatcctaagctctggccccacaccagggactagaaggaaaaagatgagacatcagtctggagccaggcatctaaagatctcatatacccatctaaagggcattgattctttttatttttagttgatatgcaataattgtacatatttatgggacacagagtgatattttgatacatgtgtacaatgtataatgatccaatcagggtaattagcatatccatcacctcaaacatttatcatttttttgtgttgcagacaatcaaaatcctctcttttaggctgagcacagtggctcatgcctataatcccagcactttgggaggccgaggtgggagatcacgaggtcaggagctcacaaggtcaggagatcaagaccatcctggccaacatggtgaaacctgtctctattgaaatacaaaaaattagccaggcatggtggtgcaagcctgcagtctcagctactcaggaggctgagacacgggaatctcttgaacccaggaggtggagattgcagtgagccaagatcatgccactgcactccagcctgggcaacagagcaagactctgtctcaaaaaataaaaaaaaaaagaatcgctacagagctgcagaggcacaagaggctgaggcacaagaattgcttaaactcaggaggcagaggttgcagtaagctgagatcactccacttcactccagcctgggtgacagggtaagactctatctcaaaaaaaaaaaaacctctcttccagctttttgaacatgtacatttaattattgttaaccatattcaccctaaaatgccgtagaacactagaacttatccctcccatcttactgtaacttgtatctattaaccaatctttcctttttcctccctagaggactagaatatttatgtaaaaaatcatccaatcaccttttattattattataaatatttcaaacatatagaatataatagcaagtaacagaattaactcacaggtatctaccacttggttctatcatttcatcatatttgctttatattgtttccttttttaacctatgtcatatttaaattagctttttgtagacagcttatatttgagtcttcttttttatccaatctgacaatctctgtttttttagtggtatgtttagctcatttacatttaatgtaattattggtatggttgaatttatgtctattattgtattatgtgg

SEQ ID NO: 225 - DNA, 8078 bp, Homo sapiens
ctctctctctgtacatgaagggatcatgagagctcacagcaagatggcggctgcctacaagccaggaaaagaggccttggggtgaaacttaccttgcagtaccttgatcttgaacttcttaccctccaaaactggcttttggagtcccctactcatacaccttctcatacatgagactacactgcttgaaaaccacaatgggctccataaacacttttgcaatagtgaagaagaagaaaaaataatgccacacatgaatgctcctgagatgcctctgcctattctggtgtgattgaattctgtccccagcaaagggaggaatggggtgaatgttgctatgtttctctttgcctccatggaaagaagtatttggagtaaccagcatcatggagacaacagccttactccccaagaaaccagagttgggggagaagagggatctgccttctctgtgaaaggcccggaggcactgaaaaggagcagtttcggaagaatgctggccttggaattatctacccacctatctatccatctgatcatccatccatccatccatccttttatccaatctcctatctgtccatctgtccagctagccaaccctcattcaccaaatatttattgagcatttgctatgcacactcactagggataaagtggtaaacaaaatggacatcagatcaattcaggctggtgtcctagctcagccatttaactgtcaccttgggaaacttgcttgctgtctttgagctgctttctttatctgcacattagggattctaatctctacagtgaaaaaggttacaataaatattgtccatatatggacataacttagcacagtagcaagaccacagtaggtgcaccacaaacagtagttttggcagttctctatctcccccaaagacccctgcctaccacccttctgctgcataggacagcatttctgcatgatcttcatacaaggcagcaacaaggacctgtgggacgacgtttgtctgggagtggagatgaggcccaatgagagtcggtggcgtgtctgaggcttaccggtccttgaagagcaggagctccttccccagcattgtcacagcgtcaaaggatgagctggagtcacagaggcatccaggaaaaactgagcgagttcttgtgaaactgaagtacactgaaggtgtttgctatttaaaggtatcttctggtggatcgtcttggaaaacatggacccaaatcttgcgagagctatcagtgagtctcctctcctgctctgcatctctcaggactgtgtcccagctccagaagaatgagcctgcacagcttggactgtcacctctggcaggttcctgctctttgatgaagcctcgtcataattacaggtgtttgaaagttcctccattgatcttctctctcctgctgccttgtcaagaaggtgcctgcttcccctttgccttgcaccatgattctaagtttcctgaggcctccccagccatgtaaaactagccttatcttcaacagctgctaaaattgaagaacaaaaagaatctttgaaacttcccttcaactggtcatcctcttccctttttctctcctttaaacactgttccaattcattatgatggccccaaagcaaagacagacatggaagtgaacattggagtggaaggaatgacgagcccaaggatgaaaacagagaagtaattaatggcagctttcctgggccagaagaataaataaggaattatcttacaaacaggtgcttcccattcccctgaccagctacatagtcatgtcaggcatcatgattcgagaccagcctgacctacatggtgaaaccctgtctctactaaaaatacaaaagttagcagggcatggtggcaacgtgcctgtaatcccagctactcaggaggttgaggcaggagaattgcttgaacccgggaggtggaggttgcagtgagctgagatcgtgccactggactccagcctgggtgacagagtaagactcggtctcaaaaaaaaaaaaagaaaagaaaaatgttttttctgtccttagatgattcttgtaagcaaattctctttccaagtagtttgccaaattgatttaatgaaagtccatatgcttcaaacagattcctaaagcctcagatgccaggtgggtgttggccttttctgggaaagatgtttcacaactggctataacctctcattccagtgtcccaaacccttggcccagccaagggaggtgactgttttctttaggaactgagtgactgcttctgaggaagcttgagtaaatgtgaggttggcttctgtttgataaacacgtggcactcaatggggacttttggacagaggagactgcatgggtgacagctggtggccttcaccaaatcctgaagttaaatttagggaatcagacccaagaacactaaaaggattaggggctctccacctgtcttccttggtcttgctctctatgctctcaggtcttcactgttgtagccacagtggtgttagaaggacgaaaatgctagggtagggatggggcaggggtagtgtgaactatagtggttttcaaaatgggcaacatcaatataacctgggagcttgttagaaatgcacattctcaggtctgctgaagaccgactgaatcaggaaatctaggggtggggcccaagacctccaggtaattttgatgcatgctaacatatgtgaaccagcattttagaaagtttatgctacttaaagaaagtctgtgaagcaacaccccctgggaacttgttagaaatgcagaatctcaggccccacccttctgagattcaggtttcattggtctagggtggaggagcccagttattggtcatttaaaaaacctcccgtgtgattctaactttgcatccagaatagagaattactgctctaaggaagaaattgttaaatgcattttatgttttccaggagaaaagatggtcccttccacagagacagtaaaagatatgaatgatttttctttgtagattcactggagttccactagaatagtgcagttatcacatcttcctccaaagaggggtaggtttcagagtttcagcagtagaagaaatctgggaggaatcaagccagtgtgcaacatcaacatcagttatattaggctgttcttgcattgctataaagatatatgagacagggtactttttataaagaaaagaggtttaattggctcacggttctgcaggctttacaagaagcatagtgctggcatctgctcagtttccacggaggcctcaggaagcttacaagcatggcagaaggcaaagggggagcagggacgtcacatggccagagaaggagcaagagagagagtaggaggagggtggcggggtgaggtgccacacacttttaaacaaccagatcttgcactaactcagtatcacgaagacagcaccaaagtataaggatccgcccccatgatccaaacacctcccaccaggccccacctcaagcaccgtggattacaattcaacatgagatttggacgtggctttattgagcaaataaaccacagcaaccatgaaattagaagtttggtaaaacatgttgcagaagaaccaggaaacacattgcaattgagcctgctgggtgctgctgcaagtttgggggtgaacaggagaatcaggttcttataggggtgaagtctgcaaagtaggatgttttcctaatttgaatgcaatgactgaagtggaaaatggtcaaaactgggcagagtggctcacacctacaatcccctaggagggaaggacaaaggcatccatatcacctcgccacagtggttgtggtggaagctgtagcactgaagagatgcagccccatggaagatgctgccaagagagggagacagagctacgtctggtgtctcccttcctccttacctggtgcctccctcctcctgtcctcctgtctcccttcagatgaaggaactgatgctgagacttgcactctaccataggcggaagcacccaccaccctgttcccagccctggaagggcaaggaatgaatctgaggcaaatagggccagcactggcagtctgctcgattttccctcagagcatttatcttccttgacatatttacaattttttgtctatttttggtttctctaacttgactagaatgtaagatccacaaggcttgggctttgctcttttgttcactatgtccatagctcctgtaacagtgcctaaaacatagtaggcaatcaatagatattctttggataaacaaatatgcctcaacattgagtctaacttacagcagacattgaataaatatctattgaatgaatgagactaacaatttactacaaaagcagttcttatgtgaaatatgacagggttgacatcttaactgaaatccatcttgagagattttttttaacccaccgagatttctgagaacacatttatttgaagaaccttatattttatgatgcatttttatatgtgaattttttgaaaccctactatcttatttcctgaggggttttagactcagctattcttcatttcatttttatacatttgtgcagctgaacacttcctactttattctttttgtttctaagttcctaaaaatagttcagaaaatccaaaattatgaactcgattcatccaaaaaaatgaacaaatcaaataactttgaaaataaatgctttcactatttattactaacaaaattgaacagtataatccagaaaaattgagcaaaaataatttataaatctcaagattaaaaccaaatatggctttatgattgtattagtccattttcacactgctataaagatactacccaagactgggtaatttacaaacaaagaaggtttaattgactcacaattctgcagggctggggaggcctcaggaaacttacaatcatggtggaatggaaagcaggcaccgtctttacaaggtgtcaggagagagggagagcaggggaaaccaccacttataaaaccataagatctcgtgggaacacactcactctcatgagaatagcatggagaaagccgcccccatgatccaatcacctcccatcaggtccctccgttgacatgtgggcattatgattctgattacaattggagatgagatttgggtggggacacagccaaaccatattggtcaattaagcgataaatactataaaaattataaatagtggtcaaactgaaacatttctctgtttcagaaacttttcactttaagaaagtcttaaattcattgttgattaccttgttcacattttctcgatctctcctagagatcaaattaggactgatttgtatcaataaatctggattttgatttcctttatgactttggatagatttctggatggtgagtgaatacagacttaaactttaagaaagtgcctgcttccagcttctggctggaggctacacttcccagcctgtcagaacagccaccctgaaaactgcaatccattatgagaaataaagctctcttttttaaattaaaaagaaaaaggaattaaaatgtaggatttggtgaccaatttaagtatgttaaagatatgttttggctactgagcttcctctgagattctttatactcaaacacaaacaaagcactgaatttcaacctgaaaatatgtcatgtgtttcaaataacttgaagaacaaaaacaacaacaaaaatcctgttattttctgggaaaaatgattcatttcaggtaaaacccatgacatatttttaggtcaccaaatcccacgttttaattcctttttcattaggagagtccacccatgataaacaataggaaggttgtaatgagtttctgtctttgtcctcaggcaagaagaaattcaaatacattctttctgtgtgaattcatttcttttccacctcagctgttcaaatctccaaaatgaataactattgccagcactgtcttgttcatgcttgtttttaaagctgtttctttcttttgagacgtaatcgcaggcccttaagaaaaccagaagggacaagccaagtgtcaattatgtttgttgttccagctagtctgtttctgtaagtgtatgatataggacagaaagaattggcccatatttttttccaattttgagaaactctgagcttaatttttagttttcccaattgtttttactttagaataaattgcttagtatatctaattataataatgatggctcacatttactgcgcattaactacatcaagtacttattgtaagtgacgcatgtgaccagttgccaattgttcaggctacagcttggatctgttagcatcctcatttaacaaatggagaaattgtagcacagagaaggaactttccccaggttccatggtgaataaatagaggaagtgctcaatgagcctaactaatctgggttgaaagctcatactcttacccagcctccaagctagcagatggaaatcaaaatatcttattttaaagctcttttctaggagaaaagataccttgataagctgtttttccaaggaatgggaggccataatgacatgtttaaatgagacaataaacaggtttacataactagtttacatttaaaaagaaagataaagaaacaggaacttgggttcctcccagaggtcaaagaagggaggggtcagacagaagagcagaaggttggcatctgtggggaggtcactgtggggagacgattttggaggtgggtttgccaaaggatattaataagatttttccctctaattgtttgatggggagcattagaaactccataagattttggattttggaaatcaagtttatttaaatcttaaaggatgagtgatatcacctactttttgagttataaatctttaatataattctaatattcaacatatatgctttgaaaactgtgtttttagattttccactgaatttgaaataggattatttttatagttgaatcttgtcctctcctacaggtcaatttttaagaatatatatccaggaaaaagtaactgcccataagcaaaaatgagtgcaatttctggtgctctcctaactgtaatatcacacgtatttgtgctacagaacaagaatagggacaaggaaagaaaacaaacttgaccaacatttgagaatctactacatgttaagtagtaagtcatactactttttaaaatccactttatcgaagtagagtaaacatatacaattcactaattttatttgcacagcctatatatatatacactagtgtcaccactgcaacaatcatgatatagaacatttctatcaccccagaaagtttactcatgatcctttgtagtcaatccctcctcccacttcccacctttggcaatcagtgacctgctttctgttactatagttttgtctcctctaatttttcatataaatggaatcatatatcatgaagtcttttgtatctggtttcattcactttccatattgcttttgggattcatccatattgtttcatgtgtcagtcatttcttcctttttgttgttgagtatggacattccagtttgtctattcatcaactgatagatatttgggttgtttctagattttagctatcataaataaaactttcatgaacatttatgtgcaaatacttatttgggcaggttttcattcttcttgggtaaacatttagagtaggatcattgggtcacaggagaagtgtgggtttaattttataataaattgccaaactgagtgaggaaggaagaaaccagtcaggcaggcagttagggtggatgctccattgatttctttcaaacaaaagaacggcatgcaagcactgataagggaactttcacaggggggcttgcctaagatatgcccacagctgcatacataagaaagtctacacaggagacttacccagacttatctgcaatggaaaatgctatcccctgacacatgcacggtaagggaaacaaagacaatatggagtaactcaagctaagggcctgcatgcacactaggaggactgggtggagcgaccagaaatttgctccttatgcaaatgagacacccaac

SEQ ID NO: 226 - DNA, 1212 bp, Homo sapiens
ttaatgaatccatcatggtccggagaatgaacctcatccttttggggtcagagattatctcatcattgactccgagttgattggatggatgcagacagtatacagaagagcctttagagcttcatacaattgtcctgggatacatgtacagaacgcaggattgttacataaggaaacgtatgccgtggtggtttgctgcacctatcaacccatcgccaaggacatctaataactgctctgattggatttaaacatttgcagtggggtacttctggctttgtgtatgtagaagtggtgtctaaaagagtcaactgcttcaccacaggacttttatacttctcatgaaatacagtccttcaaaaggcaaattctctatttcccccactttgattatctgcttatgctcctaaaataatgtaaatatggtcattaatcatctacaacattgtcaattaggagagtaaagccagtaatgaactctacatccctgacctcatatggtatgttgcattttaagggagctgtttttatcaatgacaatcgtattatttgtgctcataacctgggctctacatccagtgaaaggattttgatacagaatctttatttgaagagaactacacaaaaacaccatcaccatcatacctgatgtctgctattgttgaaataggcttcagcactgtagctggtggaaaccaggtcaccaaagacactgcccttgtacctggaaggcccgtccctgcccccattcacacagtgaattcatttagaagagaggaatgctgtagacagagtcattagaaaacccttcatgactgtggcgtggaaaagggctggcaaggatcacaaacagctttcctgggtttggtcttacagcatggacttcttcaccctcatctacacgtaaaatttattaacttcaaggagaggagatcagggttgcctctaccttgcattcctatgtagccatgaattaattcccaaatgccagtgtgagcctgttttccttttcatacatcgtatttgaggaaacagctggaaatattactctgtgtgccacacatcccgattcagcacagtctcttgttcccagagtggagtaaatgagtaaagaaattattcatccgccttttacctaacttggtgtgtgaccaataaattctctcaagattgattcaggttcctatattcatggaaacaaaaaaagaaaat

SEQ ID NO: 227 - DNA, 1079 bp, Homo sapiens
acatgcatggcaagtgtcacacaaaaataaactcagaaaattttcattctccagtgatgtggcttgacacaaaggtgcattcagagctaagaaatgaaaatagtggtaaaagtcaattatgagaaagcaaagtgggttagtagaatgcagggcgtgtacgccaagtgcctaatcccagcttgcctgcttagtagccatggaacctatttagatatttttaggtccacctgcttcgtgtatcaaatgtggggatatacaagatcaaggatgtcaaataggttttcaatgcaagtgtcaactcgagaggtttattggaaaagataatgaggccttatgtcggccatgagaaatagtgatgtgattctttactgatattctccatcagtacaggatcagggaggagcccagctctgggacatgttggccattcgtgggctaggagattatctgtgttcctctcaattttattttcctatgattgattatcatcttgaaatgagtccaatctgagacttggacacttagggcattaggaatcagcagagaagtgttctttgctgtttagctgtaggacaggcaggatagtggttaaaacaatggactctgtagccagattgccaggatttggatgcttagatgttttgaaagcttatttcaggtctctgtgccactgttttcctatcagcaaaataggtgtgaattaaactagttgacacaggaaaagggcattgaaaagtgaggtgttagcatatggtaagtatttaataaactcattgttatagatattgatagtgagaatatagtgatcagaggatgctaaacagagacccaggatgtggactattgaagaaggactcccttaattgtcttcatgcattcagatgaagacatgtgatagagatggaccttcaggaatgcctgtgctgtaaataaggaaataaaaagagtctcccggaaacagggaagcaagagaccccaggatcttcacatcagccagaggtgcaggatgctctggaccccagaaagaataggagaaagatcccaggtatgacacatacccagagacaccatgctcatgt

SEQ ID NO: 228 - DNA, 3121 bp, Homo sapiens
ataatgcaagcccttgcatggcaatccaaatttattgaactactgatgctaagttatacaaaattgcaccactttaattaaggcttttagtttacatttggccacctcaaagtagttgtaacattaggttggtcaatttaaatactgtggctccctgttggatagacacacaatctttacatccaaacattaatgcatacaaagcaacaaggcattgttaaataaaacagcaatagttactgcaaattaggccttgtgaccaattacatatgattaaaattacttcccacattcacatccacagtactcgtccaccatttaacatctcaaccaaaacgttacacatgtgaaacaatcactaacaggcaaaaatactaaacctgtatatttggtattgcaaatacacttatgcatgagcaagcaagggattcacagtgagaatctacagctgcagaagcctgaaaatgatttacaaaaattgttaaatcattaaaaaattgtttgaaaatatacacttcttgttgtagacccccactgtacacacgactataaacattgttccctatgtaaacaaaaaaaggaaacatataataagagatttgaaaagtctggacatttccttcccaacagatattaaaggcaacgtctttaatctaagacattatactgaaaggactatcatgttttaaagacaagatcaccgtctccacaggttttttaaaaattaaaaaaactatatagctgtgttaatcaaagcgcttattttgtacaataataatgaccttgaatttcttaaaaaaaattacaataagctacaagtatcaaagaagcgaagttatctggagtagtctatataggagctctttggactttcttttattatgctaaaatagtggtgcttttaggatttacattattgtactctccaatacaaagtatggggcatgttaaagtatacagtacaccattttcatacatgtacaacattggtggatgaagaatgtctcttagcagtaatactggatgtagcctctggttttaccagctgcaaactctaggactattatataagtaaaaatctctcttgtgatactggaaagtgattagaatgtgcaaactgatatagtagctttcatccgcctcttaaagggtaccaccacaggaaagtccatttaagatgttggtaggtttaacaaagttggaatgctggcactgttgaattgggcaacagttcttcagacctgtcaaaaggaaaaaaattaattaaaaacatgggctagaaaaagtaaagacccaaaagcaaacagttaagaaaacagtcttaaaagtgttagaaatgaatataatctaggctcttgttctaggcattacattagtggcaacataccacaattcacggcagaccttttcattccaaaaagatgaagtctattctgctgccctcttgaaagtcagttaaatgaaaatcttaggaacagaaagggaaagtacctttgtgcaaatttttgtgcattaccttccaaggattaaaaaggaaaaaaatcacattaaaattgttagtcaagtcaaccttattagaattaggattgaaaagtcagatagcaatattaacaaactgggtgatcctgtgtttacacaatcgtaatgtactcctagaattagatcataagtatagaatgcacatctaaccaaggtttctagtatcagataatcaagttcttcctcactctttcaatgaaagtggctaaaaagctcgttcagagcagacaaatagaatttatttcatgatggtgttttacagatttacaatcacgttatataatttctaattccatatttaaacattctattaagactgatgtcagaaaaaggtggtattacactaaaatcacatgtaattaaagattttaaaaagtaaacttagaattgttaaatatgtactttgaatagttttctgcatacatgcctcggctaaaaaaatgttccctattatatttttctggtgatcagacttgttacaagctccagaagagttgttaatacatatgtggctgttgaaataattttcacaaatgcctagaactttaggtcctcattctgagtctgaatgaggtttgcaatcaagttttctaaatcctggcagactgttgcaaattaaaaaggacagatggaagtgtgtgagctcaagcacatgtgtgctgctaagaatgggcatgtggtcaggaattataggatattagaatgagaggatataccactaaacagaaagccctagatggaaggcaggaataaaaactctgaaaagatgcagaatcaaagtgctatggcagcactgagtcaattaacataggaagaaataagagtcaggaatgtcaaaggttcttaagaataaattaacagtttaacaataaacagtttaatgacagctgaagaggaaaccattatcattggcaaacagcagcagctaatagttgagtgttaactatgtgccaggtaccgatgcaagatctgtgcagcaaaccccatggtacacctttacctatgtaacaaacctgcacatcctgcacatgtatcctggaacttaaaagttgaaggaaaaaaaaaaaagtggcacatgatgaacatgtcaggggtgtgtgtgtgtgtgtgactggcacatgatgaacatgtcaggggtgtgtgtgtgtgtgtgtgttttaaattagggacggttggctgggagcggtggctcacgcgcacgcgcgcacgtgtgtgtgtgtgtgtgtgtgtgtgtgtgtgtgtgtgtgtgtgtgtgttttaaattagggacggggttggctgggagtggtggctcacgcctgtaatctcagcactttgtttcagtcttaagagcttaaatttgatttttaaattagaaattgactaattgttatgtatacacacatacatgcaggatcaactgacctccccatcactttggatacaaatgaaaaagcagttcatttcacattgtatgtacttctcagtttgttccaagcatgacacttctcagctaggtggcctttctaagtggccaagatggtttatcttatgagtgagacagaaggtcaatctatttgcttgtgaggctttgctaagctct

SEQ ID NO: 229 - DNA, 1433 bp, Homo sapiens
gcttagcaactgtttaatcaggggggagatgcaaggtactagttcatttattaacgggaaaataatcgcgggtcctaatgagtcactcagcatcaaaatgcatcaaattcatcatctgtttcagtctttgaaaatgattaaacatcactttctttccctttatagcaagatccaagtgataaccaataaatcaggaacacagtcctattcacaattgccacaaaaagaatgaaatacctaagaatacagctaactatggaggtgaaagaggtctacaatgagaattacaaaacactgctcaaagaaatcagagctgacacaaacaaagggaaaaacattccacactcatggataggaataattacccatgtctgtgtccaaatttctcccttttttaagacaccagtcatcttggattaggtcccacccaactccagtgtaacctcttcttaaataattacaactcccatgagcctgtttccaaataagcctgtgtgtgtggtacaggggaagaggtacgattccataacaggaagagagcatggcaaacagtgaggctgagatggactgagcacctggtgtgctgggcttgtagcttccacactcactcccttggccatcccaagacacctgtggtgcagccattaggatcctaattttaacaatgagcttcatacaatgtgctcatgctcacacagttagctgagaatgcagttcagacagttggactccggagcccaaaccctttctactttccactggaacatgaccacgcacagggaccagatggaaagaggcaaagaccgcaacgcccaccagatgctttgcctcggaacagaagggaggaaaggatgtcttcaaagctcataggagactgttgttagggaagcagaggacctccctgtggggcaccgaggggcaggatggagaggcagacatcagcaccgagaccctctgacactacctctgctccatctgctctagctccacaggcctccctgctgccctggttaggagaggtcccctccatttagctcctcctgccccggggagtccacttgtcccttccctcccatctctcaggcctccagtccagcacctcttcacagtgagctcatccctgacttcctgcccccaaatcagggatttccctacaccggcattctccattcttatctcctgctttatttttctccctgacactttcttccatctgttagtaaatctttatcattgtctgtttcctcccactagaatataaacttcatggaggacattgaccattttgttcagtgcggtaaattcagcacctatactagtgcctggctcttgggagggctctgtaatacgcgctgaaggaataaatgtttccaagcagtcctggatgctggggctggtatgtccttgcttggcgaccagggaggatgtgtcta

SEQ ID NO: 230 - DNA, 5163 bp, Homo sapiens
agatagagtcttacagtgttggctagcaggctggtcttgagctcctgtgttcaagcaatcctacgtcagcctcccaaatagctgggcctacaggcatgtgccactacaccctatgctgctgctttttaatggaatgtttaatgcataagttttaggctccaatacaatattagtaagacttattaacttagcagatcaatgtggcaatattatttatcccaggaatgttcaggtgttcgtgtgtggtgtgtctatatgattggaaacccatcaactggctgtgaaagcagcagtttaggattgcccaaaagacaaagatttggaaaagctttaaaaagttttgaccacaaaggtcataaattttagtctagtgatgcagatttactggatcctgatgagcaacaggagtgaaaagcattttctagaagaaaaacctgtggtgatttctaggtaaaggacttcagatgagatcctgaagtaataacatattggcagctttagtagactcacaaacatgaggttaggcagcgatctaaggtgatagacagatgacatcagaaacaaaataagtactaggcaaggccatagccttgaatttttattagagttaggaattgaggatattctgaaccccgaggatttcaaccaagagaaagagtagcaaggcaatttagtttaaaaaataattctgatgtatattgggaaggattttattcaacttaaaatcagaaaaacaaccactaatagtttatgtgatgcttcttctaattcttacctggtattttagttctaggttcctattaaggttcaataaaccgcgacaattgaccaagggctgggctgtgataaagtcttccattttaaacaaatacaaataacattgaaccagaaagagacatcaagtccatttaaggcattggtgtgtttgtacaagacctgggttatgtaggaatagcagtaaagaacaaagcctcagacatctgatagacattgcttttacttcctttttatgtgactttaagtgggcctatgacttaatctatttgacctttactaggcctatagttatctttagtacatattgccagttttctaagtggttttaccattttacattcccaccagcaattttttagagttttagtgtctccacatcctcaccaacattcagatgaggggatggtggtttctcattgtgattttagtttgtatttctgtgatgacaaacggtatatatcaccttttcatatgtttattggattcttagatatcatatattgtaaggtgccttttccgatttcttgcctattttttaaaatgaggttaggtttttgagggttggttggttgtttttttgttttttgtttttttttgtctcttttattgattagtagtttaaaagaaagtatattctagaatatgagttctttactggatatgcatcatgcaaatatcttcttccagtctgtggcttgctgttttactctcttaatggtgtcttttgatgaacataagtttctaattttaatatagtcacatttatcagtttttccctttatgtttagcacttgtatgtctttagcacttgtattttaaaaacttttgtctaccctaaggtattttataatatttcagcagctttatttcaaagtttaaatctttaatccattgagaatttgttttagtaagagatatgaggtagggacccaattttatttttttccaaatgcttttaaacttctctgaaaacattcctcaattaatattttaaactccacctttagggtgttttcaatcacaataatcataagtttatgatataaaacactccaatacttagcaatgttcaatgaaatattaaaacaccaaaagacacaatctcagaaacagataaatctctcagtgaaccaaatatagaacagaaaagcaaaacaatgagtggagctgaagtcaaagggcttctgtgttgtgggtttcttgtttttttaaggggcagtatttgctgggagtttagctgctatgagataaggagtacttaaagtatatgaacaaggggcatgaatcctgatttccatatgaaaccaggggccggggaaaaggatcttcttctcatgaaaaaaggcaaaaaggctaggggaaaacaaagtttctggtcactacactgggctgtgactttagaaaacttcagggtacatttgaaggaaggtacatcctcgtaatcagaacagaagtggttgtctgtgagctttgtgacagcatcaggtttatctccattgtcaccctgggacaagaatcttaatatacctttatcagacctcatctggattggagtgatcatgacttgcgtagatataaacacaagactacctggccaaggtctgggttgaataccgaggaagagagaggaggaaaaacaatacacaacaggccaaaattccatgcctgtcgatcaggtattccttaaatccctggttagtggtgctggctgaggccctgaggaaaggaaaggcaaacctacatctggaatggataccaattgctgtgaggaaaaaaaccaaaacaaaacaaaacaccgtggacccttcgaggataaaaggagcccaacataatcaactttccatctaatggctggttgtcacattggaggctcagcactgatatgtgttgctggcaagtgggacactcagagacaaccgtagctatatcaaccttggtgagtgaaagcccatgccactgagtccatgtatagcctccatttctgcctctctggtcacttcattcatgggccattgtgctggggtggccagtgacaaaaactggctaatattaactcaccaagtcattttgtttacttgattgtttaatgctccttccatgataataatttcattttaatgacgttttcaggggccaggtgttgtggctcaggcctgtaatgtcagtgctttgagaggccaaggtaagagaattgcttcaggccaggagtttaagaccagcctgggcaacatgccaagacccttgtacctttgtaatgagcattagtgtgtgatacaacaatctttgtacttcattcatgtcaattctcataggcctatctacatgctggtaccccagaagtccttgtctctgtatctttcagtcctccgtgtttctgactagtaggccaagccatttgtcactgcccatgaatccatacatactctcgtcacaagcccactccttccacacaaggtggatgaccattgcctgaactgggaccatcagaaagattttccctctccactgtctttcaaggccacccgtcaatgaagttgtaatgcagctgccattcatttttggcttgagtaacctattcattacctcaaaacccaggctttgtctacctccttcacatggttgtacatatgtgtgtatatataaatgtgtgtacataggttatggtatgtaggccataggtgtgacttagggaagaattctgggtgaactgtggtggatgatgggggggtccgctcatgcagcttacatgtgccccgtggtcctgctcgtgattatcctgtatgtagtatttctattttataatagattattggcaagccatcttaactttatgacttactgagttcagcagttctggacatacggtcactaagtgtcacatggtcaaatttccatctctgtcaggtcccagtatcatatcagaagctgtttttgttttgttttgtttttgagatgaagttttgctcttgttgtccaggctggagtacagtggcacaatcttggctcactgcaacctctgcctctggggttcaagcgattctcctgcctcagcctgcccagtagcttggattacaggcatacaccaccatgcccagctaattttgtatttttagtagagacagggtttcaccatgttgaccaagctgctcttgaactcctgacctcaggtgatccacccacatagtcctcccaaagtgctcggattacaggcgtgagccaccacctggcccagaagctgttttttaaaagtcatataattttatgctatagatgtcacagaccccaggttctgcactgtgattcttcctctagagtttactataaacacactgccctttttatcaaaactgatacatataataccatagggtctgctggattgtatgactcaagtggctgggcgacttgcatcacagcctgtaccttctaaagagctcttgttcccagccccactcaaagctggcagcctcttatattgcctgatacgtacgtaggtgagctcagtatacctagttgtggaatgtgtggcctccagaacataaggaggcttaataggcatgtgtctcctacaaataatgaaagtattgcctcttcctttccaatttaagaccccatttttctttctcttccctaatcgcatttgctattccttccatgacagtgctaagtaatagtagtgaaagtgaactactaaaaatttattggcctggtgcattttgaggtgtagctttctgacgatcaaaattttttttgtatcataatttgtccatttagatttgctgtcttctctggagctagatttttattatttatattttcctaaaaatacatccattttaataatggtttcaggggccaggagctatggcttatgcctgaaatctcagtgctctgaaaggccaagataggataatctccagaggccaggagctgaagacgagtttgggcaacatagcaagactctgtctctacaaaacaatttaaaaattagctgggcgtgatggtacacatgtgtagtttcagctacttgggaggctgaggcaagaggatcacttgagcccaggagttcaaggctgcagtgagctatgatcatgctgttgcaccccagtctacgtgacagagactctgtcttaaaataaataaatatgtagagttgagaaaagcaatcagttataatttgttttatattttatctgaatctgttctctccacattctaatttttttttgtttatttatgtttcttttttcttgtttaaactacttattagctaaatggtttgttggtgccctccaatttcttgaattggaaacttaaacttttattcctatgtgaataacataaatgaacataaatatttaactaatgttacatattatcctctgg

SEQ ID NO: 231 - DNA, 6399 bp, Homo sapiens
attgaggcgtgtcttccctggttctgcgtccgtgaagcctagagattcccgagcctgggtcacccgggcggtgtcgcatgtcgtctgcggggaggttggggctgctcgcgcgaggcgctctgggtctcatttccgaggccgaaaatgctggctccaaagtggtgccctgggagatgagggcgactcgcagattccaccctattctctgaatgggcttcgagtctccatggttggatgtattggatgttacgaccactaaactttcttctgagcacacacgagcagtggtgttgttctctctgagaaatactacaggctttggtgttaagacactggaattccggaaacctgtccctgtcataccagttgctgtgtgacctccgtcaatcatggttctttactgagccctgagactccgcacgtgaaaatggatggggatgaacttccagtccaggcagtgccactgactttgcttggggacctggggcaagctctgtggcccagcattgcaccatctgtaacaacataaccaaggggtgcgcaattgagctttgaggttaatttcggtgctaaaatcccggtcagtagttccgtcatcttcacagacctcaccctacccaatgcccttattgtgctccacatcccaatcaacacttactgattccagatttgtaatttttgccattgtagtgagaagtaattaactattttatggttttttaaatttgaatttttgactatcaggattagcatattttttttttcttcgttaaagactagtcaagtgcattagtgaggaggggggaaagagtagaccaaggaatttggtctgtaactgactgtggacaatacattggtagaactcactacctttgagccagccagaatctttttattattcactggatattcaggttttgcctctgtaaattttctttcattgccatttttttcaaatagttcattcaatctttgttttcagatgtgctttccacaatcaggttacaaattctctgccactaatgatcattacaattcctcttctcagcctgtttattgtttggtctgtttatggtttctcaggcttcttatttatttatttagacagagtcatgctctgttttccaggctagagtgcagtggtgtgatcttggctcactgtagccttgacctcctgggcttaagcaatcctcccacctccgccacctgagtagctgggactacaggcgcatgccaccacctgcagctaatttctgtatattttgtagagatggggttttgccacattgcccaggctggtctcgaactcctgggctcaagcgatccagccgccttggcctccagagtgctgggattacaggtgtgagccaccatgcctggactaggcttctttaaacattgaatagtgttcctttctagatgaaggaggatcacatagcacttgggagcaaagatgcagccaagtaacccagtgctggagcccacgatggagaagatctcacggccactctggccttgccctgggtgctttagtaactcgggaggaaggccacccagacactgcaggacaccagcatgctgaaggtcaggaacttggcttcgttgaaagcatcaggcaggttccttgccagaaaggctacagcaagggaccctaaaaccaagaagcccaagtagcccaagacagagtagaaggcagtgacggagccctcattacactggataatgatgtagccaggcatgaactgagggtccttgtttacgaagggaggctctgtccccagccagattccacagagggtcacttgggtaaaggagcaaaggaagacaacagaatttgttttttggggacccatccactttcggatcctgctttctggccttatagcctggaaggccctgcagaaaacacagccactgtgaacacagctgcaaaggtggtctgtgagaggaggcaggtggcagggctggggcggccgatgaagagcgaggaagagagaaagcagagtgtgagggagacaaggagggtgtagctcagagtctggttgctggccttgactatgggagtgttttggtgccacacaaactccacaaggatcagaacagagaggacagagtagaacaaggctgtgcatgccagagtcaggcccaaagtttcatcataggccaggaaggtctcctatttgagaaggtatgttcccttttcttgtttggataatgatattcaggacaaagcctgcattgttttatatctgaaataaacaaaaagggtgtcactgtctccaaaacagagcactgcacgtttggtaagattccattgcccagagctctcaccaccacagcgccatttaggtggactgtttggctggtgtgtgtgtgtgtgtgagagttgtgtgtgtgagttgtgtgtgtgcgtgcacgcaagcatgcgtatatgtgttctgcatgtgttttaaaggaaaacataaatacttcaccagcttttttttttgaccattttaatcagttttattgattcatgcttccggttcttattcagttcaaaacaaggcacattaaatacatcctcttattgctttataaatgcacgtagctcattctctatatcaaaagtaataaataatggccataaaacaccaagacctttataaaaatgacaacccagccttgaacatagtatttaacagtccaatctagaacaataacccaacacggtacatcaaagtgccacatatgaaaacatgcagtgtgtgtagtcactctagtactgagcttgcactggctattctttaaaaacatactagggctttttcactccttaaaaaaggtggacatgatgcaaacattgcaagttatagcatcactgactttaatattacatttatgtgccaaaaatctttacagatacataagagaaaataaaatcaatgataacaccgtatatttaataaaagtgaaaatgagttttttgttgtgccaaagaggaagctacatattttgaaacagacaaagccaagccagaaactgaagcagaagagggatcacgcatttaatagcagaaatcctaatacactcagtataaattgattgaaagcaggaatattgcaaacagcatgatggatatgaggcagaccaccgtggctaaacaaataatccagcattatcattattgttatgactgtggtggggctatttaaaggagtatccaactctctagcacagatgggggttccttcacctgactccccttaaaggctcttgaaataaatcacttgataataaaaggcaatccctgcatacccaccccaaccccaacagaatcaactaatgtcaagtttatatgcaaatggaaaattttttcttttgttcttggaacgaatttcaaagaagctcattcccccctatttcttgtctccctttcttaaatcaggtaaggaagctgtacaggcttaattcagaacttatggctgggtgcagtggctcacgactgtaatcccagcactttgggaggctgaggtgggtggatcacgaggtcaggagtttgagaccagcctgaccaacatggtgaaaccccatctctactaaaaatacaaaaattagccagatgtggtggcgggtgcctgtaatcctcactacccggggggctgaagcaaaagaattgcttgaacctgggaggcagaggttgcagtgagccgagattgcaccaccgcactccagcctgggcgacagaccaaggctccatctcgggaaaaaaaaaaaaaaaaaaaaagaatttacacaaaatgctggggtgctttattcacagtaatggcttgaaatcagttcatttccaaacgagtctctgggattggtgaaggaccgtgtgttttagcatttagcagattttaagtaaaagcagatatgctcaaaagaagaaaagtgtgcttttctttgtccttaaaggaacttcattcatagcaaaatatgcacaaacaagacctgtttaacaaacacagatctgctcgggccagtcgcatcctaagcccggtccctcctgtaactatggtccactggaattgggactcttctgtcgaggttctcttctgcagttttcattagtataaagagccggcttccagacacccttcctttttgaatagcactcatcagctgcaaaaattcattgagttcaacctgtccatttttattcaaatcgacttcatttagaatttcatggagtgtattttcatccatttggacattgatactctctaatacacatggaacatcaacaatggtaataaagcctttctggtctgcatcagacttacaaaatctcttcttatacctgtcactgtctgaaggcagtaggctaatttcagagccatctgttaactgttctgatcaaagtttagtctgtttcataatatagaaacttcctggttgtttcaagttgttcctgtttcttataatcatctcaattctgttctctgcccattagttcaacaatcctgagtagggcttgctctgctgcccggacatttagaaaggccaggcgaggctgaggcaggcagatcacctgaggtcaggagtttgagaccagcctgaccaacatggagaaacccaatctctactaaaaatacaaaattagccaggcgtggtgatgtcctgaccaacatggagaaacctaatctctactaaaaatacaaaattagccagggtggagacccaatctctactaaaaatacaaaattagcctgtaactccaggtactcgggaggatgaggcaggagaatcgcttgaacccaggaggcggtgattgcagtgagccgagatcataccattgcactccagcctgggtgacaagagcgaaattctgtctcaaaaataataataataataataataagccaggcgagtacaacgtgaaatcatatccacggtggtgcaggaatactccttaatcccatagttcacctctgcttcaatatatggaaattctgacacaagacgtactccaacaataggccaccttttgctagtcacacttgccattgtggccacctcaaaagccttatcaccataggtggcagcaagatgctgtgccccctcgctttcaagtccataatcctggacaagcttcatgtagagtgtggggttccaatctttacccccttgaaggaaaagcccagctgttctacttggtcctgctttcaaattgtgggttttgatagcagcatttagggtatcttcgccacagaccggtaagttgtccactttccacctgctgtagtaataagacttctctcactgacatggacaacatgatttcaggagatagactgagtatctgcagatttgggatctgtaacaaggggacggatactgctccacgctgctaggatgtcgcccctcttctcacctcaacatcacagctcaggtaattacgtgcttcattcaaaatgaagttaatatcttcttctgaaggacttggatggtgtgtaatatcagttggggtatcagtagtgccagcaatcatcatcttttgccagggtaagaagaaaataactcgcccatcactggtcaagaagtcccatgccctctgggctgtaataaccaggcatcacaatgtggacaccagcagttggctggcagatagctgcagcatccttatcatctattttgcacacagagtctgtgaaatgtccaacggcattgataacacacttggctttcatgtcaaattcctgccctgtgaggacatccttgcaccatgcaccactcacacgcactttcgctgtctgtctgggtgtctgtcttcttaagcaagctcactacctccctgtcattgactgtggcatccccatatctggcagcagtcagcacaatggcaaggttcatccatgcatcgttatgtcgtccatcatagtagacaattcctcctaccagtttgtccttctggagcattgggaaatgttcaagggctcttgatttgctgaggacataactgcttttcaggcaattacttcctgcaaccaaatcatacagcttgattcctacccagtagtaaggtaactgccaccacttgtaaactggaagcatgataggcaatggagctgataaatggggagaaatttctggcaggttggcacgctcatcaagggcttctgttaccatccggtactgctcaatatccaacttcatcatggccttctgaagatatctcacaccaccatggatcaaattagtgcttctgctgctggtccctggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaag

SEQ ID NO: 232 - DNA, 961 bp, Homo sapiens
catgactgtaaaagctggattaaatgggcttgtctatattgggtgcctagttaccaggctgcttccaaagtggatactgtggccatcagtgactccttccttgacctcagcaatagggactacgtgtccagaaatgattctacccatggcaagttcaacggcatcatcaaggctgagaacagtaagtgcagtcaattgaaatcctaccttcattttccaagttcaagatccccccaacatcaaatggggtaacatgatgttgaatacatcatagagcccaccgcactctttaccgtcttagacaaggctagcaatcacttgaaaggtggaagcaaagggttattattcctatcacctgcgccaatgctgctgtgctcagaatgggagagaactgtgaagatgacaactccttcgaaattgtcagcaatgtcacctgcataccaagtgcttgactctcctggcagaagtcatcgatgatgactgtgctaacgtggaggaatctcagaccacagtccacgccatcactgctccccacagatcatgattactcctccagcaagctgtagtgtcatgtcagtggtcattatctctcaatccctggccctgccaaaactgtgtgcaagacaacccctgagttgaacggagagttcactgatttggctttccaagtccccaccgctggtgtggaaagtgtgttgagaatgagatttgccatctggagaaaggtgccaaatataatgacatcaaggaggcaatgaagcaagcatcaagggcccctggaagagcatcccgggctacattcaggaccagttggttgcctttgtgacaaccactatcccatttttgatctggggagggtattgctctcaatgatcacttaatcaagctgtttttttggtatgaccataaatctggccataggaattgactggggggatctatcttatggtctgtgtgacct

SEQ ID NO: 233 - DNA, 1796 bp, Homo sapiens
ggtgacacgcacctgtaatcccaggtactcgggaggctgaggcaggagaatcacttgaatctaggaagcggaggctgcagtgagatgagattgcgccactgcactctggcctggcgacagagtaagatgccgtctcaaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaaatgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaaaatgaaaaaaaaagccaagaaacaactgacattggtgaaagtctgtaattttcagatccattgatttacagaagaagatgccctgaacctctcagaatattttctagtgtgattttttttaatgattaaaaaaaatgaagaaaatattaaacaagaagatcaaacacatttcattgagtggtgtctcatatgtttttcttgtttgggatctatttttataattgatctttttagtggattcttgattgtagtttaacttatttctcttttgtttctttttgatgatgcatcaattctgacatttcaaaggtacagctggtcttcattagatatgtgctgttattgactttgcttaacaagaacagaccatcatcgtaccaccttgagttaactctgtgccagctggccttgctcttgagaaggtcatttctaaacagaaggttattttttgaaagatttttaactggtgtaagaatctggcagcagaatgtacttttacctcttggtgccactgtatttaattaccctctccccatttatcctccatgtctttcctaccataagctattgataacacacatgctcatggtttaattgtaagttgttcagaaatagaaagctgactgtactgcagggcgtttttatatttctcttttgcaagatttgaaataaaaatagatttttgcatga

SEQ ID NO: 234 - DNA, 3666 bp, Homo sapiens
cttttggatctctactcccatctccccctgagttcagacttgcaccacctactggctcttcactgaccggctaactgatgctcaaattcgacgtatcgaaagcagaactcacagtgtgcccttacagacaaagtatgggcactatttcatcagcgggaagaaagagaagtatggtgccctaatataaatccatcagtgtgcccttccaggattcctcaaggaatgaacattttccagaagcaaaacatcgcatctttccattttataggacaatgccaactcctgaagatcttgctctaagtggtcaaagggtgagcatactgcaggcaacaaaagatcgagcatactacaggcaaccaagggtcaagacaaatttacaggatccctccctaccgtggccactacccagcttcccagtagtgccttcctaatttgctgcccatggtaatggagacaaatacctgcagaagaacataatcaaaactcaaaggaaagttgagcaagcactggaacattcacaaaggcagacagcagacgtgctcatcaaaagcatttttgctgcatattgggttatcaggatggacatgcatggactaatcaatgtgcttcaatgagagctgtagaaaaatggaatgagcaacaaatggagtcatcatacagccagcatcatatagaagaatgacaaagagagaaaaaataaaactttctgggaaagaaggaataagaagctggattggcagaaagatcaatgtggttttccctagagcttcctgggcagagcacagaaaaggctggttgcctatggagaactacaaattgaagagtttcttaatcagtccactgttcacttgattcccagacacagacaacatgagtttaattatccggagacatttcaaaggatgttgatgtttcatgatgggaaaacggctacttctacaaagaattgatctttctgaatagaaagaaggtcattcctgtgagcactgtatattttgccaacagaattagactggtcagttaagaagtatgccttaattattaagagcataggatcaggcagtctgagctctgagttcaaaatcctaaccttacccttaccaaccaagtgcctattgggtacagaatcataacacttcggtaaaatgattcccgtgaacacaaaatatacggtactctcatgagcaccatatatttttccaacagaattagactggtcagttaggaattagactgttttaattgttaagagtacaggatcaggaagtctgagttctgagttcaaaatcctaaccttgcttttaccaaccaagtgcccattgagtacagaatcataacaattggatgaaatgattagcatgacagtgcctagatgatatggtgttgtatatattcaatatgatgtaattttccaatatccattgaatgtgtaccatgtggatacaaggagaacaagaagatgaagtctttctcattgggaagctcacatcttagtgaccctccagaattaatatatctaaagactaaggacagtaccaaacacaaagtaattgctatctatgctgttattcatgcaaatgattaaatcagtgcaccccctcccaatcatggattgctctaatattacatatcactcttatattataccttcctccagacagtaaatggaaatctgcactcctagagttttgtgttgttattcttaatgatgatatggcaagagactgcaaacatcctgatttgcaaggctagggagcttggaaatgccaggaaatatgggaaaaatcaaaccccattctttcaactcactggcgattttttcctggctacactgtcttcatttaatctacatttccctaccagcaggtgctcaccaactaccattggtgaaggcaccagtgagtttctggtaaggatctgagttgttcctgaccacagattggaggaaccatgtgggaaaaggtgtagcattgcattctcttggaacacagactttcgtcatttggcaaagagattcatcttgcattttttagtatgatggcaagcaatacatgatggcaagcaatacttaacttcataaccttgattcatatccttccccctaatgctcctaacaggacaactgaaatttatattgcctgattgaaaagaggctttatttgacccagacacaaagttagctttccaatacttccctagcttccaagccataaaaaattaaatgcctggaatgtgtaccttacaagataaaataaatgagataactttttactggtaaacaatcaatagcctattaaaataaaactagcatacaattctctgatttttgtagagggacattttattttggtcctgtaagtttccctagtagagctggaataattgtagaatagattttggaagtagtatgttcaggcataaaataatgcaatatgcaataactcaagttgataaacaggttaattgcaatgatgcttggcacgtagatctttttctgctaagactttgaaagttagaaaaactcataatatttatgtttgtcatttgaagaatttaaggggttattaatattcagaaacatgtactaatttcctttgaagggagataacttactggctgtaaaataaatattggccttggaactggacaaactgagcttaaatcctggctccttcacttatttgctatgtgactttagataaatgatttaatcttgattttttaaatctgaaaaatagggttaatgatacctgatgctttagtagtacaatgaggtattccacaaagatagtggaaaacagggaaattaggttgcatgtaactactatcttaggagctttaacaaaataataaaatacctgggttctcaaccccagaattctgatataattagacttgaatgaggttgaggcacagtatttttgtcaaaatccagacagacatggtccctatctctcatgaattgcacaatacagtagaagttactgacgttataggtgaagaactaaattgaatatgagttttagagccaggaagatctgtgatattttgctagctgtgtggccttgggcaataacttaattttcctgagtctcagtttccccatgtataaacactaacgttaatgcatttgtatctcttagtatagtgatttaggactgccacatagtaggtgcgtcctaaatatcattattcattataatttcacaagtattattggtaatattttacctcaaaaagatactatgactgatcgtttaggtctacaagtatctaattgctcagttgtaatatttcactttaaagtgaataaggtctccaaaaggttaaaaaaaaaatcacagttctatcttattagtgttgaaatgggggcagttacagcctcttttccatgccacttcactagtactagtactgtcaatacatttcttcataaaatatatccatcagacatggaatattaggtattcagagttgatctgtactttcatatacatattgatttaaacaacataattttgtgattttgttttcaatttccatcttgcatgttttagaatttcatcttctatcttggtatatggaacaatgtgtcaataaacatcagtgagcataaaggaaggatgactcaacaaattcttgcatccagttcaatttcaattcagg

SEQ ID NO: 235 - DNA, 971 bp, Homo sapiens
taagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaatgaatgatttttgcatttaagttgtttgaaggcatgtattttgaaaaatatctgttacaaatttataatttcaagacatactaaatcttataatacttttggaatttcattaataaggctaaaatctgaggaatgtaactaattttcagccttaagacacttaagtttggaagtccttgctattcaacagaataacaagaaaccttcagaatgtatcactctcccaaaaagaagatattaataagcccttttcttttattcatggttatagtttttttatagtctcaaaattcctaaagcaatgctgacagccattgaatttgccatattttgtattcagtgctgttaatgtgctgttgcctcaagaaaaagtgctttttctccattgatgaggctagaccctaagaggtaattaagtcaatgtaaatcaaatggaagtttttcacttttttgatcttggaaattataggtatacatttccctcttactactgctttttgctgtatcccataggttttggtatgttgtgttgccgtttttatctgcttcaataaatttttcaatttcttctgaatttctttgttgaaattgtaaggatcattagaggctactatgagcaaccata

SEQ ID NO: 236 - DNA, 1096 bp, Homo sapiens
ttgtaaggtgacaatactttgagcaatgttatccaggctttccataaaatccttggacaagcgttggtaataggatagggaagttgcaatcccgctaactcccattcctacccctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaacttcagtcccgtatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacacca

SEQ ID NO: 237 - DNA, 1489 bp, Homo sapiens
ctctgtaaacttcagcattgatgatgaacattatttcaaggaaatatcccactactttatctctgtaaagacatccatagagaatgtaagttataatttccttattcatttttctggttagagaaggcatttctattttaatggtcaattattatattctgaatttgccacaagtctccttttcatatttaaacactagggtttttttttgtttgttttttaaattcttaagataaatagaaaagttaaggttagaaaatgttcaaaacaattgctcaccttataaaatcttgttagggaagtaattttgctcatttcatactgttgacatttctgaatttcagtaatcattaatttttttaaagctgccagcagatatgtacaatactccttttagatattattcccatcaaagacagatttcacctctttcactctttgtgtcatttctctattattttgaaaatattactaatgccttcaagttcatttgtattctgtaagattctccttgtatccaagcaactccatctgaaaaaataatttgttttttttaatgagagatatattcaaaacaaaaccctgcatatatttatgattttttggtaataattttcatgatactaatttcctggaaagggatttgcacttcacgaacaaacagtgatttcctttgaaaccttctctggtctatgtcaccacagttatctaaacaatttagatgtccctttcttgactaaacttttaaaaaatgttgattctgttctgtttttagaaatgatacacatcatcagataatttgtaaaacagaaaatatattaaaaaataaaaacttccttaaataaccatgggataatcaaggttgtagtagactgccaagtgagttataaaaactccagaattatgtcagaattagacagataaccaaagaatctgtggggcactttgatgaactcaagtgaatccttatattcatctttactgagaaaactgttgggaatgatttcacttccatttttttaaaaatataaagcatatccttcagagtggcacatgcagaaatattttttatgcgtgtatatttactgttaagtacacaatacgcctatgagaacaaccatagctaatagctttaagaactgtgcttggggcgaagggaaggaatgtgtggctggagacttagtttggcatgactgagaagcacccaagcggagtaaggacgggtgtgtcggctgcagccaggcggcagttctggtacttctcagtcatgacatttggggtcaggtaactgaatcctcatcagcaaaaaggggataatagtagtaatatagctctcataatattgttacaagaattgcatatacttatattcacaaaataagtaaaatgttttgaacagtgtcgtgaagttatgtcctatgcaggtattttactgtaattgactttatttttgttttagagcagttttgggtccacaggaaagttgagt

SEQ ID NO: 238 - DNA, 5651 bp, Homo sapiens
ttagtagagacggggtttcactatgttggccaggatggtctcgatctcttgaccttgtgatccgctgtctcttcttgccacgcagttctgcaacccgtcctacacagagtgacagcagcaaaactgtggtggtggtggtgattgttttcctttttcttgctaagttttatgactgaaacccattaacattgatctcaaccatttgagttgtttgggggtacactaggggttccagaaaatgagttaccatcagatttcatctatttctggttgatctataagtgttggactttcatagacctccatccaactgactgaaaattttcaaacaggcagcaaagatagaagcatagtacaatgaacacctgtagactgtctccctggctctaaccattgtttatattttgtcatatacagttttctctctctctctctgtacacacacacacacacacacacacacattttgttttgattttttcttaaccatttgaaagtaaattgtaggctgagtgtggtggctcatgccagtaatcccagcaccttgggaggctgaagcaggcagatcactaggtcaggagttcgagaccagcttgaccaacatggtgaaaccccgtctttactaaaaatacaaaaattagtcaggcgtggaggcacgcacctgtaacgccagctacttgggaggctgaggcaggggaattgcttgaacccaggaagtggaggtggcagtgagccaagatcacaccattgcactccagcctgggtgacagagcgagactccgtctcaaaaaaaaaaagaaaagaaaagaaaaacaaagaaaaaagaaggtaaattgtaaattgtaaatgatcatgatacttgactataaatatttcattagatgtctaccaaggacattctcctatgtatctgcgacaccattatcatacctcataacattaatttttaaaaaaattaactctagcgtcatctactatccagttcatattcacgttttcccaattgcatccaaaacatcttttatagcttttttaaaaaaataaaaaataaagcaggatctaatcaaagatcagtatgttcattgttacgtctttttatcaacttcaatctagaacagtctcccagactttttgttatgactgactttctgaagggcctagctgagttgtcttatagacaaccccacagcctggatttttttttctctctctctctctgcagatttgtttttgtgtgttttttgttttttgtttgtttgctgcaacctccacctcccgggttcaagcgatcctcctgccttagcctcacgagtagctgaaattacaggcatgcgccaccacacccagctaattttgtatttttagtagagacgaggtctctccatgttggtcagggtggtcttgaactcccagcctcaggtgatccacctgcctcggcctcccaaagtgctgggattacaggtgtgagccaccaagcctggcccaggtttttttagttgagcaatgttactaccttgttgaaggtaagaaagtgtgtctctgccaataggcaatttcctcaagatatgttgccatgcaggtttattgacatcttatctactcctaaaaagaatttgaggcagtttataataaaagagaaagtctgttgaaaaaaagagaaaatattttcttaacatgtagaaggatggtgggtgggaggaaggaggggaatagaggtgctataaacacattagtgtcgttcgtataactaaacgcaaaatttcactttaaaatgagttcagtcgaggtaacttgatttctgcatctaacacgagggagaactgaggatgggtgggctgcctggctcccactcttgtcctcagtcccctactgtctccctcggccttccctgggcaggtcctcaggtacaggcagatgtcagctggaccccagatgaggaaacagagcaggtgcaaggctggacctcaaggatgaagctaagcctgagtcaggggctgtcccagacagacagctcctcatccaacaacctccccacagagctgggctgcagctgaacttgcattttatgataattgctttttcagtctgcttaagtgctgaacagcacagcagggctgcgttctcctcccctggagaacgtttacagatggtgttgcagtgaggatggattcctgtactttccgagggtgggggagcaccgtgttgtcctttcatgccactttgcctcctgtcagtcccatggggtgggtttgctctaaggtgtacctgtggctaacccgaagggtttcatatggccatttgaactgcagaaagtgctgccaaaacatacaaaattcatgtgctttgagataataatttttcagttgcttatacatgacgttacagaaattgttggccacagagaaaaaattccccatgatctcaccactcctgaaaccaactaagtcacctgctcagagccactctctgtggactcccttctgcattaaaggaaatgcacctgttcatctcctttctagaataaaacatgactatacatgtcatttagatgtgtatgtgtatgcatacctatatatttgtattcttttgtggtctttaaatgtatttttatagttataattcacataccattttgtacagtactttttctcacttaattttatagctcatgcttttttccattaccatgtggtctttataaatcatttttatttgtattttattttttacttttatttatttatgtatttatttttgagagagtctcactctgtcacctaggctggagtgcagtggtgcaatttcagcccaccacaacctccacctcccaggttcaagtgattctcgtgcctcagcctcccaagtagatgggactataggcacctgccaccacccccagctaatttttgtatttttagtagagacagcgtttcgccatgttgtccagactggtctcaaactcctgacctcaggtgatccgccccctcagcctcccaaagggctgggattacaggcatgagccaccacacccagcccacaaagcatttttaaaaatggataaatgattttctattgaatcaatgcactgtaatttaactcatcccattttcaggcaaagtctgttgtttccacctctccttttcatccattatcattcacacttccctagccataattacacaataagatcaatggcttgccacaacccttcctggcttgtgatggttagattacgctggcctcagggagggagatggttgcatttcctcttggtatggctgggaaagatgcaacccactcaatatttaaatataaggggcggggacacagcctctttacacagcctgagactgacaccttgcccaggggaatgagcaagagcaggattgaacccagagctgggtggcatcgtgaaaatgggacactcagggtatcagtgacaaataatttagaggctgcttgcccctggagtagaatgtctggcacataaggccaggtgtgcgcctcgctgaggagtctgtgcgtcatcttgatgggatggtgccatggtgattgtcagccagcctctccttattgcccgctcaccccacacacaaggcatgttgatatggaagagagacttgaaggattgccaggcatcggccacacagaagatgtgacggggagttgtcctaaacccatatgtttttatcatcctgtacttgtcaaagagctttgaagttcacgaccttgctctggttcccacggggggatcgtcctgggcttccatcatccctttttcctgtcaaccgtgtgttgcatgcagatgccacccccatgccttgccggagactcccctaaaaagctgggattatgtctttgaaattattaattttcatgaatagcatgaaaaaatttttttgtaatcccagctactcgggaggctgaggcaggagaatcgcttgaacccgggaggcggagtttgcagtgagctgagatcgcgccattgccctccagcctgggcaacaagagtgaaactctgtctcaaaaagaaaaaaaaaaatttaaagccacttcactccagtgaactaagctattgcaatttttctgtgttcagttctagtcctcagctgcacaggcacgtcagatcttaccaatttatttaagttttattttaagttcaggggtacatgtgcaggtcggttatataggtaaacttgtgccgtggaggtttattgtatagattatttcatcacccaggtattaagcctagtacacattagttatttttcctgatcctctccctcctcccacccttcacccccaggtaggccccagtgtgtgtggttcccctctatgtgtccatgtgttctcatcatttagctcccacttataagtgagaacatgcagtttctggttttctgttcctgcattagtttgctaaagataatggcctccagctccacccacgttcctacaaaggacatgatctggctcttttttatggctgcatagtgttccaggaggtcttaccaatttattaccatggtgacgttgccaccctgcattctgtttgctcattttctctaatgtggtctcatcatcaatattttcccacgtggtacaatgtctacgtaatcaccattttaacagctctgtgcccatccagagaatgggcgcgccccactttaaactctcgatgctggacacagaaactgagttcacaattgtaagccggaagcatcttcaggcacatggagtatttggcctacagaggacattaacagatggagtttagtggttaacagttggtcacacccaatgtcaccaacctggcacctaagggtgcactgtggggagcaccctcctggccatgtgtccagagcatcccctgcccgtgcagaccatccagccactctctgcctggctggaccctggcattcccaggtcctcttcccacacttgcggagggaaggcacagccagatgtgcagccccacccgagctaagccctgctccattaccgaccggccccaccgaatgtgttttctgtgtagttcgtggctacgctctggaatttcagaccacgctgaatttacttgttttatggctaggaatttcaggaggagcaccacagatgttaaacgcaggagtctcttggtgctagtaaaataaaccttactcaaacaggggtgtcgtgactcaaagggttagatagcccatgatacaggatgtcggtcaccaatgcagatgttgtaagttgagtcatttgacagcatggtaactttatatggccagagagccagctgtgactatttaaagggatggggggtcagggggaatgcatttttatttctagacaaatatatttctgatcgtaacttaaatactttcttttagtcaaaatactgatttttctttctccccgcattctcgaaagagaagcccttcctatccttttggcgttcaaccccaccaaactggcttcacattagagaccctgcaaggcttaaattagaacctcacttttgaaacctgttggaaggactttttttttaattttattattattatactttaagttttagggtacatgtgcacaacatgcaggtttgttacgtatctatacatgtgccatgttggtgtgctgcacccgttaactcgtcatttagc

SEQ ID NO: 239 - DNA, 1126 bp, Homo sapiens
gttggtcaggctggtctcgaaatccagacctcaggtgatctgcccgcctcagccccacaaagtgctgggattagaggcgtgagccactgcaccctgcctcatctcattcttatctcttgtttcagtgagccaatatgttattttattttattgagagccaagcgaatgtactctaaaatataccagagaaatataccataaaatgtcatttggaaaattttatttttctctgtttatagtgtccttaaacatatatttccttttactcatgcatgcatgatgagacttctatctaggaattatatttgatttctagtggattgagtaagttcttcttgaattcctttgaactttacctatatgcgtgattgcagtctctgacacatcatcctcataatcaataaatatggagactataaaaagattctctaacataaagagaaacaaggcaaacaaaacaaatttaaacttagctttcttatctacttaaaggagataataacacttaggtcacaggaaatattgcaagattaaatgcctaagatgtttgacatactccctgagaaatacttaacagatatagctcttattattacatcagtggagaatctagttattatccagaatattaaattggcatggaaaaagcatctggttattgaaactttggatatgtaaaaatagcattcatggatagtactcatttcttaccacatcattgcaaaattacaaacagcctgggagtccttcatttttattcttcaccttgagaagcgtgtggacaatctaactaccaatatcatcctttacgtaactccttaactccctttaaacattatacttcgggctgggcgcgggggctcatgcctgtaatcccaggactttggaaggctgaggcgggcagatcacgaggccaggagattgagaccgtcctggctaacacggtgaagccccgtctctactaaaaatgcaaaaaattagctgggcgtggtggcaggtgcctgtagtcccagctactcgggaggctgaggcaggaggatggcatgagcccgggaggcggaggttgcagtgagccgagattgcgccactgcactccagcctgggtgacagagcaagactctgtctc

SEQ ID NO: 240 - DNA, 3265 bp, Homo sapiens
gtgtttcagcaccgactatgtggtcaccgggtatcatgcctgagagctagttccggggtccagaagtcagaatcaagacatcagtaggaccttgttcctcctgaagactctaggagaatctccttccttgcttctttcagcttctagtgaccccaggtatcctttggcttttgactacgtaactccaatctctgcctccatcttcacatggccttctctgtgtctctcttctcctccactgcctcttttttaaaaaattaatcataataattgtacacatttggacgtacatgtgatattttgatacatgcatatactatgtagcaatcaaatcagggcaattggggtatccatcacctaaaacatttatcatttcttcatattgagcacatcccaaatcttctcttctagatatttttaactatacaataaattattgctaaccatagtcacctgactgtgctaacactagagcctatttcttctctataaccataattttgtacccattaaccaacctctcttcatccctccttccccctacactttccagcctgtggtagccatcattctactctctacctccatgagatcaacttttaaagctcccacgtatgagtgagaacatgcaatatttgtctttctgtacctagctttttgcacttcacataatgagctccaggctcatccatgttgccatgaacgacagggttttcttttttgtggctgaataatattccatcctgtatatataccactattcatcagttgatggacacttagtttgcttccacatcttggctattgttctgtctcttataaggatacattttgatggatttagaagctactcaggaaatccaggtgatcttgtctcaaattccttaactttattagacctgtaaagactctttctcaaataaggtcatattcacagattctggggattaggatgtgggcatatcttttggggaccatcattcaatccaacacagtagttttcactatcaccattgctacataattcatgagatcattatgcaagtatgaggagaatgggcggggaggctgactgacatctagagagtgagttatcatctatcctgaaccttaagagactcttgataagcattcaaatggtacactaatatttttccactctgagagcattcagatggaaaaagatatccactaccctctaccaaaatattcttgttacttctaagcttctgactacctgctcaaattattaatcattacccactggtccactggtttttgttattacttaactcaatctatgacttcttccaggcaaattagacaacaggattacttctctttaggaccagcattgaattaagaagtacaatcatttaccataagtccaccagtgctggccccaggaaatcaggaagaagcatctgtaaaccaagagctatctatctatctacgtatctatccatttattgatttatttggcatctcaggctactaattagtcacaggaatccttccatgaggccactggggttgagagagaacagcagcgtagcaggatgataccaggaagatgagaatcctccttgtgcaatttaacatgtgcatttaagattggcttggaaccattcctgtgcatatgtgtgtgtgtatatgtgcacgtggatgcatgggtatgtgtgcatttcacttgagggagtactgctgtggattcctcactttattttttggtgaatgagcttgtgactcattcataatgggaaattcagatcataatgccaggtatttagtcctaccaaggtccagtagcatttcaagagttgtttctcaaaataggactagttacttactggagaggtcataactttgattttttaaatgatattagaggtcttgactgagaatttactactggagctccataaagcatcccaatctgctacaaactcttcaagcttcattggatccgctggatcaaatgggctgccaggtagagttgattgcactgcagcctggactgattgccaggagctctgttgatatgagttagtgaggagacaacatctggaacagcagctgcacttggaggcaccgcctaattaagcttacgataatccacactcattctccaagacccatctgtcttccccatcaaactaattggagagttgaatggagctgcgatagaaatgaccacaacctaccatttcagtcattgatggtagcactaatctctcagattctatgggaatatcctactgctcttggtttttcttttagtaaggaaggtgagatccaggacttccatccttgttctttcctttcataataactcttattcctgagttaagaagtaaatgtgagtatttagccagttgtctagagtatcttttccaagaacacacaggaaatgaagggaaaaagaagaggatgtgtctgtaggtcccactatgcctacagtgagatgggcttgggtcaagactctatcacctgaacatcatacatttctactctgaccattgaaccacagtgccattcttctataacagacatgtgtaatttgggagccattatcttaaaacaactgaaaggtctacttatattcttttcttcagaatatatttacaccagaaaacgaccacaggtctagaaatagagtaatgactctgtttttcctttggtgagcttcatcctgagacatggggattttatgcaaatttattaggaactttgtgattgcccatatatctcagatctatagactcaatgatcaataaatcagtgttaaatatctatgtgtctctattagggaaagcacgaataaatggcctctggaggttaagtgcctgacttctgcacctgcccttctcaatcataggatctttccaatctccactgtaatcaggcagactatttcaatattagtccctcccatcaatatccccaactgacaagagaagccacaatcacatttttgtagatactagtagttccctcataagtatttctcaaggccttagtaaaaatggtcatctatgtctacttaggcaacatagttaggaagtagatgagattcatgttataaattcggtcattttatttctttctaggtactattgtaaataatttatggcatcttaattttctttagcatgatcaataatctatacagcttcctgtattaaaagtagcttgccctctctatgaattcagataattgcactatatgaaaaaaaaatagactaacctaagactacatttattc

SEQ ID NO: 241 - DNA, 2222 bp, Homo sapiens
agtttcttgaaacagctccatattctttcttctggcctcccacatattccttgggctagaaatctctttcttgattttaatcttggcagccaccctccatgacagccttaggtctgcacattcatcgagagagccttgcttccttcccagcaccctgcacacgggtgtacatgggtacacatacatgcacacacacatgcacacacatatgcacacacatgtacacacatgcacgcgcacacacacacacacatatacacacacgcatcctttgttaggagtgagtttactactacattctggcctgtctcccacgttcgagtcaggcgaaggggaacagcagctttgaagatgaatttaaccagttcttcctgagggcggattgcggtctccttatctgacccttgctgagagagaaggagcagcgtggaggaggcggcagtcagggaagccttgtctcagtccaagagcaaagtgactaccgtgtgctgagcactggagcttggtgacccaaagatgaataagactcgactcttatccttaaggagcctgcagtctgatcaagtcattactgagaagagaggaaggaaaagatacccttggcctttccaacttgtcaagggtcaactgaattcctgagccggtccccctgagagggcagtgggcgagattccagcaggtaatggatgagcacagctatgccctgacagggacattgcctgcaattggttccagtcatatatggagccaaactgctttgaaaattgggggggatggtgacagaagagagcaggcccacccctcccccatcccctaggagcctagggccctgtcttgatcccccttctgggagatgaaacgtgtggtttcccaaagctaggagcagagcaaatatcttctgcctcggaggggttggtctctgcacaggctgggaacccccagggaagcagcactgagggccctaggagagagggcagaggccagaggcagggtactgcctgctcagaaggtcagattccagagcaaacagcaagctgtctgccttttcagactctgaaaggatgggggtaggggcaggaagggagggtgaaagtttagagcccctgtgggtagggaaggggcctctagggtctgacaggcacccccaggacactgtgtctgcccaagtgtttgctgagaaagtggaggccagtgcagccaccggttgagtgcagccactgggtcagcgcagcggccgggtgagtgcagccctcggattttgccccaataaccagagtcccattagcacagtctgagcagggggcctggcagagcacttcgccctcctctgtcatttagcggggaaacagttcacacagggacaactaccatcttgagtctcttctgtcaactgccctgtggtctctctggccacactgggacagagcatcactccagtaaaccctctgagctcatttccctagctgagcaggttcccgcctctgttcctagagcaccagcatgagtgagcctcaggaaccaccccagattttaggagttaggagtgggtctagctgtgctgatggccacctggggctctggtgaactctagcctcctcccatccgcccatcgagggcatcgtcaggcctctgtgctgagccatttgcctcctgctctgccccaaacctgttcagcccccaacattctcactttcctgtccccttcatgcttcttaggtcatttctctctgcttctgcaaacctccctgccaaatgttcccccaccccaaaccgacccttttcatctctatgtccccccgtgtacacctctctcaaaatgcagggccacggggccctccttcttagggactaggccatgcctaggggtagggctgctgtggcattagtgacaaaaactgctatgtctacccacgtaaatcacataaatatacaagcaggggccaggcgtggtggctcatgcctataatcccaacactttgggaggctgaggcgggtggataacttgaggccaggagttcaagaccagcctggccaacatagtgaaaccccgtctctactaaaaatacaaaaattagctgggggggtggtggtgcacgcctgtaatcccagctactcaggaggctgaggcaggagaatcgcttgaacccaggaggtagaggttacagtgagccgagatcttgccattgcactccagcctgggcaacagagtgagactctgtctc

SEQ ID NO: 242 - DNA, 13810 bp, Homo sapiens
aaacagccagcggcgaaacagccaagcaaggcctaacagggccccacgaggacgcaccaggaagtaatgaagtcacccgtgcctgtcaagaggcacggcgctaacagaaggctcccaggagcttaaccggatgctcatctggcaacaacggcaagaatcaggcccggcgttccctgcgcagcccggtcggagcccagacaaccggcccgcgggccaagctccggccttcggtgcacgcggcaaagcgcggaaaataaggcggctcggtgccgcctggggactggccgcccacgcccccggactcaccccggaggtccagctcccggtcgcgcaccgcgttggtgtactgcgccgcctgctcgatcagctccgccgtcagcttgaccatcctgcagcctcccgttcccccgcgctgtggaaagcccgtggcctcccgccagcgagacgtcccagcgtgccccgcgccccgccgccaggcagcaccaatcgcagccgccgagtgcgcgcgcagctcgaccgccaggccgaagcaatcgaagagccacgcctccgggggcgttcttgccggaagtcgtggcgcgcgcacaggggatgtgtctcgttctgggttgtttcctagggtgtgtttcggagtctggaggacccctgattccagacgttggtgtttaaaagttaaggcgaatgtggaaacacccgaggggaactttctcatgcattagcgcacctcgaggtgggaggggaagcggtgactgtcctccctccaccagccgtcgcgggaacccgtggggttcagtgaagggtccagcagttcaggtgcccgccccgggcctgggccttggctccgggctacagtgtgagatcccgggctaggtggcccgcctggggcaggtcgccgggacaaccccaccgccccgcaagtccagcccggcctcgggcacggtagggtttgcggttaagcttgtgacctttagacttctgaatattcatatgtatgaaatgtgatatacataaaagtgtgcatatcaggaatttacagtgattaatgaccagagtgaacacagctgcgtagccgacaccgggatccaaaacaccgctattctgaaagcctccctctttcccaaaaggcaaccgcgaactcaacactacaaattcggtttgcttgcttttgctataaatagaatcatgcagtatgcttttttttttggcctagtttcatggagtctatattatgtctggagtccatccaggttgcatacagagatggtttgtttgcttttgctgctgaagagaattccattgtatatattataccataaattacttattctgctgttgatagacatcaaagttgttttcagttagggctattctgagtaatgctactatgaattttctggtacgtggttctgatgcacgtttgcatgagtttgtcctggagtgggactgctgggacatagggtatatctatcatcaataagtaatgcccaacagttatgctaagaggctgaaataatatacacactccagcggtgtgtaagggttttcatggcttccagcttcagccttcttggcattttaactctataacttcagctattctgatgggtgtgtggtggtattgcactactgctttgctttgcttttctctaataactaatgaagctgagaaccttctcatgtgtatggtgcccattctgatagcttccttggttaagtgttctttcgagtccctggctcattttttttttttccttatggagttgtctgccttttttcttattgatttgtggaatttctttatatattagggatatgaacacactctgtggcttgccttttcactcttaatggtgttgatgattagattttttttttttttttttttttttttttttagacagggtctcactctgtcacctaggccggagtgcagtggtgccatcaggactcactgcagccttgacctctcaggctcaagagatcctcccacctcagcctcccaaatagccgggactataggcacaggtcaacaggcctggctaacttttgtattttttgtagagacaaggttttgatatgtggcccaggctggtctccaactcctgagctcaagtgatccacctgcctcagactcccacagtgctgggattacaggcgtgagccgcctcgcctggctgagaagtttccaagttttatgtagttcaattattttctttaggttagtggattgggtgtgtgtgcatgtgcatgtgccttaggaaatcttcccttacccccatcatattttcctatgtggtctactagacgattgttttgcttttcacatttagttctgcaatccacccggagatgattctccttgaacttttattgaagtatgatatacatatagaagaatgcaaactgaacacacccaaccaactagcatcctcgtaagaacaggacattgccacattccagaagccctcctcctgtcttcatctagtcaccacccttgccccaagggtaaccattatcctgccatcttgtatagatttgctttatctagttttgtatttatgcaaatgaagtaccttgcatattttttgctaaacattatgtttgtgtgtagatgtagttaatctattctcactgtaatatggtatttcattgtggatgttttacaatttacttatccattctgctgttgatgaacatttgggtaattttcactcttttatattataaatagtgtacctacaaactcaataatatatatctttatgtgaacacatatactgatatactcccagggatggaattactgggtcatagggcttacttatgttcagcttaagtaggacatagttttccaaagtggttgccaacttaaactccttgctaacgtttagtattgtctttttaatcttagccattctggtagataggtaatggtatgaaattgtggttttaactgtatttccctaattactaacacaattgagaactttaaaaaatatatttatgtttgtttggataacctctttaatgaagtgtctgcttaggtgttttgcccatttttctattgggctttatttttaaactgatttgtaggagctctttatattttttcaataggaaccttgtgagctatgtctgtagtgagtatcttccccctgtggcttgggttttcactctcttaatggtatcttttgatgaatagaggttcttcattttaatacagtctgatttatgaaccgttccctatacagctaatagttttcgagtacgctgtgagaaacttttgcctactccaaaattatattttcttctaaaagctttcttcttccaccttgtccatttagatctgcagtctctctggcctagatttttgtgcatagtctaaggtagggaagaagatatatttttccccatatggatatttggtggacccagcaccatttattgaaaagaccatcttctcccccactgctctgcagagcagctcttttcaaaaatcaagtgtccaaatatgtgagggcctctgcttctgaactagctgttcttttccatgggtttagtcagctatccttgcagaatacaagctttagaaaaagacttggtatttgtccctcaaaaaaagctcccatttttttctcagattatctagtagttatctgattattctaatcctttgcatgtgaacataaattatagatatatgtgaaaaagcacccatgatttgatttgtagtgtgttggatctgtagaagaatttggagagaattaatatctttacaatatgaagtattccaatcaatgggcatattatagccctacatttattgaggcactctttaatttcagcagcatcctgcagattttgtgtcaaggccttgtatatcctttactagattgtctagatatttgatagattttgatgctactgtaaatagtaccttttgtttaaaaactccattttctaatcattagtttgatatatttaaatacagcagatttttgtatattggcgttacatccagcgatcttgtgaaatttacttaagtttatctgtaaccattcttgtggattttctacatacataaccatgctatttgagaataatgatagttggctgggcgtggtggctcacgcctgtaatcccagcactatgggaggctgaggtgggtgggtcacctgaggtcaggagtttgagaccagcctggccaacatggtgaaaccccgcctctactaaaaatacaaaaattagccgggtgtggtggcacgtacctgtaatcccagctacttgggaggctgaggcacgagaatcacttgaatcagggaggcggaggttgcagtgagtgaagatcatgccattgcactccagcctgggcaacagagtgagactcggtctcaaaaaaaaaaaaaaaaaaaaaaaaaaaagatagttttatttcctcctttccaattattatactggttctgtattttttgccctgttacactggctgggatctttagcacaatgttgaacagcggtggtagtggatatgctttggcaggcatcacttcatagcccggaagaaaactctaaccaatgatcgttaacatcaccaataatggaacagatcgtgtactccctgctagaatgcagacagaacacagaatcagcctgtgagattcgtgtcaaagatgcatgacttgactcaaaacgtgaggaaccctcagacaagtgcacagcgaagggcagcctacaaataactggcctatagtctttaaaagcttccacatcatgaggcaaggagactgaggaactgttccagatggaagaacattaaagagacatgatgactaagtgaaaagtgtgtttctaaaccagaccattttgctaagaactttattgggacaactggcagaactagaattcagtcagagggttgatggtaataacataccgatgttaatttcctgagtctgatggctgtgccggagaatgtcgttgttcataggaaatacccactgaagtattggcggggggggggcggtcatagggtatatcggcaacttactctcaaattgggagggaatttctttgtattgtacttggaacttctttgttttctgagatggagtctcgctctgttgcccaggctggagtacagtggcggaatctcggctcactgcaacctccgcctcatgaggaataacatgaggttcaagtgattctcgtgcctcagcctctcaagtagctgggattacaggcgctcgccaccatgcctggctgatttttatatttttagtagagacggggttttgtcatgtttgccaggctggtcttgagctcctgacctaagaagtgatttcccctgccccctgtccctgcctcggcctcccaaagtgctgggattacaggcctgagccatcacacctgccccggtcactgcaacttttgtttaactaaaaaaactaaaaaagttaaacaaaataactaaagaattaaaataactttaaaaagttaaaataactaaaaaaattaaaataacaagttaaaataactaagaaataaaataacttaaaagttaaaataactaaaaatttaaacaaaataactaaaaatgttaaacaaaataactgaataatgaaaaaattaaacaaaataaaacctcaacttcatttaattccagagaggaccaccaggtggagtccttaggctggagagctggttttaacttggggcccttctgttgctgtgtttaaaaaaaaaaaagagtggggtggtatctctttactttaaaaagggaaagttgtacaagtttcccttcagcataggaacagggacagaagtcaaaccatatgtggttttattcattgagggtatctctatgaagttgcaaacaattttcttttttgattccatttcttttggccggaatttctcaacctcggcactattgacattttggtctggacagttctttgtcatgggggctgctgtgcattgcagggtgcttagcagcattcctggcctccacccactggatgtgagtacatccttccagttgtgacaacccaaaatgtctccagacgttgccaaatgtcccctggaagacaaaagtcatccctggttgagaaccactattttggcaacaggatgttctctgccctgggcactttggttcctgttgtttcaaaagggagtctaagatatctggtcacccttagtgtggctggtctgtagtggtgaggggctttggatggtgggactgaatcctaggatctaaggtgggtgctcagtgctgtaccatctaaggatgctgttctgtgctcagataagccacaaagcctggggtgtcaggaaaggacttaaacagccaaccaggaaggatagagtctggggttcgtgcgaggaaagcaacagtgaaggctggggtaggggagcagattcttcctttccccccagcagccagtgcccagtggcctcccagctggctgggcagaaccttaagatgctagagaatggccttggtgtatactttccatcacccctgcttgttcttattaaaatgtttttctttcctgttctccacctcctttttccatcctctgatctgaacctctggccctcacctgctctcgggggccccaacatactccaagcttttaggcaaaaggccctctccagccatagtatcaataatgcaaatgcagtggagggtggtctccccaagttcaaggacactccactcctagactcatttagaccatgttgctatctatctatctatctatctatctatctatctatctatcatctatcaatctatcatctatctatctatctctgtcgtttttgattgattgattgagacagggtctcgctctatttctcaggctggctgcaaatgcctgggctcaagccatcctcttgcttctaacctctcagaatgttaggattacaggtgtgagccactgtggctggcccttttatttttttaagttctgtccaccccccctcccatttcaggtgtgtcttctgtacaaagtgccattctcaccagtcctttgaagagtcgcaagatacaaagtcagtagtggcctgggagggatggggatgtacacatggggtccactgtgaggtgccaaagaatttggggataaggtcaggtaaacatcaccccctgaaaataaagctagtttaaaacaaatgcatcatggctgcatttgggcagctgcagaacgacgcccctcctgcagccagccagcttccttccctgggcccggtggggagcaactttgccaatgtgcagccccaggcaaggcattcacttctgtgggtctcagtgtccttgtctgggaaatgacaggtttagaggaggtgatccatgatcctgtcacttaaaatccatacacatatcctgccagagtccagacaattttaacctcaaggtcggaccacttgtgagcagacattatatgtagttggtctctttcaacaaggtggagtttagtcattaggactttgtgaacaacttctcaactccccacccgacttgtcagccccaagctgggcttgcctggcttagccactcgacgaggctgcctggttggctttcctgtagttgtatctccctttgggagataaagggagtttcttcccttttttttttttttttttttttgagacgcagcttcgttcttgttgcccaggctggagtacagtggtgcaatcttggctcactgcagcttcacctcctgggttcaagcgattctcctgcctcagcctcccgagtagctgggattacaggtgtcaccaccacgcatggctaatttttgtatttttagtagagatggggtttcactgtgttggccaggctggtctcgaactcctgacctcaggtgatccgcctgcctcggcctcccaaaatgctgggattacaggtgtgagccaccatgcccggccaggagtttatttctgattcagctgcaaacatggtagactgtaagctctcagtgggcagctcggatttgctggtatctgggctctagggtctaaaaggctgcctggcaccagcagcacttaacaagttacttttaattcaaggtcggtctcatgggcggggcaaggggttgaatgttcatcccaaacacacttattccttcactgcctcacacgcacaactctggtcaattggtgcttgtggtggccagctgttgggttgtgtgacttgccctgccttctgagagctgcacactgctcccctcctctgctgcagagctccctgcagccatattctgctgcacaagcctgtccttgtagccacagctgatgacacagggagagtacccatgtaaggcaggctgaccaagtcctgtccctgggaaaagaagagccaagaaacagacccagaaagttggcctgaggggttggatttgtaccagttttacctggaagatgctggaggtcttgtcatttgtcccatcaactggagaaggcggccatggagagaagggcagtgctgccgtacagagagggtccaggtgacatttaatgccggctccagctttcccaaggctctgctgcacccctccctgaaattctgaatccactctggattctcaaaacaacgcccctcacccactcttgttttcacctaagtcatttctagttggtgcgtttcctttacttgcagccaaaggattcctagcaagtacaagcttctgacttcacagagaggccatggtaaacatcccaaggagtgcatcagccatgggttcagggatttcagccactgcatagaagacaagctgtaacctaattcaatcacacttggcagcaaccggtgaagaggcagtctgggctctggggagctcccccgtgacagatggaaggggcccctacatctggagaggctctagaacctcctcccagtgaggctaacgtggtctgaaggggtctctttgcccagtgacattctggggttgggatctgggatttcctccattgcttccttacatcaacatttgctaaagctcaaaagaagaccttccacgtaatgacatcaaacagatctgaaaccacagttaaagtaacgtccacttaacacttggtcagcactcatgtttcattttgtgtgccgtggaaagaaatacaggctcctgtgccatgggatgttaactcttttattaatttagggttaacattgtacttgcttcattgatttctctttcagagttgtagattcaataaacaacatctgggttctctccagctcacaggtgacaaggcaaatgcactgtcgtcaaacaggggagcaggacaatatggagaaagacgaggtcgaaaaaatttaaggcaaatgttacttccctattcaagggaattgatcaagcagatctgtgcatttcaatgaaaatatatgaaatatttgtcaaaataattaacatcggtaaaaattagaacatgtagcttataaaatgcctacacaggtttggcagaataaatccaactgtgtcatgtaggcttgtaatatacacagacacaggagtttccaccttaaaaacgagtcttctgaagggcagaggccaaatgtattttaaaagcaattccataaaatgggaagtgatggatgattaacaatgcatggctggctttacattttgttcagaggaattgcttggccatcggggtaccttttggctggccacagaatgcctcctgttgcctctcctcagaaggctctgcatcaggtcgaggtggtcgttcaggccatgagactcctgaagacacagacagaacacggtaacaaggagagctcggcttgctcaaaggagagcgctgcgggggatagaatcttctggtctggctttggaattggactttctaagccactgctgcagtttcagaagtagctgactatgtagaaatagatactccggccccagtggtcatacattttatgccctcaaacctatcttatttatagtctgaccaaaccgtccccagactgctcagtggcaggcaacgagcaggtagactgctggccctttgtcacatgtgaggatggcccagggttcgccagctgggccggggagatttactacacagccgcagaaaagcacggggagaagagtgatgtgtgatgccaagcgcctttcttttctgctttggtcttgaagattcagtaaacttatggtcccagaagctgctccaaagccagagctgtggattcccagaattcattttgttcctgttagtttgtcggaagactggagccaacaagcagcatttgagaggatatcaccattttaggaacacctccttaagagccaccacccacctggcttgggtgctcagagatgctgctcctggggagataaagctgtcaggtgcagggcgccgctcctgaaacagactctggccgacagtctggaggaaggtggacggatggatggatgggagtgcctgccctctgtgggcagctaggcacccttacccggccaggaggcacgtgcggcagcagaactgaatgaagagcttccgttcgcacagccggttggacttcaccatctcgcagaatgtctcgtcagctggggccccgcatcaggaaaggcaaaagagggaaaggtcagtcttcggtgcctgtgaagattgtttcaaggccgggcgcggtgcctcatgcctgtaatcccagcactttgggaggccgaggtgggtggatcacctgaggtcaggagcttgagaccagtctaaccaacatggtgaaaccccgtctctactaataatataaaaattagctgggcatggtggtgggcacctgtaatccaagctactcgggaggctaaagcaggagaaccacctgaacccaggaggcagaggttgcagtgagctgagatcatgccactgcactccagcctgggcaagaagaacaaaactccgtctcaaaaataaataaataaatacataaataaatattgtttcaatcattccacatatgctgggcatcagtggtgccctgggcaagagggacacagacagaggtgggcagcaggatggcagcccttgaagcccctctcctgcaatgcacttgactctgggagccctgtgtggcgggagggcactggtatatggggctcttgctgagtctcagtgacaaggggattcatgagcaggatgtgggggtggtgtgggagggatctcaggagaacacccagcctgggcctgtggggcacatgtgcacctgtctttctggacaactgctggcagtggagcttaggaggaagactgtaggggaggccggaggacgggcctggaggcaggagggaatggaagctgcttccagggtggagggggcggacagggaggagtggggatggggggaagggagccgccgtggacaggacttgctgaggacaccgctgcagcaaggggaagaggcctttgaggatgcatcatccgtggacctgggaggccctccagtggcaaccacacttttttgggctagatacataacctgggcaggtgacttcccaaagaagtagtttctgggcctttgaagggacataattagacaaccctcccgccaccccccaaaaataataaccagtaacaaggcaaggaggcatcccagggccctccacaagctccatgctctgcctggacagggccagtgccagcttcatacccaaggaccacctgccctgaccctggacactggagcagagagccttcctctcctggctgtcagaatgtggctccaccctgctgcttgctgggccagagcccccttccctgcccgtgtgtctacaatgactcctgcactgcacctccaggcccgagtcctgccaaccctccttggtgcctggaattcccaaactgggcacttagctttggtgcccttttaagtttctgtttttacaacttgtccttgtcccccatcctatggcagagccagggctctcctgcagcacagatgcaggtccatgctggatccctgcagagctgggattgctgctgctgagcgtgtgctctactctgggctctgtccccctcgtcctgagcagagaccctccaggcttcctggctttgaccccccaggtcaggcttcttttatggtatgtcgtcacatccgggccaccggcggcctatggcatggcagtgggaccagtacaaggacaaaatcatttttaggagtcactcaataaacagatcagcagtggctgggatgcctctctgatcgatgtgagaggcctagagggaagctgggagacagggcagctgtcttccatatcagctagaggaatcccagacagtcaatcggatcaggggcacgaacgcctgtctgtggagccgccatgcctatgtggctttgcttttctctttggagcacgagctggccagctgagctcctccacaggcagccccagggtaacccagctgctgctcaccgttgctgcacgtgtggttggtgatgcaggaggtccccagctgtgtgaagcccgtcttacacctgctacagttcctgctggagcctgcacagctcaagcagttctcgtcacacctgtgggaagataccgttcctgctgaagtctggggaagaggctccaccactccgggctcccttcccagaaccctcacctccctgcacctccttcccaccccctcagcctcggtcctctgtggagaggctgtgtcgcccaccattccctgacacaggggctgagtgtctgcatgtcttttctcctgtctgacctcactattgccctgggagggcagagacagccatggccagttggcaggagcaagcccaggatcaggggccaggcctccgaggcttcccgcagctcacctggacaccctcctgggccctggcacccagcccccaccccaccacacggctcccagagctgtgtcagtcttctctctccagcggctgccgggctgcgatggctgtaggcttggggtccaggccagactccacccagggatgtgacacacctgactcgagctgaccagaaggctgctgtcacctatatgtggccatgcctgcttaccctcggggagtgggagagatgccccacaattcctgcccctctcggacggtcctggcccagcctgcgcagagatggacaccagccagggctatttctaatgcagggtaaacgtgacctcaggggacggttggtgcactacagcccaagggccacatccagcatttatcctggaccacagtcacactcattcattgacaatcttttgtgtagcagtggctgagctgagtagctgtgacagaggcagtgtggccccaaaagcctgaacgactgaccattgtgccctctacagaaagcacttgccgatgcgggccgagtgcttgaaggagcacgtttcccatcctggggccgtgagtgcaccccggctatgctgctgcctgtcctgagtccagagcccggtgactcggtctccacagtgcttgcatcagctgcccacctccccattgttgccagttaagggtggaacaggccccataggcagggcttggagctttgttgtgctcatgcctgggcctccctggggggcagttctttgctttatacagatgtcccctccctgctgtgtgaagccttcccacgctcagacaccaggcctcctcgtggggctctttgcagagcagccctctgatggggtctggtctcaccacggactccgctgctctggagccccaggtgcagcatcgcttcagcctgggtgggaggtgggttttattcctagtgtgtctgaggatgctgagcctagagctcaagcccttggtctgtaattgtaaatgtgtaaaccccac

SEQ ID NO: 243 - DNA, 2415 bp, Homo sapiens
aaataattggtgatccacaaaaagaaaataaagtgagagacaaattcctgactcttttaatgtcatactggttaaatattcggggggaaaatttttattaaaaatatgtgtacaaaatactttctaaaacaggcataattcatcacaattaattacagagggttgttcaaacaaatggatctacttctatagatatacatgcatatacagacatagatatagataaatatcaactttccttttagcatgaaaagacaagaaatttaaacaatagtgaactaataaaaatatacctccgttaaactgctcagactcaagaaaattagggtgaataatcatacatcacagatgatgaaagaagtactgtgttctcataccttgcatattacgattataaagtgttccacatttaggggttggcaaccaaacaatatctattaacaactaaaatatagaaaagcaaaatgcagcaatgctggtcctgagaatctccccagagtaataaacgcaggtataattacaagagcaaaatgcaggacaccaatacttctatgatatgacctgtatttggtgttgggctttacaggagctctttctcagacacatatgcattatctgtatcttttctgagattctactaactttatggtgaaatcaacaataaaaggttttcattttgataaattggttttcaaaagagaaagatgttacaagaccctttcaacttgtcttgcaagtgaaggctatatctgaggctgccaagaaaagttattgacaaaggcatggcaaaatgttaatgtggttttgttgaccactgtgtttgcagcacagtggagaaacagcgtggttttctgtccttgctgagttttatgcattttaaggaatcatatttgttcattccacattgcagaatgtttcttgcattttcatttcctaatgcagactaaatatcttatgtggtttgcaataattctctccttttaaaggtatttctggagtaactgcctggtctgtaacatgtttgatggatacctaacccttaaatattacaaaattttatgcacaatcactacttgattttgatggacataaaaacacgtttttaagttacagtagcaagatattatcgttgcctgtgttaactcattactgatactcggtttataatcatagccaccctttgtgaaaaggttagcttgttacattatggttatgctgagggaagaacaggctatcctggatgcttgagggcctctcgtggtgactgagtgttggcactagtgtcagttcatatctaaatattcctacatatgtaatgtactttcatattttttttgacaacacttgtctagggaatatttcaactctactctgtgcttttgggattcaatgggaatcccctttcagatggtcaacagtgtgagccttattgattgacctttttgccctcttccctgaaatatattctctaggtttaatctgtggaattagattttaagtcacattttcttgcgtaaatgtatgaaagcaggaaaaccggctgttgctcatattaacagcatttttttcacatagtgtaagaaaaacagtggtcttattcaccagaccaatcttgtattcccgctggtctcacagttcaagactcccttccccaggctttttgttctgaggtctggccatacaagcatcctagctgagtgggtggaaacgacatttacctggtacaggcctgacctgtgaaaacaccctctgtgaagccccaaatattttttgccatacaactgcatgaaattttcccaagcaccatagccagatttgaagacacaggttagcaatgagaaatacaccaatagaaggtatgggggtccctaaatccatatttggaggaaaatccacaagcagagtcacatgacatttgaaagcctgtgttgaggtggtatatgccagcaatgataaatattacatgatgatcaaactgctgataaattcaggtttgtctattacaacagctaattttacgttaactgtaacaaaaatatattgaagaaaagtttgcatggaaatttttatttttatatttatttatttgataaatatcaactttccttttagcatgaaaagacaagaaatttaaacaatagtgaactaataaaaatatacctccgttaaactgctcagactcaagaaaattagggtgaataatcatacatcacagatgatgaaagaagtactgtgttctcataccttgcatattacgattataaagtgttccacatttaggggttggcaaccaaacaatatctattaacaactaaaatatagaaaagcaaaatgcagcaatgctggtcctgagaatctccccagagtaataaacgcaggtataattacaagagcaaaatgcaggacaccaatact

SEQ ID NO: 244 - DNA, 4042 bp, Homo sapiens
actggacatcaccaccctgtccagacacccagagcagagtgggggatggggaaggtggcaggtgggggacaaatgggttgatatttatagcagacaaattaataaagctacagataatgcatttagacaacaataaaaacacttgatatcaaaacctaggaaacatctaaagaaatacttagtggtccatttatagccctaaatacctgttaccaaaaggagaaggtttaaaaattaattacctaagcattcaacaaaggaagctgaaaaagaatcacagggtaaatccaaagaaaatggaaaaaaaataaaagcataaattaaggaaacatgaagcaaagaaacagtagagatgcttttatttttaaatagttctcaaaaaacaaccctctggcaaactgatcaagaaaaaacaggagtgaagtcacaaataaagactggcagatagcagtgaagttgtaaaaattctaaatgaatgtaagaaactactgtgagtattgtactgataaatgtgaaaccaaaaagcaagaacaattttctagaaaaataatattgcctactgtaactcagtaagaaattaaatgcctgagtagacttaaaacattaaataaattggatttgtagttctttttaaagccatgcacagccactcacacttacataaaaattaccagaacagatggttttaccttctgccaaaccttcaaagaaagatactccttacatgacacaaattgttctagaagacagaggaaaagggtaatctctccaactcattttataaagccagtatcaccttttagctttgaaataaaaaacaggcaaggatagtaccagaaaggaaaattatgggccaatttcagttataaacatggatgaaaatgttctaaataaaatcagagcaaaaacccctcagaactaactaaatggtttatcttagaaatagaaggttgaataaatgccagaaaatctatcaatgtatattcaccacataagtagacagagggagaaaaaaagaaaattattatcttggtagatgcagaaaaaaagtttatgacaaatttcaccatgcatttatgataaaaactctcagaagactaggaaggaaatcttcttactttgataaaagataatatcaaaaactgagagtaaacatcatatctaatggagaaactttagacacgtgctctttaaaattaggcagaagatggccgggcacagtggctcacgcctggaatcccagcactttgggaggctgaggtgggcggatcacaaggtcaggagttcgagaccagcctggccaatatggtgaaaccccatctctactaaaaatacaaaaattagccgggcatggtggtgcatgcctgtagtcccagctagttgagaggctgaggcatgagaattgcttaaacctaggaggcagaggttgcagtgacccgagatcacgccagtgcactccagcctgggtgacagagcgagactctgtctcaaaaaaacatataaataaataaaataaaaaataaaaaaattaggcagaagataagcatacctgattccaggcattgttcagtatagtactagatgatctggaccatgctctaagacatgaaaaaaagtaaaggtataaggatagttgcatagaaaataaaaatattcaacagataaactgatagacatggtaaaataaatcataacattcacctgattggtaaaaactacagaaatcaacagtgctcctatacatcagcaaaaatcaacaggaaatataacagagacacttttgtctctggccatgatggactaactggtattggaccagccctaccactgtaaacaactagaaaactggagaaaacatatgaaacaactgttggcatatattggacaagaggcagcccaggactaagatcttgagagaagagaaatgtaagaggcaagtcctatgattaccctggctttctgcctacagatactttctggacagtggcacagaagtgggggaaaccaagcagaccatggtgctctctctgagtcagagctcaggagaattaagtggttggaatttgtgaaatggagcaccagagagaaagaagggaactcctcaaggaaacaactccaaaatcctgcatagaccctttgagtctttggctgaaaactaagctgtgcacaagatgaaactaactctttgaaactgggcaaagaacaactactgattatctgtctgctgaacaagtctcagagttcacacagggctagaggggttcaagttctgataagctaaagtagaatgacttcgttggaaacttgggacgttcagtagaaagcccaaaaaggtctctcctatagctactctagacctgctctaacaaagttcaaaacaagtcttgaaaggatcaaatttatctgtaaattaaatgtccaccagaagaaggcctaccactgtttaacaaaaaattaaaaattcagacattcaacaatgtaaaactcacaatgtccatcatctaaggaagtattactagacatgtgacaaagcagaaaaatgggacccctaaccaggagtaaaattagtaaattgaaagagaccaagaaatgacagagataaaattagcaggcaagaaattttaaatgcctgtcagaaatgctcaaagatttcaaggaaaacatgaacacaatgaaaagaaaaacatgaggtatagataagaaccaaatgcaacttctagagctgaaaatatagtgtgtggaacaaaaaaaaatttactgaatgggattaagaacaagattacacactgcagaagaaaagatcagacaacttgaaagcaaggcaatagaaactatttaaaatgaagcacagagaaaaaaaaactcagagctttagtaatctgtgagacaatatcaagcaatataacatgtgtctaattcaaattccaagaaagggggcagaaaatatttaaataaaatggccaaaagtttccagactcataataaaattataaaataaaaattacaggccaggcgcagtggctcatttctgtaatcccagcactttgggaggctgaagcgggcggatcacgaggtcaggagattgagaccatcctggctaacacagtgaaatcccaggttactaaaaatatgaaaaattagctgggcgtggtggtgcgcacttatagtcccagctactcgggaggctgaggcaggagaattgcttgaacctgggagtcagaggttgcagtgagctgagatggtgccactgcactccagcctgggcggcagagcaagactctgtctcattaaataaataaataaataaataaataaataaataaaaattataaacccttagatccaagaacctcaatgaatataatgaacaccaaaataaactataccaaagaatatcatatctacacttttgaaaaccaatgataaagagaagaccttaaaaacagccagagatggccaggtgcagtggctcatgcctgtaatcccagcactttgggaggctgtggtaggtggattgcttgagctcacgagtttgagaccagcctgggcaacatggtgaattcccatctctacaaaaaatacaaaaattagccgggcatggtggcatgcacctgtagtcccagctacatgggaggctgaggtgggaggatggcttgagcccaggagatgaagattgcagtgagtcgaaatcatgccactgcattccagcctgggtgacagagccagaccctgtatcaaaaaaaaaaaaaaaagacagagagaaaaggatgagaattattacagacctcttttcagaagttaagcaagacaaaagaccacagaatgacatctttaaaattttaaaagataaattttaaaactgtcaacctagaattcttcatccagagaaaatatccttcaaaaaatgaaggtgacacattacccacaaaaattaacttaaaatgaatcaatgacttaaatataagagctaaagcctcaaaatccttagaaaagaacacagaggtaaatcgccaatctccatgaacttggatttggcagtgga

SEQ ID NO: 245 - DNA, 8030 bp, Homo sapiens
agtccttggccgtctcgcggccgctgacgaactggaactcgttgggcgtgagccactcgccgcggtggcggatggacgggcccttgctgccctggcagagtttgcgcacgtagagcagcgcgcggttggcgccgcactccacctcgatgcacggctcgccgttgtccagcagcggctggaaatccggggccgcggccgcggtggccgagaagcgctcgagggccagcgggtccctgggcaggtggaggtgcggggcggcctcgtgcaggctgaggagtgagttcgcccgagccacggagttcctgttcagtcttttgcagaagacgctgagacagaaaggtcaagtaactctcctgaagtcacacagctgtttcaaatgcaggatgtctcacaccaggaccgcgccaggaccatggtgtggggcaagagcttcctgtcaccccacacctcccagcaggaaggtggtgtggatccgaggcagggtgagggtgggggatagcgggttggcagagtgcacggcctcccactaggaggagcaaggctagtgaagcaggaccggccacaccacgtccaccttggtgccttctgacaggtcagtctgggccccagtccctggttcctggtgagcttcccatcaccccccacctccctgcgtgcccagatcggcattgcatctggagcgttccgaagagaaacacaacctgggggcgttggtaacagcagccaacccgcggagtgaggtctgggccaggagtgctctgctcaggcaaggaacatgcccagaagcctcccccgctatcctggccctgttctgtgggggctcgttggacaccagcacatccctgaccccagctgtggctgccagtgagttcctgtgccttcctctcctgaagtctgtgtcttctcccaggtctgataccatgtggaaagtctgctcctggggccagctggaggccatgtggactggccctgagtgcccactgtctggatgcagccctgaccctactgcccgtgtgtgggctactaggttcacctgcacctgaccctccttctaggttcgcctgcacctgactccctgatgttcacacagtgatttggagagggaggctggggaggcgcaggtctgcatggcagtgcctctcagggtctgaggcccttgggccaggcctctcctctgacctgggccagcagaggggcctcctttcccttccaagagccctcccctgttcaccagcatctcatcatgctcaggcccacagtgtggttaaggaggggcatggggctggccctgggtttctggctgggtgtgggggcctacccggggcccatggtgtcttccagaaaagaccctgactgggtccaaagctggaggcacccctctatcctcactgtccactccctgatgttctggaggtccctccaggggctgggtgaggaggccttccccaccacctccttgtcttcctgggaagcaggcacccgttcagaggccacgttcccacaggaccaggctcctcacccccagcatcacccttttccacggggttgtgccccttccttggtcctgtccactcacacacacccgtgtccgtgtccatgttcacacctgttctgtgtccactcccacacacctgtgtccactcccacacctgtgtctcgtgtccactcgctcacacctgtactgtccgtgcccactcacacgtgtcccgtgtccactcgctcacacccgtgtctcatgcccgctggcttacaccagtcccgtgttcactggcgcacctgtgtcccatgtcttgtgtctgctcgcacatctgtgtgatgtgttcacttgctcacacgtgtcctccactaccacacctgtgtcccatgtccactcacacacctgtcttggtctgggacacctgggccccactctcccctgcactcctcaggctggcggcagaggccagaggaacggagttctggcgctggaatcatcctgagcgaggcagggacctggcggtgtggactccaccgcccctcctccggcccaccgagccccgcctgcctgggccttggtgcctctgtcgctgctccgggtccccctgctggggcccctccgccgctgggctgaggctggagcctgcctcccgccgccagagggaggaggtcataaataaccctggggctgccatggagcagacggtgaccccagacgtcctgggggagtgtgggggcgccaggggccgctgccccagcccgcatgccgcctccgccatccgggagtgcctgcccaggctccccagcatttctcttagagcccttctcatccatcccctcatcaatcaatcaaccatttattgagcccagatgtggtacagccccagccggagatgacccagaggtggggtggggaggagagagatggggaagctgagtccggggccacaggtgcagccaggaggtgcaggtgagcagcgctcagaccagcctgtcagcctcagtcctgagcttacttctggtgatggagggagatatacagaaaagatcctgcagcctgcaggtgtggcacagctgatcttgggccaaggatgcacagctgtgtgtgtgcctggccaccggcaagggcacgtgggctcagaagcacaggtgtgcccacaccctgcgtgcctgtgtgtggcgcagcagctcccgacgcgcgcaggacacacacacagcacagacagaccctcccatggccacacggacaaagatggcttcactatagacaccggtgcagacaggatgtgcactgctttccaaggcctgtgcgcaacacagactcagggcctgtgggcatcagcaccgcccagacccaggcacacgtgatcctcagccaaggtggcctgtccagtcctggtgctgttggatggaaaggctaacctgggaggtcaggggctgtggtatatcagctgggctccctcggacgctcctgcagaagtggccaggacctcaggaacgcacctgctcctggtcagacaggaggggctgccgtgatgcaacttgcccgtgcctttgggtgctgtgagctggctgcgtgccacgtcgtttcgaggacgcaagaaggtgtttccaagtccagtctgtccaccgacctgaacctttaccattgaaagaacaaaggggtggggcccgagggacccttccctgccgtcccgtggtgtgtagtcagggatgctcctgcagacacacaggtgggctctgactgccagatcgcaggggcggtgccgtggtcctcacctgccatgtcactagcgtgctgacgcagacaccggcgagagctacagtgctcggcccggcacatcccagacaattcctctgtaaatgctgcagcagccagaggccccagcaccttgaggttaagcaaagagaaggaatagagttctccagagccccaaggagcgggagggtctgtcccaatggatgggctcagccaatttcaccctctcctccccctgccaacactgcggcctgcagcctggacctggcccgggttgtggaggggaccggggatgcagctgccacctgctgggcggacgtgggcctaggtggtcctcagccctcatgacaggagcccccgaagcactgttgcggcaccctctctgacattgggtgggagactctgggagccgagtgcagagccagggcccagcacgaaggccttgggctccagtccgtgtgccccacatccctacatgagtgagggtggagggatggtgcctctgccacggccacggtgccgccgtccacgtcagctcactctcagcacaggtgctgtgtgacggcctcgggccacaccgcttgttctgaggcccctagcaggtcgggcttgtgctggctgcacattggctggtgagcttggcgggtctgtgggcacggagagaccagaacgtgcgtaacaggcccgatgagggtgccaggctgtggcgacccccgagcttcagaggagaggggcaccagccgggggccctgcacaggcagcctcagagagaggaaagctcacgatctgggagaactccaggcctggcccagtgaagacgtccttatcttcagcagacattgcccagtgcaaggggaggtcagtctcaggagacagtctcctggacagtggcgtggcatctgtcctaaggccttgcctgcagcacagggtgccacagaggtcccctgtgacagagcctcatggctggggcaggcgggggtcgcacctgctcctgcatgaagaggcagataaagacccacagcatggtctctggggtcccacatcccaggtagagaatgacccaggtcgctggcgtctgtgccatctctgctccactgaccactcatgggggtcctggagatcctgacaccggtggccggggagcagcagcccaggcacaggccccagtgcacatgcagatcccaccgtgtctgcacaaggccttgccccaacgaggcctgggtgccgtgtgagggccgggacgctaacacagcggagggtacccacgcgtgagctgctctggggtccctccccgtgtttcttcctgtaatgaaacttgtacccaaatgggatatgcagggttgcactgtgcagtcgctgtgtgttttagggtctcatacccgtgtgcgccagcaggaccacagctgtgaccggctgctccagaagaagtgggtgggttgagaccccaccggcagggtcactgggggtagcaggccctctgtcagcactgacttctgtatcatgtcagggatttttagggcggcaagctcaggtggacaggcagttttattctgtttcccatgtcaagtccagccccagactgactttctgaggtcacagacggagcctcaccccatccaaggcggtgtcctggactcccactgtgctccccagagggcagggtgagtgcgtggcatccttttggcgggcgtgggtgcctctgtggacctggcgtgaggcttctctgtttctgagtctcctatggaccatctgtcttctgtgtggctgctgaggaatcacactggggtggccgtgccggtggctgaatgagaacaggacccccatgctgcacagccctgcttaacgcgggggtggccccagaagcgggtgggcgaggctgggcagcagggattggctgaaatcatatgcagagcccaagaggcaggggaaaggcggcaatttcagggtccctttgttcgccaggtacctggggcccagcccgggcggcaggagggactcagcccctcgcccaggcaggaagggtcccaagcagaggcccctccctcaggcactccccagcccacacctgcagcactgggaccaagactaataaaacaccagcctcacggaagacagctttatcttgttgatcggaagtctgccagcccaatttatgatggaacataagatctctaaatctgaatttacgctctgtagcgtaacgagaggtcaataagattaaacgggggctcaggagaggaccagcgtcaggctcactgcgaggtgctgcacagaaaacccacagccagagcccctgggcccagcccaggcaagaccagaaaaggagggggcaggtgggagaccagcctggggctcccgggaagcccacgggatggaggcgggagagccaggaggcctggggcaaccctgggacggttcctggatcgaggagagcaggggggtgatgagggttccctcagggctggggagccttctcctggtctcagacccaccccccttcagctcccaagccctgggtgcccctggctctgaggacagttgggaatcttccctgaggcaggttcaaggacagagctctgaccctggcccagggctgctttgggtgcctatgaactcggcttctggctcagagcagttccctgcaccccttcctgagccctctgtcctctggaacccgtgggcagggtgagggacgggtgttccttctgggtgggggcctgggcgcccagccagcacgacgctggcttgctgagcttagggcagaccccgacttcagaatttatacaaataaatgcaatgaaaagtgctggcaacctgatctgattacagagtcattcattctctggtcgttaataatttgtgcaataaaggactgcagccgctcagtgcgggggaggctgtggcccaaccttccctcggcgccggccccgggagctggaagcataaattattagtttcttatcgctgggcctgccatcgctcatgctgccagggcctggcgggagctggtggctgttctgctgcccgccctggccggctcagggccggctctcagccgtcgcctggggccctttgtcacccccaccctggccccccaggtgtgggagccccagagcctgctcaggcctggaggctgctgctggagccggcaactctggaagccagaaaggtggggctttagtgcctgtcctcagaccctcaggtaaccaaagccaaattactccctgttggaaacacaacctcacataccgggccacagcacggacacccacgacagcaggccacagcacggacacccacggcagtggcccacagcacggacactcacagcatggacagcagcccagagggacccttgcccagaccctgaccagggggaagagacagttgtgtctgggtttgtcagtcctctggttgtggcagggcccctctgggtgggactcggcacctgtacctgggagcacctgctcagatgagggagtgggagcaggaacagcgctcatgctctctccctgtgtccagggctggggccctggtctggcgggtaggcatagggcacctcctgccctctcatgccctcatacacctgctgctggggttccctgtcccaccccaaaagggagaagccaaggctgaggcaaggttggaaaatcagggtggggactctggaatccagacatcccgacagaggatgcaggaggaatcggcgtgagcgcagggtaaactcacggacccgaactctcagatgtgcttcctgggctcagcttcccctttctggagggctgggggttccagaaccttgccttgaatttgtgaggatggtgggacctggagggcaggtggcgcagatggtgtgagccctcaccccaggacgctgtgcccacttctggctgtgcagccttgggaaggcttctgacttctctgaacctcaatctgtaaaatgggaatgagaatgaaacaagatgaaattaacatgcattgagcgtgtggggtggggcagagacagccaccttgcagctggtgaggcccttacagcatctggtcctgccacctcgcagctggtgaggccctcacagcatctggtcccggagcccacacagccctttgcagagactgccctacccacgtgcaagcgtttcgccctcttcccacgggcgaccccagcttggccgcatgcgtttttgctcagaacgtccccacctatgtcccacctgccctctggcttcgggagtgctgggcgcagtggtggcaggtgcctcggtgcccttggacttgcccggtcgtctgttgcttctgaggcggccccgttgatgggtgctccttctcttctgggtgcattttccttttcctgcttcctcgcatgcctggtgatttttgaatgggtgacagggattgtgaattttgctgggtgctgactatttttgtagcaaagctgagaaaagcttactttgctcaggactccaggaagttacttggaagctgtttggtcctttggggtcttgcttttaagccctgctgggaggaccaaggcagcttgtagtctggggctgactgtgccctcctttaccagggcacggccctgcttggtgctctgcccaggggctgaggtgccccagcctggctggtggaccacggaccttccacggttccctctggtgatctcgggtggttctcctcaccttctgtagttgcctttctttttttctttttctttcttcttttttttttttttttgagacggagttttactcttgttgcccaggctggggtgcagtggtgcgatcttggctctcca

SEQ ID NO: 246 - DNA, 1723 bp, Homo sapiens
cttcccaagtgagaagcagcagggtggtgcaagatttcatcatgcttctcagaatgacatgcaatttaagtcatataaattgtttatttctggaattttttatttaatatttttgtacagcagttgactgaggttgaaggaaaattaccctggatggaagatcagaggtatagaaagaaatggagagcaaagaaagagtttgatgattccctccttggagatcttcacctgcagttcctggaatgagtgatgctgcttccacatggtcaatttcaccccttcatatctcttctgcatctatgacacacctttatcttcttgttgctgaggctgcctcacccttagcagaagcttttggtggcacttatggccagctaatcaacttgactatcaggcagcaccattccgcagagttgtatgtgatctatggaaaatcgacccctctgccctgctttcaatgaacttgtaacttactactgacaagaggcttcttattcttctataggcagctctaggtacacttacctttgcttttttgttcagccatgggtcaagtaacttgctctcatgtctctgaaattccagagaatgcatattagcctcccaaatggttcttttgaggcccccttcaattgatttgagatgaaaggggagtttcctttccctcccatgtaagagagagataatttataatgctctgacaatagtctccaaaaaaaaatcctcattagcagcctcttcaccctttcagtggatatttagctatctcttagtctggaggcgaatgatagtcttcaaatatccactggaatgtaagcagcaataaagcagacattttttatgtgttttgattatttctgtgtcatttggttttagagaaaagcctgacacatagtaggctgtcaatagatatatgttcaacatatgaatgaatgaatgaaaaagcaatcaggcactttgatttagaatgtgtgtatacacacacacacatcatatatatatttatatataaaacaacagatgtcatacatatacatatatacacacatcatatatatatttatatataaaacaacagatgtcatacatatacatatatacacgcatgtatgtatatatgtatgcgtaatgatatacatgcatgtatatacatatatacatacatatatgtgtacatgcacacatatatgtgtatatatatatatggcacttctattgttttcagattttgggatgtctgctgaaacaaaaaaatagaaaccccaaaacaaaaaatccaagaaatatcaaatttaatattctatcatacttatttaattttaaaattatctttacaaagataacaaaatccaaagtttgtgaataatctttcaatggtgatatccaaaaatacatgtgtttttcagggaccaaaggctataaatccaaagccagaaatttagctaatcttaggcagtccagaataaataagaaatttagtttattttagtaatttgaatcatccattttaagattataaatcctagttaaaagcttgagaatctatgaagaatgtgcaaaagtagaatttactagactctggctcacagaataaggtacattttagggtcagcatctggaaatacccctttctcatatttctctgttacgtgtctatgcctttaaaacagaagttttaaaacttgttgtatggatcatgttggaaataaagactatgaatcaa

SEQ ID NO: 247 - DNA, 1332 bp, Homo sapiens
gagaaataataaagaccagagtagaaataaatgaaattgaaattaaaaaatacaaaggattcatgaaacaaaaagttggtttttttgaaaagttaaacaaaattgacaagcctttagtcagactaagaaaaaagagagaagattcaaataaataaaattggaaatgaaaaagaagacattagaactgacactgcagagaatgaaaggatcatcagtggctaataggaggaactatataccaataaattggaaactctagaagaaatggacaaattcctagatacatacaaccaaccaaattgaatcagaagaaatccaaaacctgaacagaccaataagtaatgaaatcaacatttttactactgaattctaccaaacatttaaagaactaataccaatcctactcaaactattccaaaaaatagtggaggagggaatacatccaaactcattctatgaggccagtattatcctgataccaaaccagagaaagacatatcagaaaaacaaaactactggctcacatatctgatgaatatttataaaaaaaaacttcaagaaaatgctagcaaactgaattcaacaacacattaaaatatcattgatcatgactgatatggtttggctgtgtctccaccgaaatcttatcttgaattgtagttcccataatcaccacgtgttgtgggaggtacccagtgggaggtaactgaatcatgggggcagttacctccatgctgttctcatgatagtgagttatcctgaggtctgatggttttataaggggctttttccccgcttcagtctgcacttttccttgttgccatcacacaaagaaggagaagaagaacctgtttgcttccccttctgccatgattgtaagtttcctgaggctgatcagccctgcagaactgtgagtcaattaaatctctttcctttgtaaattacccagtctcaggtatgtctttattagcagcatgagaacagactaacatagtaaattggtgccaggtagtgaggcattgctgtaaagatacccaaaaatgtggaagcgactttggaattgggtaacaggcagagtttagaacagtttggagggctcagaagaaggcaggaaaatgtggtaaagtttggaacttcctagagacttggagggctcagaaggcaggaagatgtgggaaagtttggaacttcctagagacttgttaaatggctttgatcaaaatgctgatagggatatggacaataaagtccaggctgaagtagtctcagatggagatgagaaacttgtgggaactggagtaaaagtcactcttgctatacaaagagactggc

SEQ ID NO: 248 - DNA, 1458 bp, Homo sapiens
ccctgttaactgggcatggaaggaaggccaagtctgccattaagtctctttttgagcctgtatatatttgcataaggtccattaactatattaagtggtcatagataaaccagatacttataggcaactctaataaactacatgcagctttgtagattatttgcaataaaattttaattttaacaatcctttaattgttaaattaaagcctgcctaagctctcttgtagtattttgcatatgtctggggtggatctctttattggcttttggcatatgcgtttggtttaaagcagtccaagcaaaacataagtagaaaggtaggcttactgattatatatggtatatatatttacacacacacacacacagagtaaacagccataagaactatgtccagctctttctaatatagctaagtaactgtaacagtcagttagtccacctgaggaccccagctttattttttaagtaaaaataaaaatcttacttgttatcaaaacaatatgttccttatagtaaaacagaagcaaaatttttaaataggaaatttggaacacaataatcataactccaccatccagggataaccactgttaatatctaaggttgtattcttccagatcattgtatatatactgtagagtttggagtcatactattcattttaatttaaaataaacttaaaaaaaacttagcaatgtattgtgactatctttctttctttcttttctttttctttttttcttttttttttttttggagacaggatcttattctgtcacccaggctggagtgtagtggcacaatcatagctcactgcagcctcaacctcctgggctcaggtgttcctcccacctcagcgtgtcaggcagctgggattacaggtgtgcgccaccatacccagctaagttttgtttttgtttttgtttttttgttttttgttttttttgagagatggcatttcaccatgttgccaaggggggtctcacactcctgggctcaagtaatctgcctgtctcagcctcccaaagtgctgggattacatgagtgagccactgcacccagtccctatctttccttccttcctccctccctctctccctccctctctctctctctctttctttctttcgacagagtctcactctgtcacttaggctggagtgcagtggcccgatttctgctcactggaacctccacctcccgggttcaagtgattctcctgcctcagccccctgagtagctgagatcacaggcatacaccaccatgcccagctaatttttgtatttttagtggagatggggtttcaccatgttggccaggctggtctcaaactcctggcctcaagtgatccacctgccttggcatcccaaagtgctgggattataggcgtgagccaacgtgcccagctgggcccctatcttttaataataataaatattcttcaagactttc

SEQ ID NO: 249 - DNA, 1941 bp, Homo sapiens
tcttacctacggatgacactcctgtgcaagaagatggagaggcagaatttcaaatggtggcagtgaaacctaaagccaccgggggctttggatgtgagcctatcagaggctcaaaatggaaatgtgtcagaagaaacagtggggcatggaaaagttaaaaaaatccctaaaacatgttatgattgtgggcttgtcagaagccccaaatggagacatgtctaaagaaatagtagaaaatgtaaaagttaaagaaaactagaaatctatcatactaaccagtgcagaagcagcaattcagtctctagattcgaaatcaaaaaagaaaagaagaacaagagaaaaatagtgactaatgctgggcgtgatacaaaaaaagcaaaaactgaaaacaaaggggaatccgaagaagatggtatcgaggctcctgaagaaacagaaaactggggggaagccagacaatgagagagatgagaatacttcatttcttctctaattttgtcagtgaaaacactttgaaggcaataaaagaaatgggctttaccaacatgactgaaatttagcataaaaatgatgggccacttatggaaggcaggatcttccagcagctacacaaaccagcagtggcaaaaaccctggcatttctcatccctgcatttgaactaattgttaagttaaaattcatgtccagaaatggaacaggagtctttattctctcactaattaaacagcttgtcctgagactcttggtgttcttaaggagctaatgactcaccatatgcacatgcatgggttgataatgggtggcagtaacagatctgctgaagtacagaagcttgcaaatgggatcagcactggtggtcacaccaggccatctcctgggctgtatgcagaattctgcaggatttaagtataaaaacctatggcgtctggttatggatgaggctaatgatatcttggatgctgggtttgaagagaaattaaagcaaattattaaacttctttgaacatggagactatgcccttttccgccacacaaactcaaaaacttgaagacctggcaaggatttctccaaaaaaaaaaaaaaaggaacaaatgtatgctggtgttgataatgataaagctactgcaacagtggatagtctcaagcggggatatgttgttcgtccctctgaaaaaggattccttttgctctttatattccttaagaactgaaagaagaaactgatggtcttcttttcatcctgtaggtccataaaataccactatgagttgcggaactacattgacttgcctacctcagccattcatttccagaagcaaaattacgtgtagaattacattttttccagttctgtaatgcagattcagggatattgtgtacagatgaggcagggagagagctagatattcctggctggattgttcagtattatcctccagatgaccctaaggaatatgttcatcgtcgggggacaatagccagggacctaaacgaaagagggcatgccttgctcagtttttgcccagaagaattgggttttgtttgttacctgaagcaacccaaggttccattaagtgaatttgacttttcctggcctaaaatttctgacattcagtcttggtttgtaaaattaatgaaaaagaactactttcttcataagtcagcccaggaagcatataagtcatacatacgagtaaatgattctcattctctgagacagatttttaatgttaataacttaaatttgcctcaagttgctctgtcattcggtttcaaggtgcctccttctgttgatgtgaatgtgaacagcaatgaaggcaagcataaaaagagaggaggcgagagtagattcagctaccagaaaaccaagaaagttaagtccataatctttaaaaacattagcacgaaatcatctgatagcaggcagttctgtcactga

SEQ ID NO: 250 - DNA, 2811 bp, Homo sapiens
ccgatgccacaccaaatggctagagggtgtgtttgggatgacctgagtctggtaggcaacttccagtggaccccacggtgcgaccacctccctttgagtgtgggggagatgtagcgactggcttctagcagtaggatagggcagaagtgacagtaggttagtcttgtggttaggttacaaaactgacctctgtgatggtagcgtccctcgtcagccctcttgtcttgccctctcgctggctggtggtgatggagccggctgccatggtgagcggccctgtggagaagccagggaggaatggagacaatctggagaaacagaatcacaccaacaaccacgtgcgtgagcttgctgtgtgctcttgcttgggagcaagttacaggttcagcccaagaggagcggaccactccagggtgtaaataccaggagggggaattggaagactaccctaagcatgccgaccggagactgtgtgtgtgtagtaggtatttcttactgggagatcacggaaaagcaagtttgagaaacactcccatcagatgggtgggccgaggataacctcaaagcctttggttctccgaataggtgcgtaggactcacccaggcactctttccttttttaaattgtggtaaaaactacataacagtggccaggcgtgatggtgcacgcctgtaatcccagctattagggaggctgaggcagaagaactgcttgaaccaagggggcaccgctcctggctgtaacatgttttcaatatcccccctcttcggtggcacaggggctggccccatatacatgtgcgatggcaactgacagggtccctgataaaccggagtgctccagaaacaccccattgcgtgggacggaggatgttaggtggccctcctagcgtttgagtttgataaatgagcaaaggaagtggtttttactagaaagccagctttccttttttttttttttttttttccagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacagtgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacagttacatcatcttgagtacagttctctcaaggaaaaagcaagcccagcatcttctgccatggcaaccctggcttggagcctccataagagagaaggccctaagaataataccattttcttgctctaagttgctcttacgggaaagaagtgataatattcttcctaaacgccatcattcgtgcatccttcccacctatatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatagggccaggcacagtggctcacacttgtaatcccagcactttgggaggctgaggtcggtggattgcttgagcccaggaggagttcaagaccagcctgggcaacatagtgaaaccccaactctacaaaaaacaaatgttttatttttatttattttagatggagtttcactcttgttgcccaggctggagtgcagtggcgcaatctcggctcactgcaacttctgcctcccgggttcaagcgattctcctgcctcagcctcctgagtatctgggattacaggcatgcgccaccacacccagctaattttgtatttttagtagagatggcgtttctccatgttggtcaggctggtctcaaactcccgacctcaggtgatctgcctgcctcggcctcccagagtgttgggattacaggcgtgagccaccacgcccagccgggtttatagttttataacccttatgacaaatctcatagtattctgcagggataagcatgaaaccactcgttcaataagtgcaaacaaaaacgccaacaattcttaagacatttctaatcttattttaccaataattttaaagccagcttatgtattaaagatttataactacttttattaacacgtttaaaattctatgcagcttaaagcatttataatggataaaactgccaatactgagtgcctgacataatatttgaaaggtggcaggcattcaaccatggtcactgaatgagagatgtagggaagatgatggcagggaggtttttagatatcaacaccctgatagttctcattttaaccacctgtaagtgcacatacaagtcaacgccactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtac

SEQ ID NO: 251 - DNA, 3875 bp, Homo sapiens
caagacctaagtcctaaacacaaggagatctgatgctataaattttcatccaagctcaggagaagacctgtgtctcagctcaaccagtgcttttacagctagggattaagtaacctacttcactttaaacccgaattcagtaagtggggaacccattatttgtacctaagtggtttaatttcagagcactcgtagaaattatactctataatttcttcttatttgcctagtgatccacccaaattctacagaaaactgagtcccccttgatatctccttctcccttgctttttcctcccacctgttaaaacatcctcttgagtctaatccaaaatatattttgagtcatctccttctccctgcaactctagcaattatctctttagcctcttatctatttttcttgattccactgttacttttctctaatccgttccttatacagaaagcattctcttgtttaaattgtttgatagttccacattgtcattggtgtaagattttttttttcttaatttctactaggcttaaaagtcatatatctggcccctgcctacctctagatttatctagttccattcatctcttcactcagtacactccaagtatactagctttattgcaattctgcacatattccattacacctgaagccataactatattttcattcctcctgaagctataactatactttctggtttatctgagtaactagccttgtatataaggccttagtcctcaggacttttctttgggagaatagctggccctgaattatgattattataaatgcacagacaatttcatggaagcagaaaagaataagcctcagaagcttcctttgtcaagaaatgaaagtacttgcaattagcattcaaatagatgataaatgtagagtatctgtagggtatacaatgattctaaatttaattgacaattagctgtgattgtgtgaccctataaataaaattgtaataaattgtattgcataaattaaatttattaaacactatttttgctgtatcctaatatttattagtctatttaatcactctctgaaattagaaaaaaaagacagtctccatataacttctcaatttgataaatgctcacttaaaaataggtacatgagggaaacagagattggatgtattataattcaataggcctatactttttaaacgtaattacttatattggtaatatgtggaatatgtgcaaagtttaaatggttattaagattttaatattaagggagaagagtaggagatgttattagaatacataacacattagatattagaatacataacacattaagaatactagtcatatccttaatagatggaatatatctgtcagacatagaagagaatcaccagcactgtaaacaataataagctaatttcaaaataacaagaattaatttgtcagtttttcagaagtggtcaacagatttctctcatagaaattcgtctgttacaatatgttagaaactgtgaagaatagaagctgtgaagaatagaagcacctgaaaagctgtgttattcacatttgctgttgtagcctcaatgtttgtgtccccccaaattcatagattgacacctaatggccaatgtgatgattcggaggtgggccattgggaagtgattaggtcataggtggggcccacatgaatgagattagtacctttatgaaagaggccccagagggctgctttgcccttttccactatatataggcatagcaagaaggcactacttatgaaccggaaaatagacatcaccagagaccaaatctgctggtccttgatcttgaccttctcagtctgtaaaaccatgagaaataaatttttgttgttgataagccacccggtctaaggtatttattgtgttacagcagccttagcagaataagacaatatcttatgacaatatagtacaaggattaatgattatgctttaaaaagtagttttaggccgggtgcagtggctcacgcctgtaataccagcactttgggaggcggagacgagtggatcatgaggtcaggagatccagaccatcctggctaacacaatgaaaccccatctctactaaaaatacaaaaaattagccgggcgtggtgacgggcttctgtagtcccggctactccggaggctgaggcaggagaatggcatgaatccgggaggtggagcttgcagtgagccgagatcacgccactgcactccagcctgggcaacagagggagactccatctcaaaaaaaaaaaaacatgtagttttaaagatattttaataaaaataaacacgatttcctgagaaaaaggttaaaatgcgaagtttttatttctaaaaaaatactctgaataataaatcatagaagaaatgttacatagaacaggcttaaagttcagaatggaaactagtgggtacatgaaagatagtaaataagagagccaataaagtagtaattctccatcaccccacttggtacccaggatatataactgaaggacagaaaaaatataattttaaaatgacaggtttatcagacattcatgtgggattactgaatttaaaatgtgtaggcaaatcaaaactttaaaataggctaataaataattcaataagccaaaatgatttctaacaatgaattaaagttggaattggatatcatctataaaataataataaagacaatctttcttaaaagtatgttttaaaaataaaagtgcaaagaggtaaaattctttggtattttctattagaagtataggaaagacatagcaaagaaacaaaataaaagcagaatccctattattaccaaaaaatgcaacccttgtgaaaatgaaatgaacacactaataataaaagatataaaaatgtttatgatttagaagaaaaaggtgaagggagtttcattaagatcaagaaatgttgggtgttattttgtatttgtttctaataacagggcatatatttacctgttctctcactaatttatttaatatatatttattgagcactatccattgtcaatattgcttgatgataaggtcacagagatggaacacaaaatttgcacggtcaaggactcatagcccagtaagtaatagtgaaaggtgaagccgactgggcatctgggtcagctggggacttggagaacttttctgtctagctaaaggattgtaaacacaccaatcagcactctgtaaaaacgcaccaatcagcactctgtgtgtagctaaaggtttgcaaatgtaccaatcagcactctgtaaaaatgaaccaatcagcactctgtaaaatggaccaatcagcgctctgtaaaatggaccaatcagcaggatgtgggcggggccaaataagggaataaaagctggtcacctgagccagcagcagcaaccttctcagatccttttctacactgtggaagctttgttcttttgctcttcacaataaatcatgctgccgctcactctttgggtccacactaccttaatgagttgtaacacacactgcaaagatctgcggcttcacttctgaagtcagtgagaacaggaacccaccgggaggaacaaacaactccagacatgcgaactttaagagctgtaacactcactgcaaaggtctgcagcttcactcctgaagtcaagcaagaccagaaacccaccagaaggaagaaactagagacacatctgaaggaacaaactccagacacaccatctttaagaactgtaacactcaccgtgaaggtccgcggcttcattattgaagtcagccagaccaagaacccacaggaaggaatcaattccggacacaatagagttcaggatggagaaaaatacacaatttaaaaaatattatgagagg

SEQ ID NO: 252 - DNA, 20130 bp, Homo sapiens
agtgctgtcgggaaggccactggagtcatacgcaagtaggtctgatgctgattctcctgcccccctcacagggcagtgatgtggaaccaagtgagacagtgcacagaaaagcattttattggctgaacagccctgtgataactacgagagggtcctccaggcctgggcctccagccacctcctgtcagagctaatcaagccagcaccaactcagcaactccctggacagaccctccaggagcaactgaaagcctctcagtagagaactgcccttgctaccctcagactaataaaggaggaaagaccctaagtgccttatccacacctccaacaagctgcagttaatccaaggagaggccagtctgtctcccacgggtcccacaccatcctccctccatggctagtcaccagacagggaatctctggcttgggctcacagcacagaccctccatcttgggctgactgtactgagtgattgctaacctgcatcttcctggggtggagcccccaggagtcaataaaatgacccttggccacaccaccactaagatctcttcctctatggcctctaagctgaggaaggaatataaacactgagattgccccagagctgcagtgagcagcccagaagtgccaagtcacgaactacagccagaactaaagggtggagaggtatccacactttcagagcactaagaggtaaaacagctccaactgtgaggaaacatagggaaaccacccaaccaagcaagagtctaccaactgaccaataggcctaagtgtcaccttctggatcacactccaaagcttcaacaccaaaaatatctcactaacataaccccttctgaaaccagagacaagaagtcagcttcaaataaagaccctcacaaagccttggcctagtgaaaacatccagaaaagaagtctatttgactgtattcatctacactacagttaaaggaacacccacatgcagagatgagaaagaatcaatgcaagaactctagtaactcaaatggccagagcgtcctacatcctccaaataacagcaccagttctccaacaagagctcttaaccaagcaagctcgaacttgctggaatgacagaaatagaattcagaatatggataggaatgaagatcatcaagattcaggaggatggcaaaacccaatccaaggaaaataagaatcacattaaagtgatacagaagttgaaggataaaacagccagtataagaaaagaacctaatgagtctgaaagagctaaataacacaatacaagacattcacaattcaatcacaagtattaacagcagaataaaccaagctaagggaagaatctcagaacttgaagactggctttctgaaacaagacagtcaaaaataaggaaaaaaaaaaaactaaaaaggaatgaacaaaacctccaaaaaagtatgagattatataaagaggcaaaatccacaaatcaatggcatccctgaaagggaggaggagaaagcaaacaacttggaaaacatatttcaggatatcatccatgaaaatttccccaaccttgctaaagaggccaacagtcaaattcaggaaatacagagaactcctgcaagattctacacaagaagatcattcccaagacacataattgttagattttcaaaggtcaaaatgaaagactgttaaaggcagctagagagaaagggcaggttacctacaaagggatccccatcaggctaacagtggacctctcagctgaaaccctacaagccagagagattgagggcctatatttaacattcttaaagaaaaaaatcttcaaccaagaacttcatatgcagccaaactaaactccctaagtgatggagaaataagatccttttcagataagaaaatgttgaaggacttcattaccaccagatctgtcttacaagagatcttgagagaagcactaaatataaaaaggaaagatcactaccagctaatccaaaaatacatgtaaacacacagaccagtgtcactgtaaagcagccacacagtaagccaacataataaccagctaacagcacaatgacaggatcaaatccacacatattaatatgaacctggaaagtaaacaagctaaatgccccacttaacaggcatagagtgagaaactggataaaaaagaaacatctatggtatgtatgctgtcttcaagagacccatctcacatgtaatgacaaaataaagggatggagaaaaatctaccgagcaaatgaaaaacagaaaaaagcaggggttgcaatcttactttcagacaaaactcatttcagatcacaaagatcaaaaaagacaaggaagggcattacataatgataaaggtttcaattcgacaagaaggcctaactatcctaaatatatatgcacccaacacaggagcacccagttttataaagcaagctcttagagacctacaaagagacataggctcccacacagtaatagtgggagacttcagcagtccactgacagcattagatggaacatccaggcagaaaattaacaaagacattcaggatggtaactcagcattggaccaaacggatccaatagacctttacagaaggttctacccaaaacaacagaatatacatttatctcatcaccacatgacacatactttaaagtcaaccacataattggacataaaacaatcctcaacaaatagaaccaaaatcataccaaacacattctcagaccacagtgcaataaaaatacaagtcaacacactgaaaattgctcaaaatcatacaattacatggaaattaaacaacgtgctactgaatgacttctgggtaaataatgaagttaaggcagaaatcaataagctcttttaaaataatgagaacaaagatacaacatatcagaatctctgggacacagctaaggcagggttaagagagaaatttatagcactaaatgcccacatcaaaaagctaaaaaaaaaatctcaaattaacaacttaacaactgaaagaatcaaagaagcgagaacaaattaaccccaaagctagcagaagatgagaaataacaaaaatcagagttgaactggaggaaatcaagacagaaaaatattcaaaagatcaacaaatccaggagttgtttttttgaaaaaaaatcaataaaataggccactacctagcctacttaagaagaaaagagagaagattcaaataaacacaattagaagtaatgaagcaaatgttacaactgaccccacagaaatgcaaacaatcatcagaaactactatgaacatttctaaacacacaaactagaaaacctagaagagatggataaattcctgaacacatacaccctcccaagactgagccaggaagaaattgattccctgaacagaccaataatgagctctgaaattgaatcagtaatagcctaccaacaaaaaaaaaagcccaggacctgatagattcacagccgatttctataaggtgtacaaggaagagctggtactattcctacagaaaccattccaaaaaattgaggagaaggaacttctctgcaactatttctatgaggccagcatcatttgataccaaaacccagcagaacacaacaaataaagaaaacttcaggtcagtacccttgatgaacatcagtgcaaaaattctcaataaaacacttgcaaaccaaatccagcagcacatcaaaaagctaattcaccacaatcaagtaggcttaatccccaggatggaaggtgggtttgacacacaaatcaataaatgtgatccatcacataaacagaactaaagacaaaaaccacatgattatctcaatatatgcagaaaaggcttttgataaaatctaacatcccttcatgttaaaaaaactctcaacaaactaggtattgaaggaccaaacctcaaaataataagagccatctatgacaaacccacaaccaacattatacaaaataaacataaggtggaagggttcaccttgaaaactggcgcaagacaaggatgccttctctcaccacttctattcaacgtagtattgggagtcctagtcagagtaatcaggccagagaaagaaataaaggacatccaaataggaagagagaaagtcaaactatctctgtttgcagatgacattattctatatctaaaaagccccatagtctcagcccaaaaagctctttcaactgataaacaacttcagcaaagttgcaggataaaaaaatcaatgtacaaaaattactattattcctatacaactacaacaaccaaacagaaccaaatcagaatggcaatcccattcacaattgccatacacacacacaaaataaaatacctaggaatacacctaaccaggaaaatgaaagatctctacaatgaaacttacaaaacactgttcaaataaatcagagaagacacaagcaaatgtaaaagcatccccttctcatggatagaaagaatcaatagtattaaaatgtctacagtgcccaaagcaatttacagattcaatgctattcctataaaaataccaatgacattcttcatagaactagtaaaaatattttaaaatttatatggaaccaaaaaagagcctgaatagccaaggcaagcctaagcagaggaggaatcacattacctgacttcaaactataccacaaagctacaatgaccaaaacagcacgttactggtacaaaaacagacacacagaccaatggaacagaatagagagcccagaaataaggctgaacatctacaaccatttgatctttaacaaagctgacaaaaacaagcaatggaggaaagaccttattcaataaatggtgctgggataaccagctagccatatgcagaagattgaagatggacgcattccttatgccatatacaaaaatcatctcaagatggattaaagacttaaatgtgaaacccaaaactataaaaaccctgaaagacaacctaggcaatggcatactggactcaggaataggcaaagatttcacgacaaagacaccaaaagaaatcacaacaaaagcaaaaattgacaaatgggatctaattaaatttaagagcttctgcattgcaaaagaaactatcagcagagtaaacagacaacctacagaatgggagaaaaatatttgcaaactatgcatctgacaaaggtctaatatccagcatctttaaaaaacttaatgatatttacaagagaaaaacaaacaaccccattaaaaagtgagcaaaggacatgaacagacacttctcaaaagaagacatacatgcaaacaacaaacatatgaaaaaaagctcaatatcactcatcattagagaaatgcacataaaaaccacaatgaactaccatctcacaccagtcagaacggctattgttaaaaagtcaaaacataacagatgctggtgaggttgtggagaaaagggaacctttacacactgttgatgggagtgtaaattagttcaaccattgtggaaagcagtatggtgattcctcaaagagctaaaagcagaactaccatttaacccagcagtcccattacagggtatataccctgaggaatataaagcattccaccataaagacacatgcatgcaaatgttcattgctgcactgttcacaagagcaaagacatggaatcaacctaaatgctcatcaatgacaaattggataaagaaaatgtggtagatatacaccatggaatattatgcagccataaaaaagaatgagattatgtcctttgagggaacatggatggagctggaagctatcatccttagcaaactaatgcagcaagagaaaaccaaatactgcatgttctcacttataagtaggagctaaatgataagaacttgtgaacacaaagaaggaaacaacaaatactggggtctacttgaggagggagaagagcagaaaagagaactattaggtgctaagcataatataatacctgagtgacataacaacaacaaacaaacccctgtgacatgtgtttatctatgtaactgtgaaccccaaaaacctgagacaggtctcatttaattttaaaaagtttattttgccaaggttgaggccacacacctgtgacacagcctcaggaggtcctgacaccatacgcccaagatggtcagagcacagtttggttttacacattctagggagacatgagacaacaatcaacatattcaagatggacattgattcgatctggaaagatgggacaactcaaaggcaggaaaactcaaatcagggaggaggctaggtcataggtagctaagagacaaatggttgcattcttttgagtttctgattagcctgtccaaaggaggcaataagatatgcatttatctcagtgagcagaggggtgactttgaatagaatggggggcaggttggccctaagcagttcccagcttgacttttccctttagcttagtgatgtgggggcccaaagatctattttcctttcacatagcaaaccttcatatgtacctccaaaccttaaatattttgaaaaaaaatttagaggtctcttccgcaattctgggaccacaaatgccagaaaacttccaaatacttcaccctcacaaaagtatgagctttaagatctggactttgccctactggatatctccattccattctaagaaataggaaggaattgctaaaatatgaggggtttctgacaataaacctcaatataatcagtgaatacttcctgagcacctgccttttgtcatgctctggtcaaggaactgagtgtagagatgaatataaaatgtaatctctgacatcagtgatttcattaggtagcacaggacactaagccagtatctgccactttatcagccttccagctatgtctgctctagcctttaaatcagagtgtgtccagataataaatcaaatgtttacacgtgtggaaggaaagagtaccagtagggattttttttactcttaatcactcatttgagcacacatagtacctggaaagaaaaaagaaatctcttttctgtctttgcatcaccagaaatttgccttgcaggatctggtatagtctagctggccaggggataatggtggtttgggttggaagaggaggaagggtttcctccgtagtttaggtttgcttcagtttcaccagtgattgttctcaaaggtcccgataacagaacctctcaacatctttcccctaaagaaactatgataaccttgtatctttatgacatgaccacttacgcatcccaataaaactgagagaaataatagctttctttaacgcttctctaagagaactcttgtctactctcattgactcccagatatacatctctatcccagatccttctcctgatcaccagacctataatgactggtggacacctctatgtgactgtcatgtggctgcttaaagttcaccatgccatagactgaactcactgtttctaccccaccttgatctttctattctcggtgactagccgcattgttcactggttccatcctcttcctcattctttattcagtactcttcatttcctatgaaataaccccataatgccctactgacttcttgtattcatccacttctttcaatcaccactagcactactttggttcagtccactgctctcttttggattgttgctattctcccaattagtgtctccacttctagtcttacctgctctagtccagtctccaaagtcatttttataatttaaaaatctgagtatgtatcctccatttgaagcactttaataggaccccctttatcttcaaataaagtccttcacataaatcaccacgctttcattatatgacctgttcatctctccagcttcacatagtgacactccccaccttattgtccataatccatactattccaattgtagttctcccagtggaaaaaaaaaattctattgcctctggaatttttcacatgctggccaaaatatttattctttgtcttttttatctgtgctctctcccagttccactttccttttttcctgcttactcttgcaaaaaaaatcctccctgatacctagaggactacatctgtgttggtgtctctgaaatttactcccatagggtgcttgacttacccaatattgtagcccaaacccactgaactgactgtaaatgctttggaaggtgaaccatgacatgtttgttgttaatttcctgatgactaacatacaggatggcacagaatcagacatcaagaaagatgaatcaaaagagaatgacatcagtaagatggcagagtaggaagccctggaccctccttctacctacaaacacaaattcagcaacaatttatggacaaattccctttgtgagaaatcaaaaactaattaaaaagctcctgcactctggaacagcataaaaacagacatagcaaagcctgtggacagattcaggatactgtcttgtcagagacccttgcccccagtgcagggccatacattcaggaagaaaccctgtagcttccagcttcatgcagtcgaggtaaggagctggttgcacattcagcaccccaacatttccaagggagtccccagaggtttgccttctttcttgctagacctggtgctctaatgggtctggtatagtctagctggccaggggataatggaggtggtggcttgggttggtagacaacattgatttccttctcccccaactccagttggcacagagtgagcagatgaaaactttcagccctcagcttcccccagggaggaaaagagctgatctgtgcaaccagagctccaacttctccagggctgctcaaactattggcatctgtttcaccagtcttgaagctctgatgtgtgcagtacagtctaactacccaggagagaacaaatatgccaatttgggttggtagatgctatagtttgaccaccccactccactctccagctcagcacagaaagagtgaacaaagccatagctcctgcttctccctggggaagtaaagaggtagtagatgtccataagaatcactggctgggctgatggggggttgggggtgtattttcctgtatgaagccagttcatgaagactgtgatagctgcctgttttgtctaataaccctcggatatcaacacagggagtcaaggaaattaaataattgggcaaagatatttttaaaaagggaattaagatacatttccaaagactaaccctaatgaactggagttacaacttcatgaagatgtggactgagtcagtaaaacatgcatttaaaaagtgaggatttcaacagagagataaaacatattttaaagtgccaaatagaaatagaaatgcataatagatgagccaaatattcactggaggggttcaacagcagactagatcatgcagcagaaaggatcagtgaacccaagcacaggtcactagaaataattcagtcaaagaaacaataagaattaaaagaaaaaatggagaaacttaagggacttatggatcaccatcaagtgggccaacatacatattagggatattttagaaggaggagagagaaaggaccagaaagattgttcaaagaaataatggctgaaaacttaccaaatcttgggaagaaaatggacattcagatctaagaaattcaaaagacaccaaataagataaacccaaagaaatacatacaaatttgtaatcaagttgttaaaagtcaaagacaaagagaactttaaaaacagcaagagaaaagtgacttgtcacgtacaagagaactctataagactaccggtgggtttttaagcagaaagttttcaggtcagaagggagtgggatcatatattcaatatgctgaaaaaaaactgtcagtgaagaatactatactcaaaaaatttttctataaaagtgacacagagtaggaggattctggaaaggtggtagagtaggaagcactaggaatagtaatctgtttccccatctacacaaaaattaccctggactaatctgtctaatgtaattattttggaactccaaagttcattgaaggcttgcaacttccagcagaaggtttggatgataaatatggttaatgtcagtcaatttcagctcttaacacagtaacagctacccatctccacccatactctctccccgtgggaggtagccagcacatgatcctggagtaactttcacaaagcttttgggagtcatggtaccaaatatctggtatctgtgctgtgatttctgattgctgcttctgatcacaacagcgtagacaaggaggtagtggctattgttggacttccctccattgttgcaagccccatcctttctggataaagtgacttccagggcatgtcactaatcatctgggaagtgcatactaaaccacattaaaatgtcacctcacacctgctagaatgactattatccaaaaaaaaaaaaaatatatatatatatatatatgtatatacacacatatatataaaacaagtgttggtgaggatgtggaaaaattggaaccattttacatggttggtggaaacaaattaatacaggcattatgaaaacaatatggagacctaaaaaaattaaaaacagagcgatcacatgtttcagcaatcccactactgagtacatgtccaaaggaaagaaaatcagtatgtcaaaggagtatctgcattcccatgttcattgccgcactattcacaatagccaaggtataaaatttacctaagtgttcatcagtagataaatggataatgaaaatatggtgtatatacacaatggaatattattcagccttaaaaagaagaaaattacatcatttgtaataaaatggaggaagctggaagacattacattaagtgaaataagccagtcacagaaagacaaacactgcatgatattacttatatgtagagtgtaagaaagtcaaactcatagaaacggagagtaaaatggtggtttccagaggctgaggggtggagaaaattaggaagatgttagtcaaaacacacaaaatttcagtgagacagcaggaataagttcaagagatttatcatacatcacagagactacagttaataacaatatattgtatacttgaaaattgctaagagattaaagtgttctcatcacaaaaaaaattataagtatgtgaggtaatgcatatgttcaatagcttgatttagccattccctaatgaatacatatatcaaaacatagtgttgtacaccataaatatttataatttttacttgttaattaaaatattttttaaaagaaaagacattctgacatatgctacaaaataaatcaacctgaaaacgttatgctaagtgaaataaaccagtcacaaagacaactattgtaggtttcaatttatatggagtatttaaagtagtcaaaatcatagagacataaagtagaatggtggttgccaggggctagggagtgaagggaatggggagttattgtttaatgggtatagagtttcagttttgcaagattaaaagtgttctggaaatgaatagatgatgatagatgtacaacaatatgagtgtacttaataccactgaatgtacactaaaaatggttaagaaggtaaattttatgttacatggattttaacacaataaaaaattgaaaaaaataaaagtaggtataaagactttcccagacaaacaaaagttcagagagttcatcttcagtagacctgccttacaagaaatggtagagttcttagagttgaaacaaaaggacactaaccagtaacatgatagcataagaaaaagtagaaaactcattggtaaaggtaaatatgtagacaaatacagaatactgcattactgtaatggggtggaaaatcaccccattaattctagcataaaagctaaaagacaaagtatgaaaaataaatataactaaaaccatgataaaagatatacaatatgaatacacataaattgtgacaagaataatatatgaggggttaaagtgtagagtatgtgattgaacttaagttgttatcagcttaaaatagactgctataaccatattttatgtaagccccaaagtatgtatgtaaccacaaagaagattttttatgtaaccacaataaagtccctatagaaattacacaaagaaaataaagaataaaatcaagcatattatcttagtttatttgggctgctataacaaaataccttagacttggcaatttacaaataacagaaatttattgctcacagttctgcggactagaaagtctgagatcaaggcatcagcagattcagtgtctggtgatgtgtcagtctctgcttcaaagatgatgcttgctcactgcaccctcacatagtagaaggggtgaataagctcccttaggcctcttttacaaaggcactaatccattcattagggtggagccctcattatccaatcatctcccaaaggctccacactttaatattattgaattgggtattaggattcaacatataaattttggagggaaacaaacattcagatcatagcacatattaatgcaaaaactttacaaaacataaagaaagacagcaagagagaaaaagaaaagggaactacaagactgagagaaaacaactagtaaatgcctatagtaaatcctttcctatcaatattactttaaatgtaaattgattaaattcccccaatcaaaagacaaacagtgagtaatggactttttttaaagacccaactatgtgctgcctacaagaaactcactttagatataaaaacacacataagttgaaactgaagccaagaaaaaagtattccatgcatatggtaatcaaaagagagtaggagtggctgtacttatatcagaaaaatagacttgaagtcaaaaattgtcaaaagagacaaagaaggacattatatgatgaaaagggtcagtccataggctgtaataccaatataagagcacttaaatatataaaatattgacaaaactgaagggaaaaacagacagcaatacaataatagtagaattcagtaccctactttcaataatgaacagaatatccacacagaagatcaataaacagaggacctcaatcgcattataaaacaaatggacctaacagacatgtacagaacattccatccaacagcagcataatacacattattttcaagtacacatgattctttctgcagagcaggtcacatgttaggtcacaaaataagtcaacaaatttaaaaagattgaaatcttaccaaagattgaccattatggtcaaccttttctgaccacgatggaatgaaacgagaaatcagtagcagaaggaaaactgaaaaattcacagatatatggaaactaaacaacatacttataaacaacaattgagttacgaggaaatcaaaaggaaattagaaaatatctcaatacaaataaaaatgaaaacacaacataccactgcctatagggtatagcaaaagcagtagtaagagagaagtttatggtgatgaacatctacattacaaaagacaaaatgtctcaaataaacaacctaactttatacctcaaggaactaggaaaaaacaataaattagttccaaagttagcagaaggtaggaaataacagattattacccagaaataaatgagagagaaaatataaaaacaatagaaaaaaatcaatgaaactgagagttggttttttaaaagataaataaaagtgacaaacttgtagctagactaagaaaaaacactcaaataaataaaatcagaactggaaagaggaaacattacaactcttgccacagaaataaaaaggatcctaacagactgctatgaacaatatccaacaaactggataacctagaagaaatgataaattcctagaaacatataacctaccaatactaaaccataaggaaatataaagtcaaaaccgacacataactagtatggagattgaatcagtaatcaaaaacctccccaaaaatcaagctcaatacctgtagagtcactggtaaactctatcaaacatttaaagaagaattaatgccactccttctcaaactcttccaaaaaattaaagaggagagaacacttccaaacttattttatgaggctagcattaccttgattccaaagccagacaaagacaacacaagaaagaaaacctacaggccaatattctcaatgaatatagatgcaaaaaagcctcaacaaaatactagcaaactgaattcaatggcacattaaagggattatacaccatgaccatatgagacttatcccagagatgtaaggatggcttaatgtcgaaaaagcaagtaatttaatatactacattgacataataaaaaataaaatcacatcatcattttaatagatgcaggaaaggcatgtgacaaaatttgacattgtttcatgaaaaaaactgtcaacatactaggtataggaggaatctacttcaacattataaaggtcatatataaaaagtccatagctcacattatactcaatggtgaaaaactgaaagcttttcctctaagatgagaaacatggcaaggatgcccactcttgccagttctattcaacatagcactagaagtcctagccagagaaattagacaagaaaaaataaacataaagattcaaactggaaaggaagaagtaaaattattcctatttgcagatgacattatgttatatagagaaaactttaaagactcaattttaaaaaaaaaactgttagaataagcagttaataataataaataaattcagtaaagttgcagttaacatacaaaacttagtagtattcctatataccaacaacaaaataaattgttagaataaacagttaacagtaataaattcagtaaagttgtagtcaacatacaaaacttaatagcattctgatacactaacaacaaatatctgaaaagaaatttaagaaaacaatttcactcataatagtgtcaaaaagaataaaatacataaagataaacttaactacaaggtggaaaacttatactgaaaactacaaaatattgatgaaagaaaactaaacaagacacaaacaactggaaagcactccatgtttatggattagaagagttaatattgttaaaatattcatactacccaaggcaaactacacattcaatgcactccctatcaaaatcccaatggcatttttacagcaatagaaaattttttttattcatgtggaactacaaaagaccataaacagctaaatcattcttgagaaagaaaaacaaagctggaggcatcatagtttttgacttcaaaatatgttacaatgctacagtaatcaaaacagtatggtactggaataaaaaaagacatataaaccaatggaacacaatagggaatccagaaataaatatatgcatatacagtgaaatgatcttcaacaagagtgccaagatacacaatagggaaaagacagtctcttcaatggtgtgggaaaactggatatccacaatcgaaagaagaaaatgagactcctattatatgccatacacaaaaatcaacccaaaatacattaaaggtaaaaccccaaactgtaaaactctcagaagaaaacataggaggaaaagtctctagacattagtcttggcaataatttcatggatataacaccaaaactacaggcaacaaaaacaaaaataaacagcacaccaaactaaaaagcttctgcatatctgaggaaacaatcaacagaggaaaaaaggcaacctacagaacaaccaacctacagagtgctatttgcaaaccatatatctgataagtagttaatatccaaaatacataaggaattcctacaactcaaaattcaagagtaaaacaaaaacaaacaaacaaaaaccccaactaataacccaattttttaaatgggctgaggacttgaatagacattgctccacagaagacttaaaaatggccattaggtataaaaaaagttttcaatgtcactaaacatcagggaaatgcaaatcaaaagaacaatgactatcacctcacacctgttagagtggttattatgaaaaaacaagactacaaataatggtgaggtcgtggagaaactgaaactcttgcacaccactggtggaacgcaaggtggtacagctgctgtagaaaaccatatggaagttgctcaaaaaaataaaaatagagctaccacatgatccagaaatcccacttctgggtattttacctttgagaaatttaggagtgctaatatattgtttgtttgtttttgagacagagtttcgctcttgttgcccaggctggagtgcaatggtgcaatcttggctcaccacaacctccgcctcccgggttcaagcagttctcatgcctcggcctcccaagtagctgggattacaggaatgagccaccatgcccagctaattttgtatttttaatagagacggagtttctccatgttggtcaggctggtctcgaactcccgagctcagggggtctgaccacctcagcctcccaaagtgctgggattacaggtgtgagcaaccatgcctggccaatatatccttgagatcctaatttcacttcttttggctgggtatttttgccaaaagaattgaaattaggatttcaaagatatattagcacgcctatgttcactgcagcactattcacaatacccatgatgtggaaacagcctaaatgtttattgacagatgaatggataaagaaaatgtggtatatatacacaatggaaaactattcaatctataaataaaggaaattcaacaatgtgaaacaacatgggtaagccttaaagatattatgctcagtgaaataagccagccacagaaaaacaaacactgcatgattccatttatatgaggtatctaaaaatagtcaaattcatagaatcagagagcagaattgtggtgccaaggactgggggttgtgggaaatagggagttactaatcaatgggcatgaagtgtcagtcaagcatgatgaataagctctagaaatctgctgtacaatattttacttatcgtcaacagtaatgtattgcacacacttaaaaatgttttaagagggtagttctcatattaagtgttcttaccatgataaaataaaatgaaaatgaaagaaagataaatcaattcagtgaataaattaacaagtactcttgagtccccatgggtgaagccaaggacacatatagattggggttttgttgtcacggggcattttgacttgtatatgtgtttacctactcaatatgtgttacagtatatgctatttctcatttcctacatttctattccaatgacttcatggtaagcttctgacgaaatggcgtggctatgctagtgaagataatattccttgaaactacttacttgatattgcaataatttctccctacaaacatgctaactatagctcctgaatgtataagaaaccatgaggtttttttattatgtatgtgtgcatgtgtataaacatttcatgtagaacttggaagctataatttctaaattcattaacatggtggctgcccagctatagtaaattatatgccttcttcctcttcgggccaagcccacaatggtatgtgctacatgatcgttagtgcccctctcaccatagctctttgatccaaagtgacccacattggctcaatcagactttctcctagaagaattgggaatctgctgctaaaagacccagcacccctagagctgagtcatttgacatggtctgtacatttccatggcatctcacgttcccaagacctacctattcaactctttcttagatcctatgagagtcttccagatcattttaataaattccctatttttaaggtcactttctgtgacttctcaccaaaagaaactctttaactaacgtagcagcagtgttatagaaaactatcagtattatactttccttattggttcaaatttctcaaaggtaaaggaagacaatacaccttgaagtcccactttaatgattttcttaggtaccatgctgttggatctaacaaaactgtagaagaagaaagtagactgaaggaactacaggatctttcatgccaatagagcaattctatatatatatatccgtaacatacaacctagtcctaagtgaaaagcctatgatgcagttcatcaggttcttccagcagtggccagccatgctttgaataccaaccattttctcagaatcctttctagattgagaaacaatatatactgtcatgtgtcccttaatgacagggatatatggtaataagtgctttgttaggcaatcttgtcattgtaagaacatcatagagcatatttacacaaatatagatggtatggcctactatacacctatgctacatggtatggcctattgcttctaggttttaaatctgtacagcatgttactgtattgaatactgtaggcaattgtaacacaatgctaatgatttgtgtatctaaacagatataaacatagaaaaagtatagtaaaagaaatctaaaagattaaaaatggaagccgggggcagtagctcacacctgtaatcccagcattttgggaggccaaggcgggtggatcacaaggtcaggagatcgagactatcctggctaacacagtgaaaccccatctctactaaaaatacaaaaaaaattagccgggcatggtggcgcatgcctgtagtcccagctacttgggaggctgaggcaggagaatggtatgtacccgggaggctgagcttgcagtgagctgagatggcgccactgcactccagcttgggagacacagccagactccgtctcagaaataaataaataaataaataaaataagtaaaataaagattaaaaatggtacacctgtatagggcatttaccatgaatggcgcttgcaggactagaagttactctgggtaagtcagtgagtgaacatgaaggcctaggacattactgcacaccactgtagacttcataaacactgtacacctaggctacactaaatttattaaacaacagttttcctttttcaataataagttaactttagctaactgtaacatttttactttttaattgttttaactttttgacttgtaataacacttagcttaaaacacaaacatattacatacctatacaaaaatattttttatttacattctcattctataagcttttttctattttaaattttttaacttattaaacttttttgttaaaaactaagcacaaacacacacattagcccatgcctacacagggacaggatcatcaatatccctgtcttccagctccacaccttatcccctggagagtcttcaggggaataacacgcatggagttgtcaccttctatgttaacaatgccttcttctggaatacctcctgaggacctgcctgagactgttttacagctaactttttttaaataagcaggagtacatcctaaaataacaataaaaagtatagtttactaaatatataatccagtaacatagttgcttattatcattataaagtattatgcactatatgtaatcgcattgctatacttttatacaactgtagcacagtaggtttgtttataccagcatcaccacaaacacatgagtaatgcattacattatgatgttaccaccactaggccacaggaattttttagctccattataatctaaaagaccaccatcatataatatgcagactgactttaactgaaacattattatgtagcacgactctctctctctctctctctctctctctatatatatatatatatatgtatattttgttttgttttgtttttgtatttgtttttgttttttttgagacagtctcgctctgttgcccaggctggagtgcaatggtgcaatcttggctcactgcaacctccgcctcctagttcaagcaattctcatgcctcagcctcccaagtagctgagattacaggcacccacaagcacacctggctaattttttgtagagatggggtttcactatgttggccaggctagtcctgaactcctgaactcaggtatttcacctgccttggcctcccaaagtgctgggattacaggcatgagccactgcacccagcagcacatgac

SEQ ID NO: 253 - DNA, 5037 bp, Homo sapiens
tggttattcttcttgttctttttctaacttcttgagttcatattaagttagttagcttttagtccttctaagtcaattactgaatgttttgaagttttcactttgtgttactttatattttttaggctacttattaaactaaaccacgttctgaactgttactgctactggaaaccagtcccgatccagaccccaaaagaggattcttggatcttgcacaagaaagaaaggagagggacctgtagtcattaccttcaaggaacctaaatcctggtgtctttatggttatgggtggcatataatatacagacacagtgaaggagtgagatgtgaaggtgctctgtcattgcctcagtcaagactttcatggtacattggaagaaagagaagcgtgaacaaattgcatgatacttgaggtcatgctgtgtacctgtattgaacaagaataagggaagaaagctgggaacctggatctcccatatattggaagttttgtaaaaaccttgagggtcccttccactacatatggggattatgggaactgcaattcaagatgagatttgagtgaggacacagccaaaccacatggttttagaacattgacgaagagagaagacaacccactttgccatatatgcccatggtcttaccaaggctagagtacagtggcacagtcatagctcactgcagccttaaactcccagactcaggcaatggatccgatcctcccacctcagccagcctcccaagtagctgagactacaggaagatctggcaagagttagcatgcaggtctacattgtgacaatccatgagagctaaggactggctgtctcttgggacaaataggctttcttgagtctggatgtccgctctgcttgtcttaccgcatgagagagtgcagatgttcctgaaagcatctttgcgtggatttgcttgaagcgagatgtgagagaaggggcaaagctcgaagggagctgctagagagagaggaaagcagctggacagggctttcctgatgactgaaatcttattgtggataatggagatcaggtcctgtggtggtggatctaatggaaggatcctaggtctctgaatcacaacgtggaagaaaatcagtcaccacccctagctggaacaccaacatttcaaataagtgaaaaataaactcttattatgtcaagccactgcaattttggggtttgtcttagtgttagtgtcacctacatttatgcaatagctgagtaacattttagaagaagaggatgtttgtagccattttggactacaagaaatgtcaaagatactttttattttcctaatttttaatttctaggtttattcttaaaagagtaagatctttttttgaaaaatcagtactattattttgacttttggatatacaaacaggtctctccttaaccactcaaaagagccaagtgagaggaatttgtggataaagacatttaaaggtagtatgaaatctttaatcacgccaaatcaacactcatcaccacgacattctgtcagtgcctccagggattaaggacatatgaatgtctttccctgaaatgtgattgtgacattggacttagctatttgggttttcatgaaacccattgtcaggttaaataatgatagagtagtagatgttctgcacaattgcttttgttataaaacttgaaaaaaagtatattaattttttatgccttgcctttcagtgcattattacttatctttgtgcagagtagattaagtaggtccattgaataagaaagcattaatttggtagattctctgtgttaagatgctcagtattttttatggaataaaggtgtggaaggtttctactcctggtcaaggagtagaaacaggtagaaaatatttatatttcagccctgcttctcctttgtcatatccttcaccacaaggatctactttcacttctgccttggttttaaacagcagccagtatatgaaggtctagctaactacactatctccctaggagagttggtacaatgttgtttccaaaaattagacaaagcatgtttaatggctccctttcactaagtaaataaataaaagcaagaaagggaggaagcaagctggctaaagaagaaatgaactagacatctgtatgtttcattttgttagtgatcaagctcgtctttcatgattattactttgatacatacaagatatatcacaactattttcctaagcaatatgaagatacaaagttattataaaaactaatggatctaaaaatacatattgaaaggtatatttatcttttgcacacctcgatgaatttttcacaaactgaacagatctctgaaactgacaaccatataaaacaaacagacaaaacaaacaagcaaacaaacataaccaacaccctagaaaccctcctaggctcctttctagtcaaaggattagtcattattttgatttctaacagtatagctcaattttataaattaattaagcaaattactctttgtgtaatttacatgaatacattaggtattcttttgtgcctgacattttttgttgaatattttgtttgcaagatttatcctattgttgcatatgcttgtagactgttcattctcacagatgtattataaaatctattgagcaaatatggcacagtttatttatacactctactgttggtagacatcttgatagtttccagttttgtttggagctattacaaaagtgctgctataaacattccagttaagtcttttggtaaactcaaatatgtatttttgttgaatatatatgtatatatacctaaagaaagattcgttgatactgccagttttccaacatggttgtatcaatccacatcactaccagttgtgcataaagatttgagttgccttgtatctttgccaacacttgaaattttttgtctttattgttttagccagactagaggttgtttagtggtatttcactgtggtttaatttgcatttccttgatggctaatgaacttgagaatatggaaatatgtttattggccatttgaatgtctttctttatgaagtacctgttcaagtattttacctattcctctattgagttgcctgcatttttcctattgatttgcaggagttctttatatgtgctagataagagtgtttttggtactctacatgtaacattatatgtatgtgtatatatatatatatatatatatatatatatatataaaatttcccactttgtagtttgccctttcattcttttaatgtcttttgatgaacggatgtttttagtttatttaggcaaagctataaggtaagaacaatgttagattaagctttaaaaggtgattcagttccatgaacagaaagattgggattcccagcactattgagctgtttgaatcaaactcctagaagccttaatatattttttcaactttccctttgtaattgtagtgttggaaaaacaatagttaccctcagagtgttgtagaaattaccatctgttgattgaaacaatgagaaaatattaccaaaatggttagaacaataagagtactatataatatccatgaaaaattgacactagccacaggttccttcaggaaaccatcagtgttctgaaaataataaatcagaaaatcaatgttcagttttcaacagcacggtgaggatggcagtgaaaggtattattttaagaattttctcaggccctgagttgtaagagtctgtaatcagtgatatttttatttaaagaaaatcagagcatgaaagagcattattttaatatctaatatttaatgctagaattaaaaatctagtgtaagatttatgttggaaaaagcaaacaagcaaacaaagtaaattacagctctctgtgtaataacgtgaatgaatggagattcctcggcaaattgaatttactatgtgaaatcttgtaaatgaggcatattttaaaaaatcttggctctaaagtgatttggtgaaatgattattttcctcattaagacaaaataaatttctgtcatattattaaacatttcacaacctcaaagtgctgttttatggtagaccagctagaagtaaagattaaagtggactgtatttgtggtctggtcagagtttaagcagaggacacagtttctggaagcttttccttcagcctggatgtcaagggtccttttgctgcttagcacctccagcagcctccacccaggttcatcatctagctgtgttgtctccactgtttcctggagaaaggtccaattacccaaaatacagttgtgccctttttatgttttcatcatagttaattatagaaaaacttggttatatgcgaagtcctactaaaacaaaagtatcataggaaatatttctaagaatcatgcaaaatcatgattttgtattaagaaattctaaattaagaaccatgtaaaaatgagagtttgaaatgttactctgtcagacactgaagaatttaagaaccgttaattgtttgtatactagctcctcgaaggtaggtctgtttttattcatctttacggccttcgttgtccctgacatattgctgcacgtagagtatatgcacagtgtatacttgtggactaagtgaatgccaactttagcttttgaaaatgtaatatatgagtttaacagatgttgtctcttcactttctaagtacttggaactttgaaaatggctctttcaatagtaaagtttttttctctagatatgttcttaaataaaaagtgatgtaaagaaaggaaaacaaacttaaaccattaaaatgttttaaattactaaatctgcctccaggaatgtgtaaagagataatgactacctaacataattttttatgggttaaattttctctaaatgtgatctattctattttgaactacaaatattttaaaagtataaattgtaagcaactggaaaattggttttaggcacgtgatatgcaatttcacaaatgttcaggatcctggtgttatttctatgactatgagatttcataaacaaattatatagcc

SEQ ID NO: 254 - DNA, 3140 bp, Homo sapiens
agcctccgggatctgcaagtctggaaaggccacgttgtggaccttggcgcagaggttatgggggcgacccggagcggatggtttcaggaaaactagaacccaccctcatggcctgaacaactggagagaagaggatcgcagcaatttaaagccagcggcaaggatcacagtcctggggtcaggtgaccaaagccagtttttcagcccttaacaagaacctggcttcacccagccaaacatgagttaacgtatccattttacacacgaacaaactgaggcgcagagatgatcacagcttgttggtggcaaactccgctagggccttctctgctaccctaaggaggtccgaccgtatgttttggaccccttaactcgggataccgataaacgaaaattaatagggtgttggatgttttaaatgtgtgcgggaatgtcattatattggctagaatcaaaccttatttagacttgttttgcacttttgtacactttagtaatttttagttttaatcataagggagttaaaggcgaacacaactggtatttttttttttttttttttttttttgagacagggtctcgctcggtcacccaggctggagtgtaatgctgcgatctcggctcactgcaacgtccgcctcccgggttcaagagattctcctgcctcagcctcccgaatagctgggcgtgccaccacgcccggctgatttttgtatttttagtagagacggggtttcaccatgttggccaggttggtctcgaactcctgacctcaaatgatccgcccgccttggcctcccagaatgctgggattacaggcgtgagccaccgcgccaggccgacaactggtatcttaaggcttagggcctctggtagaagtgagctccacctcccttcctgtgtagaaggtaaatgcattcattcattcagtgaatcgagcatgcatgaaatcgtttgcgcacacccagaagcccacctgcgagccacaggagcagccattccaggaagccaagctataatgggagacgcaaggaatggaggcggaactcctgtttttaagtcctagctccaacactagccttgtcagcctgtaattctgaattactgggcgcctctgaggcttcttgtctcatctgcaaatcaggaacaacggcatagagtggtgaatgcatcaagtgggatgatgtctgcaagtacgcaacccgcttacacaaagaattatctttccataaccttccctggacccctagggccagcagggaatcatagcctccctttgtttctagagcccggaaatcactgggttttccctctgtctggagcagagctgggtgcgaatttgaccaacgggtggcaggaacagccggagcaggatattaaggagcgggcgagcttgccaagcatgcgcagtagcggcgggttggtttgagaagccgccagggagccagcgcggcgacctagctggctggggcaggggaggggcccgccttatatgggagctgcgtggggacaaactgttcgggcccaacgcgcgggtctgagagacagccacgcctgctccgggtcactccggccacctggggggcgtcggcgcgcagactctggccagttcagtattcaaactcttcaggagtgctaacttactcatgacagcgattttctgtatcggggtttcattggtcggtggtttagaaggttttgctcattcattcgttaatgtaattccaacaacctacacgtgtttataagccccctttccatccacgactttgctgtctgacacaaaacggaccatcgcagcccggcagacgctttagacaacaaacagcatgcctggagcttttcaataggaagcagtaaggcttgatcatcacagacgatacggaacgggcactttcttagcagaaaatatttctattggggcgtgaaggaagtttctgaaagggaagattattataagataaggggtttgctcatctcagactttagtgtgcctgctttaaagtgttttgcaaacttgaatgtttaaaggaatcacctggcggtcttgtgaaactgcagcttctaatgggcaagtcagaggggaagcctgagacatggcatttccagcacgttcggggagtgaagatgctgtcggctgccaccctccctgcaaggagccaggggatagatgacctctacgcaaactgtgagagcttaaaataactgatagtgaaaaacagttacagaagctctaggccgggcacggtggctaatgcctgtaatcccagcactttgggaggccgaggaggatggattgccagaactcaggagtttgagaccagcctgggcaacacggtaaaaccctgtctctacgacaaaataaaacaaacaaaaataaaagccacgcatggtggcgtgtgcttgtagtcccagctactcaggaggctcaggtgggacaatcgcttgagcatggaaggaggaggttgcagtgagccaagatcgcaccactgtactccaacctgagtgacagagtgagacccaatctcaaaaaaaaaaaaaagcagtaaatccagggcccaaaaggtcagtaagaattcagggatccaaatcagttatgtactgatgcataaaaataatggccaaaaatgtggaggcttaaaacaaaaaccggttattatttctctcaattctttgggttgctggtgtcacccgggctttgtggctgggctctaggctcacctggggtgaggaaaagttggtgcattttgctttttcatcctcaaaaagtttagaccaggttccagatttcttgcggcggcgagacacctcgccaggagagcaccgcactatgcacaagcctttgctggacttccattgaccaaaggcagtcacatggtcacgcccaggcaatgtgggagggccccgcaaaggaggggtgggtactcaagagagccactaaataacaaacctaccttaagatcacatttatttctaacattttaatagttatagttcagtataattgattttcctggtaatcccatttattttattttatgcattttaaaatgttattctgaaaatgttactctcaccaaacaaccaaaagggtccacggcataaaaaaggtttaagaatctatgattttaaaattcaat

SEQ ID NO: 255 - DNA, 2077 bp, Homo sapiens
ttacaaatattgattgatgttctcatgactccctaaaatgtataaaaccaagctgtgcctcgaccaccttgtgcacatgtcatcaggatctcctgaggctgtgtcacaggcgcatcctcaactttggcaaaataaactttctaaattaactgacatctgtctcagattttctgggtccacacactggacaaaacagaagtgaacaaaatagccgaagttcccaattgtgttcctatggtgggagtagggcagcaatggagacggaaagcaaacaagtaaatgaagaaagaaaatatcactgagatgtgctaaggggagaattgaaagagggtgatgaggttgagtataaggagctacttcagataggtggtgtagcaaccctggttccaggaagaaaaacagaggcaagtcaagtattccaggaatattgggtggtgtgaatgtgggaggagttggagagtgaaggcctgaaaagcttcagctctagaatcagagaaactctctgcactttcacctggaaaagctggaactcaaagcgaagttcaagaagtagcacaatactagctctttgagttggattgtgaagtgtgtccgtgagagtggccttgtcttacactcacgacctcccaataatagtgacttctgccttccatatcttgcttgaactcctgtccttggcaaaccctaatctagaagcatacagaaaaggggactctgggaaacatagttctcatcctcagatgggccttgtggcttggtgctgagctgatagctgacaatttaacactgatgatcagaatgacatttaagctgaggtctaaataacaagaaggggtcagctttccaaagatcacagggaggaacattccagacagagagagtaaccagcacaaagtccctgaagctagaaagagcatcttgagttctccagaaacatcaagaaggccagtatgcgtggagctgagtgcatgagaggaagactgatgggagatgctgttggagaggtaagcagaggctgagtcatacggggtcctataagatctagtaggtccattagggatttatgtgcctgactggcttgtgtctgtgtctgagccccgtggataaggtgtttgtggacagaaagctcactgagctgtttagaaagaggggcttggtgagatttagggacccagacttttctgcctcaggcagtagacagtgctatgaagcagagaggggcactcaccttatactccccagaacacaacagagttttgcagcatggagaggttaggggacacagtgctgccctggagcctggaggaaaggacatttgggagcatccagagacatttaccctgggaaggatgtccactcttgtccagtggtgaagagccacagtgtaagaatagaggtgctctagtaggtttgagttgtcaactgacagatgaattcaggaacagatgtgagaccctcatcctgcagccagaaataacaggatgaacaatagaacagacttggagaggggacatgaaggtgaaatatgagtcagtaaatgttaaggtgatcctatttcccttgaagcctgggtgaaaaccatgtggaacctcagattgcattggctaggcccttgcttgaatgcattcagaaagttaagggatattcattttctttggggaatccatacagttagtgatttcattcccaatgtacatacatgctttactgaaatgactaggttgcttggaattttttatcaggcatactttcaaacccaaaagctataattttaggcatttcaggtctcccaacaaaagtactggccaaggttgatcaaatacaggttggtctatgccctgtggtgacatttgtgggataacaagatgattctaatgtcccttgaacatgtctccttcgcattgtctgaatgccatgatggagagttggttggcctgttagtgtgactgaaccaagtgcccgcagtgatagctgctctggatgctccctaagttaatttctttacattttgatctcacttccacagttccctgcaggtgcttcttgagatcacctcccaaataaattacttgcacag

SEQ ID NO: 256 - DNA, 1075 bp, Homo sapiens
agaagacctgaaaggagagtcaccaaaagaagaaaaacaatgtccccaagagtccacctccaagagaacaagcaacttcctagcagatgctgaggcttgcaagactaatctgggcttggaagtgttaaaagaaaagattttaatttaaaaagcaaagaaagggccgggctcagtggctcatgcctgtaatcccaccacattggaagccaaggcaggcagactgcttaaagccaggagtttgagaccagcttgaccaacatggcgaaaccccgtctctactaaaaattggctgggcatggtggcctgtccatgtggtcccagctacttgggaggctgagatgggagaatcacttgaactggggacccagaggttgcagtgacttgagatcgcaccactgcacttcagcctaggcaacagagcaagactgtctcaaaataaaataaaataaaaagcaaagaaagtccttgaacccattggaaacatctttcaaggagcatgaaaccaacccttttatcacgtaacaagtattaatggaaagacatgagacgttgcaaagtattactagatgctggagtctagagattatctatttgacatttaggcagagagcaaggaaaaaacacaaagtactaaggaagcagggagcctctctaaatgctgataagacgatgaactgcgttagtcggggaacactttgggagactgaggtgggtggatcatttgaggccaggagttcaagaccagcctggttaacatggggaaacccatctctactaaaaatatctctcaaggcagcctcttggtgagcgaaagttctgaggcaacccggtggagggttagagttccccgatgggcaggctttggtttgcaaatcaactggtaaccctcaagaagagatccgtctaggagaacatataattagatgaacttgccttgtaggcatctgctgaactgcgaggtaaaaggttatatttgcatgtctaaaggaatgagtaggaagtgggaaactggggaaccggggagtgagaaaagaagagagaaaaaaataattaaaccatctcttagaaaaacggg

SEQ ID NO: 257 - DNA, 1913 bp, Homo sapiens
catgtctcctgacacccagttgcctctaccactcagatgatgtcaggcccagtccctcagtgccctgcgcaaggaacaggactcatcttctgagaaggatggacgcagccccaacaaatgggacaaggaccacatccagtggcccatgagtggcggtcatgatcttcagcaagcggcaccaggccctggcagggcacaccagggtcaccccaaccaggataaccggactgtcagccagatgctgaacgagtggtggtacaccctggggcccaatgagacacagaaataccacgacctggccttccaggtgaaggtggcccacttgcaacaaggaccgaaagaagtccagctcagaggccaagctcacaagccaggggctagcaggagtgtaacaagggctcgtgggagtggagcatatcagagacgggcactgccactgcccctggggtgtcctctgaattcctgtcagttgcagcccaaacactccagagctcggataccaaggagcagcttctgtggggcagaacggctgcacacagtcagggaacctagctcagcctggcccaagccttctcccacaggggggtacacagcctggatggcagggaaatagatcatcaggcactacaggaactgacacaggtggtgtctggcaatgcatcatactctggcccaaagccttctactcagtatggagctccaggccactttgcagcccctggtgagggaggtgaccagtgggcagccctgctgctgcccacctgagctgctcattcccagcacatggccagtgaggacatagcgagtgatgaggcgcacacgatcatccatgaggaggagggggtgatgatgtcattgctgatgatggctttagcaccactgacaccgatctcaagttcaaggagtgagtgaccgacagagtggggacaactctggggaggagccacagggcaacaagggctttggtgggaaggtatttgcacctgtcattccttcctcctttactcctgctgccccttgctggatcctgagcccccagggtcccccgatccacctgcagcttttggcaaagtctatggtcccaccctgtcctcctcctacacatactcggatgcttcctcctcaaccttggcacccacctccttcttactgggcccgggagccttcgaagcccaggagtctggtcaaggcagcagagtgggccccctacggcccctacccctggggatgggggcccagggatgccttccaaggcgacctgtttcctcccaatggatcccgccaccttctggtgcaagagacctgaaagtgtgggcgacctggagctaccaggctcctcagtcatcagggtccctccgcagatcctgaagagaaactgactggtctttcggggtcggggcagagggaaccccacggacatggatcccacactggaagaccccaccacgcccaaacgcaagatgagaagatgctccagctgcagcccaaagcccaacacccccaagtgtgccatgtgtgatggggacagcttcccctttgcctgtacaggtggagaagccgaggacaggctcagggaaccggagaccgagaaggcactgtcctcttcactgcacgcgccctggaccagtgccggccctgatcatgcagctcttccaggcccactgcttcttcctgtccactaggccacagccaccctccaggcccactatgcacacatcttccactccaaggtttgttctgcccctgccctgactcccagccctgtgggggtcctgaccggacctcacctggctcaggcaaccctggctgccctgccactgcctctgccccagagttggggccttgacagcctggttggaaggggacaccccagccctgcctcaacacctgggggtctccataactaccacagg

SEQ ID NO: 258 - DNA, 3556 bp, Homo sapiens
gtctttcgctccaggtagagcttggggttagtacatcactggcctgcgtgctccgctccaggaggtctcggtgattctgccacagcctcatcctccgtcgccctgtgacctactggtattggaacattcatagctaagactccaggacacccacaaagccgagaaatgctgagtttgcgggtcagggcgtccggagactggggaggcctcatcggagtcggccggaaatggcggtggcgggaccgagtctgtgagcctgagcccccctcagctcagccctcagtctcctctggtgcagggtacccaggcgtcctgtaccgtttcagcacagcggctttggccccagcctgtagccctctttgcgcagctctgcgcccgcatcttccccagcttgtgaggtgatgaggagaggttcaccagggaaagacgccgacttggtgtgcagggcttctgcgtggaaggagctctggtctgtggggtcaccagtccctactttaacctattcagacataaacggaggcaccattaaaacattaaagaatttatatgagcaaacagtgatgaaccagtgggacagccccagacatggtttgtcgtttgggggctaccagcgggtcttgaagaaaaggctttaagtctgcacatgtctccaaggagtctgaggacaagtgcaaagtcaacaacaagcaatgatggtggtggtgatcctagtcaataaaaagggggaagatgtgggtggcaagccacccaggtgccaaagcaagagactgagggcacaagctattccagtataataaagaaaatatatagtataagaatagttctactagaaatagattatggatatgattatatatgaatgtcattaatcattagtttgtagcattattctttattctaatattataataatctttgttctacaattataacctaggaaaaaccaggccctacagagataggaggtgaagggacatggtgagaagtgaccagaagtcaagaatgttagccctctgttacgcccagacagggccactagtgggctccctggtctagcagtaatgccagcacccattacctagcagaccttggtctagcagtagcatcagtgcctagggaaggcacccattacttagcagaccaggaaagggagtctccctttccccgggggagttagagaagactctgctccaccacctcttgtggaaggcctgacatcagtcaggcccgcctgcagccatctggaggcctaaccgtctccctgtgatgctgtgcttcaatagtcacgctcctggtccactttcatgttccactctgtatacctggctctgccttctagatagcagtagcagaattagtgaaagtactaaaagtctttgaaatgcataaaagaaatagtggtgtaatctgtcctctctctctctccacctcggctgccaaacagggaagggccccctgtccagtggacacgtgactcgtgtgaccttacctatcattggagatggctcacactccttaccctgcccccttgtcttgtatccaacaaataacagcatggccaggcattcagggccactaccagtctccacaccttggtggtagtggtcctccgggcccagctgtcttttcttctatctctgtcttgtgtctttatttctatgatctctcatctccgcacatgaggagaaaaaacccacagaccctgtagggctgggccctacataactgtgtagaggtattagactcagtttattctagtgggcccaacctccgagaccatcttgagtatcaggagactgtgagctatacttggatgggagcagctttgccaacctctgcaaagtgactctgaaaaagatggcaagccctgctccagtcacacctggaagctgactggttcccgcatcaccaaagcatgaggaaattaatcacaggactcatttccctgaaaatttggacttgtacagtaaggacttcaactgaccttcctcagactgaggactgttcccaatatatacatcaagtcactgaggtaggacaaaagtttgctacagtcctattattttatggttattttaagtgtaccaggactctaaaaggaacttgtttgtataatgctattctatacaaggtatgtagcccacgaaatgaccagcctgatgtgtgctataacccatcttttttcctactgcccataaaaacaggcgaacttctaggtttcctggtctatgcttcccgagaaaagagaagcatagctataggcgactgaaaagatgacaagtggccccctgaaagaatcatacagtactatgggcctgccacttaggcacaagacagctcatggggataccgaatccccatttatatgctcaactgaatcatacgattacaagctgtcttagaaataatcactaataaaactggcagagcttcaactgttttagcccagcaagaaacccagatgagaaatgctatctataaatatagactagccctagactacttgctaacagctaaaggaggggtctgtgggaaatttaaccttactaattgctgtctacacatagatgaccaagggcaagtagttgaagacatagttagagacatgacaaaactggcacatgtgcctgcgcaagtgtggcatggatttaatcctggggccatgtttgaaaaatggttcccagcactaggaggatttaaaactcttatagtaggagttataatagtaataaaaacatgcttactgctcccttgtttgctatgtacttcttcaaatgataaaaagcttcatcgctaccttagttcaccaaaatgcttcagcacaagtgtactatatgaatcactatcgatctgtcttacaggaagacatgagtagtgaggataaaggtgagaacttccactaatgagagaggttctcaaacggggggaaaaagggaggagaccacccctcatattgtcttatgcctagtttctgcctccaaagaaagaagaagtgaaaactgaaaggcagaaatggaatccacaggcagatagcccagcatcatgccctgggcctgctagttaaaaatccacccctgacctaactgcttgtgttatctatagatttcagacattgtatggaaaagcatcatgaaaatccctatcctgttctgttctgttctgactagtggtacatgcagcccccagtcacataccctctgcttgctcaatcaatcatgaccttttcaggcggaccccgttatagttgtaagcccttgaaagggacaggaattgctcactcagggagctcagtttttggagatgtgagtcttccaatgctgccagctgaataaagccctttccttctgcaactcggtgtctgaggggttcttgtctgtgtctcatcctgctacaacagaggtgggcagatcacgaggtcaggagttccagaccagcctgaccaacatggtgaaaccccgtctctagtaaaaatacaaaaattagccaggcgtggtggtgcaagcctttaatcccagctactcagggggctgaggcaggagaatcacttgaacccggg

SEQ ID NO: 259 - DNA, 1864 bp, Homo sapiens
atttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagtccagatgtataatctcatccctgaacatttctgatggtgtgattatgacatgtgactttatctggcaacagagtgagttgttgctcccgcctgagcccagcccccagaaaggattgtgacatatcgttggacccagaattgaggtggaattgtgacatataacttggccaagcacacagatgtaatggtgtggtgactctcatacctagaactgggacctgtgcaggattgttaattcattactggacattcctgtgggtgtgattgttacatatgcctatgttcagcacccgagtgatttgattttgctgcctggtctcagtccaaatgtaagattgtgatttatcgctgaatccagcacctcggtgatttgactctccctttttttgtgggagggatcctgcaaattttgggtattgtcaattattgctgaatcctgtacccatgttatgactctcccaaatgtgccttacctgttgtggcacaatatatcacattagacattgttaaatattgttgggttcaacacctgggtgatggatgtaactttttttctgggcctgcctacaggggaccttgtgacataactcaatgcccatcatcatggtaatgttactctcttctcctgcctgatctctgctcacagagaaattgtgacacatcactggcctagcatctaggtgatgtgactctcctctttttttcaggctctgcatatttgggtattgtgacatattgctgaactcaacacctaagggatgggagtctcctacctaggcccttcctacaggggacattgtgacatgtctctgcattcctcatccaggagatgtgactctccttttctgcctacaccctgcctacacagaaagttgtggcatattgctgtggtcagcaaccagatgatatatttctcctgcctgggtctttattacaggaaagatgattgacatattactgggcccagcatccagatgatgtgactctcttcttctgttggtccttgcttacagggaaactgtagcatattgctacacccaacacctagcttatgtgattcttcttttaggtttgccttcagggaacattgtgacatattgctgggccctgcactgataatttgtgactcttctgcctgtgatttgcccacttggggcattgtgacatattgctgggtttaacactcaggtgatgtaacttttatgcctaggccttgcttacaggaggcattttgaaatgtctttgtggctgggcatggtggctcatgtctgtaatcccagcgcttggggaggccaaggtgggcagatcacaaagtcaggagttcgagaccagcctggtcaacatggtgaaaacctgtctctactaaaacaaaacaaaacaaaacaaaacaaaacaaaacaaaacaaaacaaaacaaataaaaccacaaaaatcagccaggtgtggtgattggtgcctgtagttgcagctactcaggaggctgaggcaggataatcgcttaagtccaggaggtggaggttgcagtgagctgagattgcaccactgcactccatcctgggcaacagagtgagactccatctccaaaaaaaat

SEQ ID NO: 260 - DNA, 10240 bp, Homo sapiens
gcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcgacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggcttcaccaggtactgccttctaacgagctggccatttccacatgtcagataggaccaacttgccttttaactacccgtgtgatacttaaacactgttgccggtatcacagcttttcttcaaaacaggatcttgctctgtcacccaggctggagtacagtagcaccatcactgctcactgtagcctcgacctgctgggctcaagtgatcctcccatctcagcctcctgagtaggggactacacacaggcaccaccatgatccggtatcaccagtctgtgggtacaaaaggagagtaacatgaacgattcaaattccactggctcttgttcccatggattcacagaagttcagccccatttcaaaacttcacatttgcttctgggaagcccattctggaaagtttctctgtggccctctccagaaggcagcgcgacttccacccagcaacacaagtctctgcagcacctgccccagcagcgccagctgagccccggaagctgggaaggcttaagctgactcttctgctgcacatagcaaaaaatggtcatttctgtagttgcagctccagatctacaataatcaatctatatccatattttatggggtttttttgagacaaagtcttgctctgttactcaggctggagtgcagtggcattatcatcattcacttgtagccttgacctccctggctcaggtgatcctgtcacctcagccttccaagtagctgagaccacaggcatgcaccactaagcctggctaatttttcaatttttatttttcgtagagacagggtctccctgggttgcccaaactggtcttgaattcctgggctcaagcaatcctcctgtcccggcaccccgaagtgttgggactacaggcatgagccactgtgcacagccctttttgtttttgtttttgtttttttttaaaggtaatttcccagtggaatcctcgagatttcttcacgtttttggaaaaatgagttacattttagattgttttcctttttggaatttaatggtatacattatattacatagctatgttgagctctatttctattacactaaaaagtaggctaattgtcttaactttcatcagtaatgacattaaatgtgtgaagattatacttggaataaagcacttggattcattcatttcttcagtaaatatttattgagcactagtatgttccaacgagtgtctgtctacattctggggacaagtgataactaaatccctgtcctcgtggagagttaacaatcaacaaactaacaaacatttaatttatgtcatcaactcatttccacaaatataacaacatcttgacttcaagtttcctgagtttctggtctaaagaattgctaccttcaagagctcaaatcatttgttggggagagaggcctgtgatatattttctcctttacaatgaaagtagctgtaaaaagaggaagagaaattctgagggtaaagataaaaaatgttgaaatcttctttctggatttcagattgagtctcttgccctaattgatgcaatttacactccatgcatctccttccctggaccttctccagttcttggggactacagatgaacttacttttaatgcattttatggcatttggaggccctccagtggacaaatactatacctgaaaaaaatccttttgctgtgctaaagtgttcaggtgtgaagtgtactcatgtttgcaaatcactttgaaatatataaacaaaaatgaattaatggatgaatagagtgatgcatagatcattagacatgtgataaaaataactgttaattgtagaatctagatgatgagtatattatatgatatggcccactgtataattctttcaacttttctgtttgaatgtttgataataaaatattgaataaaaatctttttgctaaagatttatgccttgtagttcacattattgaaaattttgctgagataacgtaaattacctttcaaaaatcatcttaaaaattgtcttaataaacatggattaatttttatttttatttttgagacaaggtcttactctgtcacccaggctggaatgcagtggcatgatcatggctcactgcagccttgagcttccaagctcaagagatcctcccatctcagccttctgagtagctgggactagagactaattaaaaaattaacccagctaattaaaaaacattttttttttttgagatggagtctcgttctgttgcccaggctggagtggagtgcagtggtgtgatcttggctcactgcaacctctacctcctgcctcagcctcctagtagctgggattacagatgtgcgccaccacgcctggctaacttttttattttctgtaaagatggggttttgccatgttggccaggctgcccttgaactcctgacctcaagtgattcacctgcatcagcctcccagagtgttgggaatccaggcataagccactgcaccaagccttaaaaatgttttcgtagagacagggtctcactatcttgccaatgctggtcttgaactcctgggctcaagcaatcctcttgccccagactcccaaagtgctgggattacaggcacaagcccctacaccctgcctggattaatttttaaatgtctgaaaaacacttatttttagaaagtttagacaatgtaaatgtgaaatagctctatgaattctttgtttgaaaaaaggcttatcttcctggaatatgtgttttatgaactcaggaaattgttaacaagttaactgaatttactttgctttttaaattagagaggcgattgtttgagaattattgacaataatttttcttagaggagatgcattggtctgggttcaacgcagaggtaaaatctacccttagctggtttaagccaaaagggacttattacatggtatatcataaaatttgtcagattaaagaaacagcgtataagcactttgggaggccgaggtgggcagatcacaaggtcaggagtttgagaccagcctggccaatatggtgaaaccctgtctctactaaaaatacaaaaattagctgggtgtggtggccctcgcctgtagtcccagctacccaggaggctgaggcaggagaattgcttgaacccgggaggcggaggttgcagtgagccaagatcgtgccactatactcctgcctgggcggcagagagagactccatctcaaaaaaaaaaaaaaagaaaaaagaaacagtgtacaggctgagcttcaggagtgactcacaaatccactttatagacctgggctatcaaaacatgctgttgatgccaggatccggaagccagcccctacagccgctagttccagagccacattacctttcctataaaacactccatcaggaaggatgcctcataatctgtctctctgccactcaattatgaattcttcactatatgcaagtgcttctagaagtggttggttggtttgttttcagacagggtctcattctgttgctcaggctggactgcattgcacaatcatgacgccctgcggtcttgacctcctgggctcaagtgattattttgcctcagcctcctgactagctgggactacaggtgcacgccaccatgtcccactaatttttttttctttttcagagatggagtctcgctatgttgcccaggctggtcttgaacttctgggttcaagtgatcctcccacctcagctgcccaaagtgttggaatttaaaattcatgtaacagtctgaaaagggtaccttcttcactctgactgacggccacctcctttcagacaatttctttgcaagttatgtgcatctgggtccacctgtaagcagaaaatcaggttaggccctcaaggagcttgcaagcaaatgtggaagacatattttataaacagctaattttaaatgatgtggaaaaactgcacagaatacaagagctaaggaagcctgatggagaaagcagctgattctgccagaggtcaagggagtggtacatggagaagtaggaaggctttataaacaaagtaaacttggtggactttgaaaggtatgtcactctacttttgcttttggagaaagtggtcagggtggggccaaaggagcaaagcacagagttggaaaattccaaggtatatttgggggctaaatttctggttgaaggttagggtggaggagcggtgggagtgacagataaggtagaaagcttggagctacataatagatgtcaaatgctaaggcctttatgctctcatggttaatttcctgggaagaattacttaaacagagctgttacttcaatatataatatcacctaactccagtcccgcctcctctcccacatccttcatctagtatagagggaacaaatcttccctgcattgtaacctaggacaagttacttaacttctctctttaacttgatgtccaaatctataaatggagattgaagatagtgcctatatggttagttaaatgatttacttaaaacagtatgtggacacagtgagcaccatatggacgcttgctacataagtaagttgtaggcagtggatacagcattgcctattagaaattctcaaataattgttttgagacatttaaataaaaaggaggctgggcacggtggctcacacctctaatcccagcactttgggataccgaggtgggtggattatttgaggtcaggagtttgagaccagcctggccaagatggtgaaatcctgtctctacaaaaaaaaaaaacaaaaaaatgagccaggcatggtggcacgtgcctgtaatcccagctactcgggaggctgaggcaggagaatcacttgaacccaggaagtggaagttgcagtgagccgagactgggccactgcatgccagcctgggtgacagagtgagaccctgtctcaaaaaaaaaaaaaaaagaaggatttttagacttgtgctaactcccaatcatgggcttaagactttcacaataaaaatcattatgtgtatatatcattctagccttaaaaaacataattgctaaaaggactattagaatgcctttctattttacagtctgggtaaatgctttcccagacttaagagcttcttagagagttttatcaaacatgcaggcacatttctgattatttaaggcttaagactttggaaattctttggcatttagctacagccttttgacatttttgctgttcattaccagtaccgtgctgtggaaaggaaaagagaagggacacacaaggtgattttatacacctacaaacagtggaaaagtgatagtggataggaaaaaagtagaatctacatgaaatatttgtagatttaacttatgttctgttctccattattgtaattgtttgtgtcatacattgctgcataataaactaccgtaggccaggtgcagtggctcgtgcctgtaatcctagcacgatgagggggtgaaatgggaacattgcttgaggccaggagttcaagaccgacctgggcaacatagcaaggccccatctctacatctgaaaaaataataaattagaaacctactataaaacataactttaaaagaacacttaatgatttctcaccattctgcatgagggcgctgctgtatgactttcttccatgtgatgtgggttgggacttgttgggaatctccccacgtggtctctcatccgtccatggcttagcctgagcttctttacatgccagcaggaccccaagagactgaagcagaaggtctcttaaggtctcagaaccagcccagaaacacatctgctcattttattggttaaagcaaggcacaaggccagctcaaatactagggctgggaaaacaaacactaccttgatgggaggagctgcaaaatattgtggctatgacttccaacacacctcagtagctgatcaagttgactgtaaaattaaattggacaaaattggtaaaaattccagattctgacttctgccagacatttattccattttgcatttatcccatttgcatttattccatttgcagatctgcagattaggaagtagacagaaacagtaagaaaaaacacgtggatagtcttaatcacttttcaagttttttttttttggagatacaggttcttgctaggatgcccagtttgtagtgcagtggctattgacagatgatataccacactgtggcctcaaatttctgggcgcaaataatcctcccacttcagcctcctgagtagctgggacgataggcacatgccactgcgcccagcttcaagaagtttgttttttttttttttttgagacatagtcttgctctcttgcccaggctgaagtgcaatgccgcgatctcgtctcactgcaacctccgcatcccgggttcaagcgattcttttgcctcagcctcccaagtagctgggattacaggggactgccaccacacccagctaatatttgtatttttagtagagatggaatttcaccatgttagccaggctggtctttaactcctgacttcaggtgatccacccgcctcggcctgccaaaatgctgggattacaggtgtgagccaccatgcctggcgaactcataggctttaaaacatatgtcttggggactgggcgtgatgttgtttttaaccactctgcttatgaactgactccaggagcagggataagagtgtaaacaacctacattaagctttactccatgggtatctttatgtaagtgttttaaatagatcaagaggtattaagtttgaaaataaagatttattaataggagtctattaatagacttctactgggaatataaatcaaaaccaggtacggactagctaccttaacatgtactatggtcttggatttaagtcatctattcagtagacatttatttatttatttgtttgtttgtttgccaggctggagtgcagtggtgcaatctcggctcactgcaacctccaactcctgggttcaagtgattcttgtgcctcagcctcccaagtagctgggattacagccacgtgccatcacacccagctaatttttggattgttagtagacgcagggtttcaccatgttggccaggatgatcttgatctcctgacctcgtgatccgcccgcctcggcctcccaaagtgttgggattacaggcgtgagccaccacgagtggccaatactttttcttttacggatggagtctcactttgggaagtcggggcaggaggatcacctgcatccaagaaaccagcctgggtgatatggcaagaccccatctctataaaaaaatcaaaaattagtcatgcatggtggcatgcacctgtagtcccagctactcggagtctgaggtaggaggatcgcttgagcctgggaggtcaagggggcagtgagctgtgattgcaccactgtactctagcctgggtgaaagagaaagactgtgtctcacaaaaaaaaaaaaaaaaaaaaaaaaaaagaggcagggcgcagtggctcacgcctgtaatcctagcactttgggaggttgaagcggatggttcacgaggtcaggagttcaagaccagcctggccaagacggtgaaaccccatctctactaaaaatacaaaaaaaattagccaggcatgatggcagacacctgtaatcccagcgactcaggaggctgaggcagggaattgcttgaatgcgggaggtggaggttgcagtgagctgagatggcgccactgcactccagcctgggtgacggagcgagactccatcttaaaaaaaaaaaaagggatggagtttcattttgcccaggctggagtgctggggtgtgatcatagctcactgcaacctttaactcctgtcctcaagtgatcctcccgaagtgttggggttacaggtatgagccaccacacctggactcaggaccatatttaagaaaatacttacattcaggctacacctgtaatcccagcactttgggaagccgaggtgggcagatcgcttgaggccaggagttcaagacaagcttggccaacatggcaaaaccctgtctctactaaaaaattacaaaaagtagccgggtgtggtgtgcatacctgtaatcccagctactcgggaggctgaggcacaagaatcgcttcaacctgggagccaaaggttgcagtgagccaagattgcgccacggcgctctagcctgggcgacagtgaaactctgcctcaaaaaacaaaaacaaaaacaaaaacgctgggcgcagtggctgatgcctgtaatcccaacactttgggagaccaaggcgggtggatcacctgagatcggagttcgagaccagcctggccaacatagcaaaacctcgtctctactgaaaaaaaaaaaaaaaaaaaaaaaaattagccaggcatggtggcgtgtgcctgtagtcccagctactcaggaggctgaggcaggagaatcgcttgaacccgggaggcagaggctgcagtgagctgagatcgcaccactgtactccagcctgggtgacagagtgagactccgtctcaaaaaaataataataaaaaaaaggccgggcacagtgactcatgcctgtaatcccagcagtttgggaggcctaagcaggagaatcacaaggccaggagatggagaccatcctggccaacatggtgaaaccccatctctactaaaagaaaagaaaaaaaattagccaggtgtggtgacgcgtacctgtagtcccagctactcaggaggctgaggcaggagaatcgcttgaacccaggaggcggaagttgcagtgagccaagatcgcgccactgcactccagcctggcgacagagcaagactccatctcaaaaaacaaacaaacaaacaaaaaagaaaatacttatattcaaaattagtcctacttttcacacttagctacctgagtctatatatgccaatatttccactaaatttcacggtcatttctctcaaagaggctagtttagtagagcagaaagtttaagtaaatgtacttaaacagtataggaacaaagaggaaatggttgatttgacttgttgggagacaggacaagttaagtttaatacaggaaatgacacttgaactaatcttgttagatgagtagggctcaacagaacaggacaaagaacgatgttcaagaggaaaggtataggatgactaagggcgttggggggctctggaaactataagtagctcatggttggagcacagatgtgaccagagtaaaggccagagagaatagcaacaggaagatcttgaacaggtcttgcatgatctgctcaggagtctggacttgatcctgtaggtcttgttctccaattttattacgcaacagaatcacctgtactgcttgtctaaaatacgcattctttggctccactctaattcaggtccagagtaggatcttggaacctgaattttaagaacactgcctcaattctagtgcaggagaatctgggccag

SEQ ID NO: 261 - DNA, 3910 bp, Homo sapiens
actgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacaggtacactgaccagaaagggcaagatgggctaaacttcgccgttgggccactgggctcccccgcaggattttaaagagctagccagtagatggattttgtttttgttattttcgcaatttattttcaaatatgtaatacgcgaacttggtacaacattcatgtgataaaaaggtagatacgtgggcaggacgcggtggctcacgcctgtaatcccagcattttgggaggccgagatgggcggatcatttgctgtcaggagttcgagaccagcctggccaacatgagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatgctttatgtgattgacacagacatggaagagatctggtccttatgaagaattctgtgctcgcaggaaagatctgtaggaataatgaaatgctttcttcattgatgagatgaagtctctgtttttcagataaagaaaagagaggataatgggaagacaaaacattgtattaaggtagaaggaagctggataaattgtctctgtaaattatcttaaattttgtattaacaaatttaaaatgactcaaataaaataacaaagaaaaatatattaatttggcctcaaggaattttctcaagccataaaaaattttcttagtttatttctttacggaagtatcttatgcttgatcagctgacttaaaggaactctcctagtgtgggactgaaaacaactttatcattgataaaagatgattagtttaaaaagttggtttttattattgaagtgcccacaggcacaagagtataggtgcttacatttccctttagattatgggaaagcccttttgagaatgcactaaatcaggaaatctttcagcaatcagaatgcatgctgaaagttcagatcttttaagttttgggtttcgctgtttgagcataaaaaggaagggagcagggagaaatgtaactaggttcacaattttgagcaagagcatatgtaaaggtaacgtatgtacattttatttcaagaaagacagaagacaaacagcataaagatgcccagatgccctaaagataaatacatttcaaagattctcattaaaatgaatctgtagtatttttttcctgcaagcaaaatacctttctttaaataaaattaaaaaaatcagtattctgaattgcaaatgcttttgttttttttttgcagaaaatctgccatgattatttttttaatgaataaggattttccacaaaacaggcttgctctacatgctagatttttaaacagttcagtgacacaatatgctaactacatacacaacagataatatagtaagaaaacactcaacctgatgaaaagttaaaatcttcattaatacactgaaaattgacataactcatgcctttaaaatcaaaaatacaaaaattaaatgttttcctaaaaagatttccttattttaaggattcatttgaaaatgaagctgcatgtaatttgtacagtaagttgtacaagtaaacaggtaatatacataaaaaattaattgacatactcctcaattatcagttgtccacctttaatttccaatactgtactttcttaacaagcatacaaaatatcaaacttctctttagaaaaagtgccgttctttgacatcctttacacaaaaacagtctgagcctgtggcatgttaatgcagttgagaggcaaagcatacgaacttttacaaattctaccttccataaaaagcctcccgaaaaggagattacacgccactataaaaatatcaacctcttgtggtagctgcattagagaaccaaggcttgaagactattttcatatagcatagaaaaaccactatgagagcatattaactgcattggtggcttgggagtgtactgtgccacaggattatgcatagctactgttaggtaccaagactgttatacagttttaaattgattgtaactgagagcataacagaggtactaccagcccatgcaaaataactaaaaatactgagtcactgtgctgaatacttcattcctggagaaaaccaaaggcagcagtaactaaatcaagccaaacaggtgaccaaactttctcctcaaagatttgtgagcacagtgaagtctgaggtatacctttatccattaaatctgtgtgccattgcaagatattaccatttgagaatatacgccatcacaatggtttaaatcttttgtatattagtcattcatatattcttatctacccagtctcttgatttttgaaaagatttcacctacagtagaatattacagaaacaaaatataaatgcatgtctttctaaatgaaacttacatagactaaaagtagagaatatttttaaacaaatatacaatgtgcaggcagacaaagcaggaaaacggccattcaaatgtataataaaaaactaaaaattgactatctccagaaaactatgaagcgcctcaactaaaaggaatgcataatgaaattctaatctaatacaggtcaaaaatgtaaaaaggttataaaccttaacaggaaaaataaaacaacttttactggccattcctgttgaaatgagaatcataaagtaacagaaaagtggctacaaacccacttagagcaccaaacagagagaaaataaaagtccattttcatctctgttattatcataaaatcctgtgtgactacaggtcaaactgctggtggcagaaacagaattctttataaactgcagatgtcctgtacataaaaaatttcactggagttgcactagttctaaagactcttctgttttagcctacctactatatgtattcgatctgagatagataaagtctctttctgtaacccttaattattattgggcaccaaagataagaaaagcaagacggggtacaaaaatgcaaaatttcaacagtaatggcaatgtttttgtcttagtccaaaagggtcctgcattctctcccccttcagtgatttgacaagtctttgtacttaatctgggggcagcaaatcatgcaagcgaaatctgtctctgatgtgtggtcgaacatcttcattctgcgtggaaaaaagacaatttttaaaaaggcataaaatttcaaagatat

SEQ ID NO: 262 - DNA, 11871 bp, Homo sapiens
agactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaattgttgcaatccaatttgtatagtttactgttttgatgacaaagcgcttatgatgggaaaaatgtagtgttgcttttgtaactgcaaacgctgcacgccgtaattagaggtttatgttattttatttgaatttttcattcttaccatcagttttcatattagtcaggaaattgtgataaattaaaaattccctcattcaactaaaccttaaaaaactgtacccagtttcaaatcaagcattatcaggtgtatgattacaacagctgaaataaattgaggaattggtatgccaactcagtggagaaattttgggattttaggtcactctaagatttaaaaaaatagtttgattcgttaaacaaggctattgaagttaaattgatatttccttaaagatgattttagagaaaaattccttggcgagcttcgagaatgcgttcatggcttctgttgcctgtacctactgctatacttttttatgtggactaatttgtcttatttgaaaatttgattacaatatcaaatcctagatgaagcccttccattcttagggtgattctaaggagtactgataactaagctcttaaaaggcgaggaaatagtttattctactgcagattagggtaatcttaatacagacactctgatggtaattctaagcagtgttgataactaagcttttaaaagataaggaaatagtttattctacttcagagtagggtaattttaatgccctgaatatactctgaatcttttatagatagatttctggatgatttggcccaaaaaatctgataagctttggggaattttttaatttttttttctcttaaagagaaatcagaaatgtgggatttttttaaaaatttattttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaacaataaaataggaattaagctgaaatgtaaaattgtgtaataattaggtttcattaaagtatatatagtttccttaataactacatgagtcagtagtgttgacttaataataagttatttagcttttgcttttctctgaaaacatatcaaactcttcatatatagcatcgaaatagatattcaacctgagccactgtaaattgttgaagcttattgctatacattaagggaaattctatccaacagttcagtgtaaacaattttttaaaggtgctatgattctttaacatgatttgtagtatgtagaactcaagtattctagaataatctttgcatgataatgtatgagaaacatttataaacagtccttcaggtgtacaaaataactgacataatattttgcatttaactacactgcctccaagtattttaaacaaagatgaaatttttagagtattgtgctatatttttataactgaatttccctcttattaacaatactcataacatttagccattaatgattactgatagcttaaataagagtgtagtttctgtttctaatgtctattaattttaaccccatttaaagatatttcctacttatcatactcaaagttaatcagaagttaaataaatgatggtccttctggttctctggaaactgaaaagaagcttctgtttctttagggtatgcaggaattttttttcttcccagtgagctgaatccatcctttacgctgctatttgctaacctcagttgtttttctgctccattaaagttgaggccaccaaaaatagtagtaatatcacaactacaaaaccctgggtggatttgtacccattgcacatacacttcttgctgccaattcctaagagacttttgaaataatagtatattcccagctggacaatatattctacttgtggcctatgtatagtgttcaacaagtccaggagccctatgaaacggaatgtgtttactgcatttttctagggagaagttctcagcaggcacgggcatcttaaagaccctgtgatgcccaaaaggttaaagctctatttgctaatgacagatagtaagtttggaggattgcttcaggtgcagcattttattttgtgggttgttggcctgtagggaaaaacattttgaaattgtagttaaggaataccacttcagttcatcaaattaaaaaaattatggcaaataagcaaaaatctatttctaaagaactacatacaatatattcttacagaaaattttagattaaatgcatgtaactgtttttttggtttgccatgtattgaaaatggatggatgggggattacattagttgatgtatttatttatttatttttgaggcggagtctcactctgttgcccaggctggggtgcagtagcgcagtctcggctcgcaacctctgcaccctaggctcaagcaacactcgcacctccacctcctgaatagctaggactacaggtgcacgcaccataccacacctggctaatttttgtatttttttatagagacaggggtcttgctatgctgcccaggctggtcttaaactcctgagctcaagcaatctgcatgcccaagccattggcccatcttggccttctaaagtgctgggattacaggcgtgagtcaccatggtcagcccatattaatttaaagtaggcttcaaatataattattcactaattgggaatgcctggggatgtatatgaatgtattaccgttttgtgagtagtagtgtgtgcttgtgttcatggatggcattcatcagaatgtttgcaatggtgtagccaggttacactgccatcttcctgttctcctttgtgcttacttgctctgcctgtatttgctgcagtttctagcgagtgtatgtaggtgttggcccagaacttgcttttgtagagatcatacattgtgctaatttatcccaaatcagtttttgtgtattatctgtgggcccaatgtgtaatttgaactttaaggatactacttcagactgcagtgtagcataacctttaaaaaaaaaaatgctagttttgccctaatctgtgcatattccagttgttcaatgggtattagtaatacatgaattacttctgtgccctttttggtgtagagtctcatatgaataattactgttatttaaaacccacgactccatgcattgttttggtgggagagggtagtttcccatcatgttttacatatatgttagcattcagattttcctttttagcccactccctactgaactgaagggaaagggcgtatttgagagaaaacatatgctttactcaggttccaataattaagccaatgcacttgatttaagttatacatttagctcattcttaaagtgtaataaagactttaagcctcctggctcccaaatcagtgctttttctactaaacattctttctgtcttgctaaaaaaatccaattttcagaatcaagttagttgctaagcaaatatgcataaaaccatacatttatctgaattgtttctaatttaaggagtagtatataaaagtttcaacagaaatcattgattagtaaaagtgatggaaaatcagcaaaataaaaatagaattagagtaggctaaaaggcccttctttagggtaatcggaaaactgagttcaaatatagggtctgggacttctcaggtgatattttatcttaaattagaatctgcatgaggtagggtggggccactcatgcctataatctcagcactttgagaggccgaggcaggagcgtcccttgagaccaggagttcgagaccagcctgagcaacatagcaagaccttctctctatttttaaaaaactaaaattggatttaaataaagaatctgcatgaactttcttgtcacttattcttacatattatttgccagtgtgcgatacttaataaccaagtaagacacttgaaatgagtcttttaaggctacaacttaggtaacattttataaatattactgctacatacataatacagtaactttttttagcctcacaataataccttgtacaatttataactgctaaagggcctatagaaggctacccacctatgtaaaaaaaaaaaaaaaaaaaaaaaggtcctagctctgtctggtgtagcttggcaaattatttttgatatgaattgccaggaatataggggtatcattccttgctgataagagcacatacccttcctttgctggctaagctatgtgattctgtaggaccttagtgtcatggccatcctttcagtagtaagcagatttagagaagttgtcccattgttaccttatttcaatagtttttggtctttctatattgtgcataacctcacttaatcagattgttatgactgtttccccccaggaagtataggaagataaaaaaaaaaaaaagccaggccagatatatatgactgaacgtgagctcagcaaatgatataggtgtcttaaacatactttcttttttttttttttaaagggaggggttctggctctgtcacccaggctggagtccagtggctcaatcatggctcactgcagccttgaccttcccaggctcaagcgatcctcctgcctcagccttctgagtagctgagactacaggcatgcagccccacacccagttaatttttttatttttatttttgtggagacaccgtcttgctgtgttgcctaggctggtcttgaactcctgagctcaaccagtcctctcaccttggcctcccaaaatgctgggattacaagcatgagccagggcacttggtccatattttgtttcttaaagtcacaagttaaagctggaggtttcacccagaatcaaagtgccaggtagcattttagtccagcctaggataagcagctgagtttccatgaacacagtacaagaattcagggatatcacttgctaaatgtaaaccagttacctccgtaatttcccaaaaattttattgtgacaaacgagtgccatactctgaacattaaaggcttttacctccagctgtccaaacattgtgcatgttattcgggtagaggcactggtatggtaggagtttctcctttagtgtcttgtaattgacaacagatccagcatttatggaatgtattgttattgtaacttttgagtttccatagccaagaacgtaagagtaataactaggtatagtccattatttttagtaaagttagttttagttagcctttgatggtagacacttctcaggttataattcagactcaataacaaagccagaaagttcaggaagggtagggtagtgctgtggtctgaatgttgaaatcctaactatcaaggcattaggaaatggaacctctaaaaggtgattagatcatgagggcagaaccctaatgaattagtacccttataaaagagaccccagagaactggtttgccccttctgccttgtgaggttacagcaaaaagaccatcatataggaagcaggacctcaccagacaccaaatctgccaacgccttaatcttcgacttcccagactccagaactgagagatataaatttattaagtttataagctacccagtctttggtattttgttataacagcccaaactaaggtaacaagaagcaatcctcacagtgcttgcttaatgtcatgcacctgtcattctagtggtgctcatttgccagtcttttttttttatgaaagaaattagcagtcctgctttctcttgttttgagtgacaggtctcaggtaaggatttattttccagaaagaaagtgactaaatagattccctccagaaagattttcagatcagtagatctgccttaaactaatgtagtctttggacccagttcagaagtggccaaggccaatcctcaatgcatgaaagtaaaagttagactgtatttaagggagacaaattactagttaggaaccatcgaatgaggtcagaggcaagaccttactaacagatgggcaagttaaatgctatcttctgaaaattttagttgcttcatgatggactcatttggagcatatctggaaagttttttggacatgtctaaaacacggggttgaattttccttacaagccagggttaggacaggaggtcgacctgctgtctagatagtctcagcactaccagaagctatttgtaagctgtactactagtctggtgactcaagtaggaagtgtccaggaacctttcttctagacactgcgagaaaccaaagattagtaataagaaattgtttgatagacaagatgaacatcttaaagcatagattcaagacagaggacctttgtacctgacaagtactcaggaagacttgaaaagggcccccgcaggtgagtttcaggctctgtcttccactcatgaacctgcaaaatccaatccttgctgctgaagatttcttaagaaaaatgaacagtgtacctggccacttcagtgtctttagaatcccatcttggtgttatactttgcctattgattctagatggagaggtatcaaatgctttacaaaatctcaaggagttataaactacttttacaatctgtgttataaagtgtattccctggttattataaataggcaaaatgctattccaaatctaacaataaagacttttgccaatactcattgtttcagctttcaaatatgttaagtatgttttctacccatcctacaaaagtatacataatcactaaaacttatgaacaacacatatatgatattaacctgaatatttacagagagctccccggagggatgattttatttattatgttaattctctatttgtttagtttgtgacctgatcttaatagtaacaagtgaatgagttagcagaggaaatcagttaataaatataagagcaacaatgcctgtgaagaagtcaccacatgggccaggcacagtggctcatgcctacgtctgtataatcctagcactttggtaggctcaggtgggaagatcccttgaacccaggagtttgagaccagcctgagcaacatagcaagaccttatctctactaagaataaaattaaaaataaaaacatgaagaaatcaccacagccttagtttagtaacgataacagtattttgtaatatccacagcagaggagactaaggactagatattttagctcctccagaagcgaggaatgtttattgtttttacaattgtctacaatcaagaactacccaaaagcttgaggagcatcagtcatttatgacttttcagaagttaaagtatcatctcaggtgaggacagcactttctgccacctaggaagaatatggagaaagcaaaattttttactactttgtcttaagaacagactgcatgtctagaagccaatttggtttttttctccaagctgccagttccctcttcaatattatacagtgttttgttttggtcatagcaccaattactaatttaaatgagatttaacgaaactctttcaataataaataatacataacaaaatacgtgtgtgaccatatatttgcaagaaaggggttgtgccatgaatctttttttctcagtttaacaaataaatttgcaaaggcaactttcaggaatcagaatgttattttaaatattattaacaagacaacaaattattcagacaactaatcagaattatagactttaaacttacgttatttttcacagaatatagcaacactgaaatccaggcgtccaggaagactattttacttgaaataatatttttaaacccagttttatgatatagaatagaattctatttgcttttctgcagctttagggaagaggggacattttccccttttgatattgctggttttttttttttattttaagaaaacagcaattagaagtgtctaaatatcagatttccattagctagcatcaagagagaagagtaggtacaaacttaaaattcagaaaaggacagaaagggccaggcatactggctcatccctgtaatcccaaacttggggaggctgaggtaggaggattgcttgaggccaggagttcaagaccagcctgagtgacgaagcaagatcccgatctctacggaaagatcagccattcctggtggctcgcagctgtagtcccagctactcagtagactgaggcgggaggattgcttgagcccaggagttcagggctacagtgagctgtgatggcaccactgcactccagcttggatgacacagcaaggccctgtatcagaaaataaagagaaaaaggacagaaagataatgctaacaaatggaatatggagcatataatgtcttgcctctacatgtaattaagaatagaagtaaaatttatctcagattaagattttttttgaaacaatctcaacagtctatattcagataagacagattttaataaaattatatatgtcagtcatctgtttcaaaaatttcagggctatttttagtctttatcaagcataacttacagttatagatagttgtggttttagaagctattctatttgttattccctctgtatcccttaatcccatgcctcaaattatttcagaatactttcccaataaatgtactaacttgttcttttgtattccaaaaatgtgaaaggtgttaaaagtttgtgttttcagtgcctttggaaacacttaaaaacgcatctttgaaattgtgtgtccaaaccagtatttcccaaaatgtgccatgatctgtttataggtgttgagttaaatatatgtatacacacatatattatatacacatatata

SEQ ID NO: 263 - DNA, 1607 bp, Homo sapiens
atgtttcactgttctcagaaattaagtcctatactgcctgttgtccaatgtctgaaaacagttgtcttgtgttttgcctggttttctagttgttcctctatcatagatggaatccataataaatatgatgccaatgccaaaatctgctactatattactctttaaagcagagactgtataggaagaggaaaaaagaaatcagtgtaaccgtgggggcaaggcaggaagcattctgtttatgtaacacagacgtggcattctttactttctaacttaggacatttgtgatttgaagaagagacacctgaattttcaatatgttagtctttgttggaataattggctcttctcattctttagtcatcaaataatacttattaaataccaactaagtgctttgtgccctgctaggcattacttctctttattctacttcttaacagttggaatatgccaaacaaatgaaataaaaatagttttcctattctagttacaggttggattcttggatttatctcccaagctttgacattcagaaactgaaagtggaatatagtgtattctcagatgtaaagttgatctcatttcctcactggccatctgtttatttgcgtctaagaataacaaaactttcatagtcatatctgtattttttaattactaaaaataatgaatggactgaaccatgcttgccccacttttgaaacaattccttctatagactgttgcagtaggaagctaatacccctgattaagaataaagaccagacctacataagcatatgttgtattggtgtatctgaagtcatgaggatgtgattaatggtccttaagagttttaatttggcgtgtcttaatgcctaaatctcacttaagcttggttgcaaagcctggcaaatcagtcttctgtacatggcaagctaagatgtggcaccatcttcttgaggtttcatatcctaaacctgtctgtccttacaggttaaattcaaaggatagggccaagcttgatttgctgtagtcatagtgaatcatcacagatccattcttagtgcagaagagttaaataattccttggccaagagcatggtgccttccccagaccaatttctaacagtgtcctctgttagatctttaagttaataaattcttttattagatttttgggtcagaaaaacagactatgcttgtactcaggagcccagaaatacataatataattgactaattcctgtctttgaggtcttaacgtggtttcatgtgccttttgatttgtttttacatgtggatcattttcccttaacactttaatatgatacaatttttgtctatcgtttttcttaaataggagggagaaaattttttttagtaggaaaatatctggtggtaagtggcatctttttattccatgtgggatgcagaagtttctcccaaaaactgaagtgacctgctttttgcagataggacccctgtatttctcccatattactttatagctggtagatggtagggctgtacacagcaaatgggtttgaatgcatgatggttttctggtggagctgagataattagtattatgaagccacgcttctgattgtgagaatgagaac

SEQ ID NO: 264 - DNA, 1976 bp, Homo sapiens
aataaaattgtgtttttgtttccagtgtttattgttagtgtatagaaatgcaattgatttttaaaaatgtatatcttgtattttgtgaccttgcggagctcactttttaattttaggagattttttctttgcatgatccataggattttctatttcaataataatgccaactgcacacagcacagtttatccctttttttctcaatttacatgccattatttctttttcttgttttattgcactggctagaactttgagcactatgttgaataagagtggtaacagcagatagatgttgttgccttgttcctgattttacagagcaagcattcaatctttcattctttataattttagctgtgatatttttgtagatgctgtttatcaagtagagaaagttattctcaatttttatttttctgagagtttttaaaattataaatgcatgttgaatttttcaaaaatctttttcttcatagagtatatgatcatatgctctttcttctttagggtgctcatttgatgggttatattaatttattttcaaatattaaagtagtcttaaaccacttggtcatgatgtataataaattctatttactaatattttgttaaagatttttgcatctatattcttgagggatattggtctgaagctttcttttgttttgtttggtactgtctttggttttgatatcaaggtaatattaacttcatacaatgaattaagaagtgttctgttttcttcccttcaagagattgtgtagaattggtgttaaattttctttaaaagtttggtagaattctccagagaaattatttggcttggagattaatttgggatagagatgagtttttagcttatgaattcaatttacttaatatttaaatatctgttcaaattttctatgtcatattggataaattgtggtagttttctgtttttttttttcctgaggaatagtaaaatttcttctaagttattaaatttagttatgcagagatgtttgtagtattcacttactatctttttgatgtcttcaggatctgttttattcctgatgttggcaattagaataatctttttccttttttgtcagtcttgccagaagtttgtcaatcttattgatcattcaaagaaacagcttttcgtttctattttttttttgttttcatttccattgcttttctgctcttatctttattattgctttccttgtgcttactttatttagatttacactggtcttctttttatagattcttgaggagcaagcttgaattactgatttgaagcattgtctctaccctaatctaagtgctatctatacatctggtgctataaatttccctcttagtcctgcctacatttgtcctcaaaatttcggtatggtgtgtttttattttcattcagttgaatatatttctcggatttttcttaaatcttcttttttggccaatgagttatttggaattgtgttgttcagttttcaagtctttgaggatttttctttctttctattattgatttatagtttgatttccttgttatcagaaaacatactcttcatggtttcaattcatatggcccagtatatggtctttcatggcatacattttatgggtgcttaaaaagaatgtatattcttctgttgttgtgtcctataaaagtctattagattcatttagttaagagtgttttaatcttctataatcttgttgattttctgtctagttgttctatcagttgttggataggggtgttgaaatttccaactttagtcgtggagttgtatagttttccttttagtgatattgcttttcatttcacatcttttgcatcttggttgtttgatacgtatacttttataattgctatgtcttcttggtagattgacccttttgtcattatatggtgtcttactctaattcttttgttttctctgttctatttaatctgatactataatagaag

SEQ ID NO: 265 - DNA, 705 bp, Homo sapiens
gcagaaaaacacaaaaaagaattgacatgtcccatttaacttaaactattcaaagatccctgcttgacgccctgcaaacacaacttctgcttcacctgcctcaggcagttggagagggagaactagcatgtcctttcacttgttcccagtgtcttgacatctcttggatccagaggatctagaccaatatggccctggggaagctagtggctgagatcacagtgatgacacttgtgacacttgtgctgagcatgttctgcatggagttctatgaaaagatgagtctgaatgtggccacaagtaataacctcctcatattttctaatgacctgtggagcctcttatggagatatgtccagatgagaccaccagagaatgccaagacattaatctctgttcctcctgtcctagggtcctcgtgcttcacctctggctgacattattaggagttgaaagtgggagaaataaaaagatggattgcgggtgtttgcagagaatctgcatttcatgaagaacctttcctagtatcatcagatctctggttctgagtggtgagcctcaagagcgtatgtgaagtcactgctagcacagaaactaggacggttctccatgtgagcccaaacttagaagtggggattttcctggactgtgacctgaaaaccatttcatttttcaacacgtctgatagtttccatttattcacct

SEQ ID NO: 266 - DNA, 3909 bp, Homo sapiens
acagacaaacaggtactggcaagatagactatgctgatggagtaaccaagtttgtgagtatatgaaaataacgagggatgacatatgggaatattacacaatgataaagttggaatgtcacaatgaataaacaaaatctgattcagagactatgccaagccaggtgataagatcttgaagaaccaagatccagagagaagtgaaaggaatcagtgttccatggaacggaagtgcatcaggaaaggaaagagaaaacagattcagactaaagcacgtgcctgacaatgtgtctgctgcattgcatgaggcagccttgctgcagccaaccatagtggggtccaattaagaggcttaattgaagaattccaagttagcagactgtcctggcactcagaggatattgtgcctggtaatgatagtgttgaattggacagaaagaatattcacaaaggtggctgtccatatccatgggttctgtatccatagatgcagaattcttgaatacagagggttgactgggagatctgacatctgcaggttttggtatccgtggaaggttctgcaaccaatctctggtggatgtgagaggtgattgtacttaagcttcaagaaaggcctcctctgctaaaaatgctctctgattagccattcactgcttcctgaactatgaagacatcttctaggaatactcaggatcttctgctatgtggctttaatttattttaagattaattcctcattaccttcttacacaaagccaccattagcatatcaagcacagctgtacaaatttttaaaaggccaaaagatgtatctgccaattctaggaggatataaacctgaaggcacaaatctgggctggagcacatggtttcccttgtgagaagaaaaagtctccttcctctgaatggacacaccttgcacaccagggcacaaggtttgtctagaagagcacagctgaacatcataaagtgcagaaccacacacctggcatccttgtccctacacaagtttagacggggtttcaccggttagccaggatggtctcgatctcctgatctcgtgatccgcctgcctcggcctcccaaagtgctgagattacagacatgagccaccacgcccggccaccttggatcctttaaaagtaatgtatggtttaaggaggaaatttggttgaatacgtttaaggaaatattaatccaacctgtttaataaacattacctgtgaacattgcattttgaaactgttcaaatataccaaatgattcatattaattagaacaaaaagtccaaaaagagaaaactacaaattctattacactatttaaaatagcatacaaaaacaattttgagcaaaataatgtaaaagtagaaactgataaattaaaaaatagaaacgtagaattaattcaatttaatccctgtatcattggatacacacacagacatcaaagagagagagaacatgaaatatattagaacattaggtatgagaagaaggtatatatccaaaattaaatataaatttaactgctatctgggttattattttaaaatctcacttaaatgaatctatatctgagcagatacaaattatttacatttttctaaagggttaactgataaattctcaaaacatttcaactatcagaaaaatcatcatactgtgtaaacaactgcagaaaacacaaaataataaattctcatgttttcaaactaacaaaattcttctcttaatgatttccaaaacacataaaaagaaaatgacagatcattcctaatatttattcaaattttttaaaaaaattaacgatataatccagcagtatgttatagaaataataagtaaaattagttctaatatgacaaaggtgatttaatatttgagaatatgtaatatgaagcaagtcattccaaatgaaaatttcgtaaacataattttatttttgtaatggcattttagaagatttcaattattctgtaattaaaaatttagctattttagggtaagagagattccatgaatatagtgaatagtaaataacctacatcattgttcattttcattcaaattaataataaaatgaccttactttctttgaccagaaacattcataattgttctggcaattctgatcagtgaatgatgaaacagaattagagttctgtttctaattatttcaaggaaaagggtgaggttgaagatatcctatctaaaactttatgtaatatatataatatatatagatgatatatagatatctattatatctaatggatatacagacattacataagccttaaagagtcagtcaatacttgttatttatataagttcagtatttttttgactataaatactcaaaataaattatgtcatcaaccaaagatgaaaaataatttcatttacaattgctcctccaaaaagtcacaaaaacgacatgggaataattatagaaaaaaactaatagtataataataataaattacaaaaatttttagatttatcaattaaatttaaatgtatggataatcacagtttgaccctagattttaaaaaatcaattctttctaaacattttattagtttatacaaaataaattaaaactccatggtactgattttgtctcttaccaaaatttttgccaagttatctggaaaaattaatttccaggaataattatgaaaaaataaagtccattgcccaaaatactgtactgaggaaaagattatttcttataaacagtcatattaagtttttcttctcatcttgtatctcaaaataaatttcaggttgattaaagtatcaaagttataaaatgaaaatattaatggaaaactgaataaaatacaggtcaatattgaactgatttgtggataggaaataaaatgaaatgattgaaaatataacacaaatttaatatattgctaaataaaaataaatggtactgaagaacattactaaaattaaatgtaaatgaagaactaggaacactataagcaatgcaactaaaaattggtatatttaatctaatctattaaaagcattctagtaacagaccgtggatgtgagaagacaacacaaggaatatgaccagaaaataaaaattaaacatatttaattttaattataaatgctattaaaatcaaattgatttattaacagtaattcacaaacattcaggaacgataaaaataataatacttaataagctaaacagggaatttcacttttaatagaagagtaaatgaagacaatctctctgtaaagcaattcattatcttaaaatattattctttgaaatagtaatttttagaatcagttcctagaaataatcagtgacacacagttttgtatataggataaatatattcatcacaatatgattgacggcaaaataactgagaaacaaatgaaatgtgaactatgataattgaattatagccctaaaatgaatactaatcattaaaatgacattttaaacttttcggaagaatcgtttaattattttatacaaactaatatgtcaacattattttaagaagcaaggaaaagagtcaaataaaataaccaaaatatatctctgtccggaaatagcacatttggagaacatcattattggtctcttagtatatagatttatacagattctttgagttcattatgtttgagaatatttttgtcttgctgttataagtaagccaacaaaagctgtttatagtattcttgtgttataatatattctccttggatctacagataattcgttcacttgtgtctgcaatttgttactaaaaaaatctatggccaatatgactaagcctacctctcatctccatgagtgacttgatattttctgcatggaccctgaagaatttttcatttttcaacttcaatagtataatcg

SEQ ID NO: 267 - DNA, 2477 bp, Homo sapiens
agacaaggaatctggagttcaatgacgggagacgcacagggcagagcgaaagacttttgcattctggtaaccaactgatcctacccggacccatgatgcataactcagctggtcctgtggcgcacacccagaggccgactcaatgcatgaagactgttttccacacccctatgatttcatccccaaccaagcagcagcatccattccctagccccctgcccaccaaattatccataaaaactctggcttctgagttctcagcaaaactgattttagtaataactccagttcttccacttggctggccttagttaattaaacttattctttactatagtaccgtgttcccagtgaattggttttgtctgtgtagcaggcaggacaacccatcaggcaatcacacagttactctgcagtgcttctttttattttgcttttcaaacaaatttcaaatattattagattgaaataaactatacaaatagcttttcctcacaaaaatgcaatattttgtgtattattcctaggtaaactacaaaacttttatttttggaagtttttttttgcaaaaataaatcaagatgcttatgcatataaatcaagatgaggcaatgaaaaaaaaccaaagaataaccaaagagagacaaatcagttgtcagtgtctgtgaactcatgttctgtcttgcttgtaaaacagagggttcatgtgtggtccgctaaaaagctgatggcccagttagggtagagatacaacaaaggggtgcaagccccagcaacacatgtggggcaacagtgaggcatccctccattcaaactgtaactgtaactccttcctttcttccttcctccctccctcccccttccccctccatccctccacacttcccccttccctttcgcctcccctcccctcccctccactcccctcccctccttcctttctctttctttattttttttttaagagatggggtcccactatattgaccaggctggtctgtaactccgggcctcaagggatcttcccaactccacctctcaaagtgctggattacagcctgagccactggacctggctactgtccattctttgatgaagacaaagtttaccctgaaatcctgttcaggtgagcacacagtttctatcactttctggtaacttcctaaactattccttatggaatagttttaatagtgcacttaaaacacaatgtatttgagttggaagcttcgttcttttgtataaatttttttctccctccctcacttcctcaacatttatttcttccaaaagctgataactcaaatcctggtcattagattggtagattataaatgtaattcccaaaatgactttaatcccttcatcacgccactggcgggcatcgcacagaaatgaaacttgacactttgaataccatcttcttggagacagagaagttttcaaagcatgcaagttcaggctgtgattattcaacatgtaggacatagatggctaatggatttggtgggaggcctgtagccaaatttacctttagtgactaagtggcctaatgcaaatcatagttttacttcctaatagtgaaaaacaaagcatcttaaaatattatctcaggtattgtcagtaatttccgagttacttttggaggctctgactcatttgtatagagtttgctttatgtgtctatcattaaatgcaaaccatgttttgtattaagagttatgttaaccaagtgacatgacctgacctctggtcagtgtttttttgggcatattttgtgatgcttacatccatctgtgctcactctcagtctccatcctgggaacacaggacctgaaatgatatgtaaacattaagaaagagacatagatgtcaggcagatagcgagcatcataaattgtgaacagatagaagttctttgcctttccgtgtgtatttccacttgatcttccagcaatggagctccatagaagtgcgtctagattggtgagtcactctgtacatgtcagcagtgtgttactctgacatgttgagctggagatgtcctgtgtcttagtataagtactttgaggtgctgatctgagaaaatctaagtttctgaataatgtgctctaccattgggacactgtttctaataatgtcaaaggctagttgagattctaggttatcctggtaatccctgaaaaacttcccagaaggtttcatttgaacatcatgtttagtggccacattagtggcttcctcaaaccaaaaagtataataaaattcaatattttttaccacttcatttgtgaatgtgataactgtagttaagctgctgcctgtcaagaagatgccagaagtttgccactggaattttccccccaaaggctcttgttaagatagggcattttttgaggcgggtggatcatgaggtcaagagattgagaccatcctagccaacatggtgaaacccaatctctactaaaaatacaaa

SEQ ID NO: 268 - DNA, 3744 bp, Homo sapiens
gtcacatgttgtcaaacatggctacctacaccaccatcatagaagagatggaagtgagttcttctgcagcaccccagagccggcctgcagtcaggaaggcctccccagaggcatccacgaagctgcctgccaacctgggtgccccaggcatgggcccctctaagcctgccctaggaggagaacagtttgtgtgacacagggggcggaggctgggtctgaatctttttttttttttttttgaaacagagttcgctgtgtcgcccaggctggagtgcagtggtgcaatctcacctcactgcaacctccgcctcccgagttcaagcgattctcctgccttagcctctctagtagctgggattgcaggtgtgcaccatcacgcctggctaatttttgtattttttagcagagacggggtttctccatattgggcaggctggtctgaactcctgacctcaggtgattcgcccacctcagcctctcaaaatgctgggattacaagcgtgagccaccgcgcccagctgggtctgaatctttaacagttcccctccgctcctggagcccctcccacagccagcccttgctcaccagcgggggaaccaacagccccttcctcaccctcctgggggttggggtctctctccacaataccagtgccgggacgcatccctcgtcttctctgctcctttccgttgtccggaggcctaggcccagtcatccagccagcctccacccagctcctctccctgcacacaaagactgaccccatcaagctgcacttcctgaaacacacccacaaaccagaaactcagcctcccctttgcccgcaggatgcccatgggcaaaactgtcaccaagagaagagaggaggggcccaaaccggctctgtctctgtggagaaagagcctgcctagggctggaccctggttgtgtggcttcaggtactgtaaaagggattgagttcaaactcctgacctcaggtgatccatccgccccagcctcccaaagtgctgggattacaggcgtggaccaacctggtgaaactccatctctactaaaaatacaaaaattagccaggcatggtggcgggtgcctgtaatccgagctactcaggaggcagaggcaggagaactgctgaacctgggaggcagaggttgcagtgagccgagatcgcgccattgcactccagcctgggcaacaagagcgagactccatctcaaagggcaggacccaatctcggaggagctgcaaatctcggcatgctcgacaaattccagcagggcatgaatcatgggctcctgcctcgtgagggccctcctctgccagtggggctggtggagctctggggctcgcctgctgcccagcttggaggcagagccgggcctgacggagtcctccctgcacattccagaggagctcaagccagctttccccccgggatctcacctgacactgcaaggcagagtgccccacgaagagagggtttccttcgcttgcctttttgccctggcaagactggcaaccaggagtccgtgagcaccggtgcctcctcaggggtggcacctctttctgggaagccacacgggtctcagacagctgtgcccttcctgctgccctccagctgccagaaggccatagttcccatgtgccctggaatgtgggactctctttgagacgtccacttggggacctgtcctcaggccctggggtcagcacacaggtgggcagtttctttgggctcagggtcaggctcctactggtgggtgaaggcagccctttgtctcatgtcttgccccagcgttcctgagtagcaggctccctcccccatcctcttggcagctgtccctccctgctccctcccggtgaccacagccaagccaagaggcctgtgctctgttccccacacgtccatgtagagtggctggacaccggtgttgattgctgtggaggtggctggagggagtggacattccattgtaatgatggcaaaaatagccatgatctttcagccactgctgaaactgctggagtcaggcccttcccaggtatgatttgccctccctgatggtgcatttgtctcccagatgtgcagatgtggaagccgatgtcctggggatcaggggaacctcatgagggaggaggcagggggccaggactggctcctgagctctgcaaccccagtgttgccgtctgtcttttaatctttaaaaagaagatacaatgatataattaggatgcggcaatctcagcactgggaggccaaggcggggcggatcacttgaggtcaggagtttgcgaccagcctggccaacatggtgaaatcccatctctactaaaaatgcaaaaaaattagccgggagtgatctcagctactcaggaggctgaggcaggaggatcgcttgaaccggggaggcggaggttgcagtgagccgagatcgcaccactgcactccagcctgggcaacagggcaagattgtgtctcaaaaaaaacaacaaaaacaaaaccaataataataattagaatgctgacactgtctctagcttttctgggtctctcccattcctgtagaatcgttcttgcccacaatcacctgcccatctctcttgcaccccagaaaagttttgcaagttcaggaagagaaaaaaataatctgacatgtactgtctgtattctcccatgacaataatctctctgtggggggaggggtgtccatgtctaccacggtattgaatgaatattgaatgaatggctgaatgtgcatgaaggaaaggagacagtgggtggttcaagtgtggttgttcttgcttccccattccaatcaggacataagcggggggccagggaggacaaggccaggctggcagagtgtcatcaactcacggctgctgcggtgggtggccctcctgtccagcaacagcatcagggggtgggtgagcgtgttaggaggggacagaaaagtaggggccactggcttcccccacccccaatctgccaatcctacctcagaacagtttttttctttttttgagacggagtctcgctctgtcacccaggctggagtgcagtggcttgatctcagctcactgcaatctctgcctccccggttcaagcaattctcttgcctcaggttcctgagtagctgggactacacgtgcgcaccaccacgcccagctaatttttgtgtttttagtagacatggggtttcaccatgttggccaggttggtctcgaactcctgacctcaggtgatccacctaccttggcctcccaaagtgctgggattacggtcatgagccaccgtgcctggccctcagggcaactttagtgctcctccctatacccagcaggggcagaggaaagtccccagggaaagtcctctttgagccgttgatgacagcatggttagtagtagttacaatgccaaaatataaaaagaataattttaaaaaagattttgtgtgcaattttgcagagggaatgtcttgcccttttttctccactcaaaaggaagggagggtattcaaaagagtccaaaagtggaaacagcccaaatccccactggctgatgagtagataaacaaactgtagtgtatccacagcgtgacacgttactcagccttcaaaaggaaggaagcaccaatttatgccccaatgtgcaggaacagtgaaatgtgatgctgagaaagcagccaggcccaagaggccacacagtgtgtgactccactgacacaaaccacccaggacagg

SEQ ID NO: 269 - DNA, 3503 bp, Homo sapiens
ggagcggggcggggcctgcgggggcggggccccgggccgggccaggactgatggagcgagcgagaacggactgcgcgtgcgtggctgcctggccggcgctgaggggctgagcgtacgcgggcggcggggtgggccgctatgctgcaactgaagcccagtgatctgacagtatggaagtgctttccttccgctcatccgcggccctgggctgcggcaggggggttgggtgtgtcaggtgaaaagtgctccctcccacccttcagacaggtccccaaaccctgcggcctgcgcggaattcctgcattgtcattgccggcccacccactgttcaggctgagagcggtcccccgcccaaaccggcgcttcgccggcgccaagatagaaatgggtcgcccggctggtaaagaggctgccctgcaaccctgggctggagtattgctgtggtcctggatttctggactttatttgcgttctcaagtggcgaagtgttcctcaacctggacccacatcagaagcaggttctccgagcccctaagcagcggcgtgacaaagtaattgtttaccctggaaatagactgttattttttaaaaattattgtcagggcttgctttaatgttcttaatgtttttgtatgagatcctccatgtgagatttgaaaagatccactatgcgggtcatctaaccggtcactagacattgattccacacttactacgtcgagcacagttgacactgggaatacatggatggacttatactagccctaaaataactccttttctattagaactttactaggtaaaggtatttgaatgtctgaactccatgtttagaaggagtcattggttttaaggctctgtcctagtacacctgtaagagcatttgcttaaaattgcctggcctttgtatgttatctctgtcacttcatatttgaaaatcacttgctagaatatggcctgatcaatgctgttatgctagtgagaaaatccacaactaaagactatttgctatatattagcattacggttagaagtctggaagcctttggaggctggcaaatctgagttcaggtctagctcttcgagtttactggctgtgtaaccttaggcaatttacttaacctccgtgagtctcagtttccttatctgtcaaatgaggataaaagaacttagagttgttattgagattaaacgggatgattcatgtaaaatggcttagaataacgactggcaaatcttaagcgcttaccacatgttaattgttatcaatgactttctttacctttcacaccattaatatctgaccaacctctagaagtgatgggcctaaagaactcttggagctaaaattctttgtcacctgtaatgccagcgctttgggaggccaaggcaggcagattgcttaagcccaggagttcttgaccagcctgggcaacatggcgaaaccccggctctacaaaaaattagccaagcgtggtggtgtgtgcctatagtcccagctatttaggaggctgaggtgggaggatcacctgagtccaggaggtcgaggctgcagtgaactgtgatcatgccactgcaatccagcctggatgacagagcaagaccctgtcactaaataaataaataaataaataaaataaaacttttgattttgttgtttatatacttaagaaaggaaccagaaccctccccagtagtcctacactttctgtggcacaaagcaggatggagacccccaggagaagctgagtctttatgttactgttctaaaggagagctgtatactgctcttggcccctctgaaagccattttactctgtactttattctttcagtcatcttcctcagagcattttcccctcaattttgttgtcagttccatatcatatttgcttagtctgagaagtgtttacttttataatagtgtcaggcttcaacacctcatgacttccagatgctcaactacccacctaaattgaggtcaaagttgtattccttgtggttttataatatccctatccagcattcttccattaaggtggctgacaaaagtggtcatttatgaatgcctactatgtgccaggcactctgtgtgttgtatttgcaatcctcatactttgtaagggtcagcaaaattaagtaacctaccccaggtcacacagatcagaagtttatagataagctgagattttttactgtctagtctgtaaaatgacctaggccaaaccatgttaaaataaatgtcctcgtaattttagatgctattctggtaaataccttctgtgaaaacctctacattacaaaaatagggaagctatatattatgaggaagtctataaaaggaaataattcatcagtcccttggaatttttgttgcataaatgctgttttataattgacctgttttctatactatgattgctttttctttattgcccaatgttttcttacatctaaaattaataaccatcttgtttttcttttttcttttttttttttttttttttgagacggagtcttgctccatcgcctaggctggagtgcattggtgcgatctcggctcactgcaacctccgccttctgggttcaagcaattctcctgtctcagcctcccgagtagctgggactacaggtgcctgccaacacacctggctaatttttgtatttttagtagaaacggcgtttcaccttgttggtcagcctagtctcaaactcctgacctcaggtgatccacccgccttggcctcccaaagtgctgggattacaggcgtgagccactgcgcccggccaaccatcttctttttcatttgcttagatttccatgtctttaattcagtttcaaattcccgtcccagctgtgtaaaactccttgttaggtattttaacaattttaccttcttaaagacacctttaagaaccttctagcctgctccattctgagttggttattctgaaactgaatacacagctgtcatcctgtgatctttcaccattgttcagaagattccctttgcctcaatcttgtgtcttcttgttttagtggagaacttcccccaatagttttctgataaaaaggctcactggtaagtctttggacaccagtgtatccagtcaaggtcaaccagaggaaaaatggcattcttaagggggtgctagaggaaagcttaataaagggactgtttacaaaggtgtgaacagtgtgaagagataggactagcaacagcaggaagccttaggcttgaaagggatagaggaaggaatgtttactagaatccagagagagatgcagcttataggaaagtgttgcccaccaagatttatagtcttcagtaaaggaacacagtatccatccctttctttctgccccctggtctcccaccagtgttgccctttgaccaaacccaaccaggagccagaggacaagagacccaagtgaagcaatccatgcaggtctacctccctgagcacaaagtgggaatagagaaggatctcaaggggcaaac

SEQ ID NO: 270 - DNA, 3417 bp, Homo sapiens
ccttacagtagcgcagcgccaggagggtgtccgcggtctcgcctgccgcccaggggccctctcagtgccgcgctccgccagcctcggccccaccccaaaccccttcctccttcaccgccggctcttacagggaaatcggcgcccgagacacagccagcgggtgttcagaaaggaaaacgctcgctcaacagccttttcggttgattcttacattcaaggtgtgttactatttgtggcaagcatcttttcatttaaatctcgtgacaaccccgtgaggaccatcgtccccattttcctcttgaggatgagggctcagagacaggaggaaaccggtgctctgatcaaagccatacagctggtgacaggtgggcttggctcccagcgccctctctgcaactgaataagctgccttattcagaacgtgctgagatggaacagatttaacatctgacaagcaggaatgtccccaagtggtgtttctcagctagatcctgtttgaaaggacacttcttgcaagcctctcagtgtggactcaaattgtttttagaataaagctaaacagcttcatgcataaaccagcacaagctccctatgtttgtgagtcctaaagcactcaaattaaattcagcataagccagactataaaatcaaaactgttgaaatcctcatgagtcgggaggctgttctgtttgcagggccactgctcttggctgtgtctgtcccagctttgcagggcaggcaggtgccgcccggtgctaggtggcccaattctcctctgcttttctttcttcagagccctgggttatggcactggagtgtcacggggtactgcggtgagggtgcgggaaagggggttctaacttctgtcacccgcgccctagggttcgatagtgttttttcaatctcattaaagggctgacttctatacacacagagattcggaagctgccactgcattattttcatattagctccacctctgttcttttgttaatgtctcccaccaatttataaaatagtctgaggctctggtgggatcagaaacccaaaggtgaacacggcagcagctcctgcgtcataaggtggtgggccggatggtcggtgtatctgtactggtttttcttcacttgtcaacaaaatggaaatggtatttaaaatggaaaatggcaggagtactaaaagtcctaatagatgatagggcattacaatcagtattttagttgtggtagtaacaccgtggtcatacgtttttctttttcttttttttttttttgagacggagtctcgctctgtcgcccaggctggagtgcagtggcgcgatctcagctcactgcaagctccgcctcccgggttcacgccattctcctgcctcagcctcctgagtagccgggactacaggcgcccgccaccacgcccggctaattgttttatatttttagtagagacggggtttcactgtgtgagccaggatggcctcaatctcctgacctcgtgatccgcccacctcagcctcccaaagtgctgggattacaggcgtgagccaccgcgcccggccggttatatgtttttcttttgtcattttaatcatgcagcctgaagtatttatatggatgaatatcatgatgcccgggattggcttcaaagtaaccccatggagacgaggggttaatatgagtgtgtccgaccggcacaagatgggctggataaggctaggatattcattatatgaaaattctacttttataaaggcttggaattatccgtaattaaaacatttcaaaaatcttccacgagctcaaggagactccaagcctatggccctggatcacctccctgagacagctggagcaaatgtcaagcccagtgttgggatggcaccagatggggtgcatgtagcttgggagaccttccttggccctaaaagggagcactgtctcccccacacctccccctgctgggcagcatgggcactgcatgccacaggcagctcggcttggacacttgggcacagagcccatactgggtcctccacgtgactctcaacctaacaaaatgttaaaggagatgctttttctattaacataaatcagcaaacatttatgagcacttcggtaagtggtccttgaagtcttggataggcaagaagagggagaagccacggggcaggggaaagactaacgtgcgtggatttccagcccaatcccagctgtcaccccctgactgcatggccttagacatctcttgccctccccgtacaatggcgacagtaatccatggctctacgggttaaatgaccgctgcaagagagggttcgcagcacagggtagccatgcagaggacttaactgaatgaaggagaagaggagagagcccagagctgacctgatgcaaggctggccacaatgcctgtgtcccttacctgactggctgatgaaaaagcaaacgtcatccctgaacacaggtgtgttcctgtccagaaaatcactagcaagttcaaccatcacaggaagctcagtcagttcctccaaaacttgccgcgtctgaagccaacaagcaagcatggagactaaagtcagtcacaggcacgacagggacatggggcagctgggcttctagggacagtttgtgacacggaacctcactgtccaggtggcgaggggacttcggtcacccacaggccacctcgaagataaaagggctccgtgtcatttctcacgctagctcatgggaatgggtacaagggcttagccaaattcagaaggccacatgagtgataaaactgaaggccagtgtctggtcctagactgccgtcgacttccccacgcacatgtgtcacacttacagccacggcagcgtggtagctggttccacagccaatcacgatgagccgtcggcatcgtcgaatctccttcaagtggtccttcaagccacccaggagcactgcagggcacacgacaaggcgttaatgctgagtctacacagtcaccgcattccctgagactaggctcgggcggaggctccccaccgagtgtaggaattacctgtgttggtttcaaaattcacccgacctctcatagtattgaaaactgattctggctgttcgaagatctccttctgcataaacgcactgaagttacctggtcaaataaacgtctggtcagttttaatttcattatatttcactgcttttcattatgcagcagcgatagtaactcctgtaaagcttactgcagattcccaaaggcatccccagggattaccctgcctgacactcactaccatcagagggaagcaggtcaggaaccaggactatctccaatttacatattggaccctgcagcttgagaaagggagggatttgcccaaggcatgcaagtaacaaatggcctggctgatccctctgggccatgctccctta

SEQ ID NO: 271 - DNA, 1738 bp, Homo sapiens
gtgttacccaggccggagtgcagtgactacttacaggcacgatcatagtgcactagagccttgaactcccgggctccagtattactcctgcctcagcctcctgagtatctgggactataggagtgcaccaccattcctggcataatcctctttttatgttgagttgaagaaagtcacaagacgtgagacgctttatgttgcagttaatggtctcttcctcccttttctctgttcctgcaaatggacaattattccttctcacaaggtttttggcttcccacttcagcatgcctccagcagtgttctaaaattactctacaattgccaaagtaagagcagcagatgctctaaatctatttccaggacacccgtctcatgatcaaggacaaatggggtccaaactccttggctgccagatgagcaaaactggagtaaagatgctgcgcaaaaggccaaaatgatgtcaaagcagtgtaaactgatacagatcaaagaacaggagtggaaaattgcaagcagggatatgtagcggctctgtatggcccaatgtgctcaaaactctccagaggttgttaatttcctggcaagatgaggttacatcatacagtctgtatttgcatatgtacccatacttgacagtgaaatatggtctaatacacaggttttattattattattatttaatttgaatattcacatttataggttccaaattcaggtcaccaaggataagggaatcaaagctctaaaaattatagaatatttgagcaatgcaataatgactggacaggcagctagatgcttagatggtttccactcaatgcagttgtctcagctacccacaatatattaccgctaggatttctttagctttaggaattgtcgataggcaattcttctgatctgcccataagaacatttttaaggggtcaaaggtgagcccatctcatggcaatacgataaccatgtaaattaggttcactgctagttttcagaaaagccattagtactttctacacaagtggatattaaaaatatctacaagaatattttattataaaataataaaaagtactaatgggacttctatatctatagattattggtaatctttgagcaatatcattgacaaattaattttcagtagcaaaactgaataaaactaagctcttttagctattctccaaaactcttatgacaaaaggattccaccatattgtacgctttagcatttgtaactcgtcaagaattgtttttatttctcaagtgtactacttgtatatagacacatatatgaccttattttatcacacatccaccttaaaaatacatagcaagtaaaagtagctcttaaagaaagtagctcttaaaagtagctctttagaaagcaacattgggtgcaggaactaagaggactggctggtgcttttcatcagtagtaggtggtggtggctaaggtttccactgtgggcacagcccaacacagccctatcaaactgactctgcagatcaccaaatggctaacattacactgaaaagtgtagggaaaatattgatttgtttattttctatgaattgagctaactttcctcactagtcttgttgttaaatagtggagaaaaaaaatttgaaaaaaaaataaaataaatttgaattcaatggagcaaatttggtctaatgcagtacaatactttttaaaatctgtctttgcaaattaaaataaaatactgttatcttg

SEQ ID NO: 272 - DNA, 5012 bp, Homo sapiens
aggtctcctaagcttgactcctcttcggcatgagactaaggaagctccccaagttccagtcagagcaggcttatggaagagtcttgccctaacagaaaaacagggatgaggctgggaagaggataaagttatagcaggataaagttataagaagataacaaagcaggatgacatcacatgggaccaagaagggggctgcatcatccctggacctgctcctgggggctgtcggattgtgggcgtggccgctttggatgcccaggtgagccctgacacagaggtgcttcctcacattacagtgaggagaggatggggccagtacaaagactgaagaaccagcactcctcctgggtccgtctttgctaagttgagtcatcccagcccaggctcagatgatgggcactgtggacggagagagacctgtcttccagcaggcttctgtgtgcgtggctgctgcagtttctgagggctgacccagttttctcatctctggactttataccttctttgtccctaaatagaccacaacaccactctgtgttctctgcaagcctggggctaggaagcatcgctgaggtaaaggccttttttaaggttctctgccaataacaaacacgtcttcaattatgagagcagtactccatgatcctgaatctctgccaaccaaaagaaagctgtgcacacactgctgaacttttacaactctacaactcagaggacataaggcatgtgtaagccagctgtaaatctcgttgacagtcttgccccacccactggccactaggcagctggatttccaatttcaccccggacacggccagcctatcaaccctctctgcttaatgctctcagttcatttctcatcatttttctacctccactcaccaggccacttaccctcccttcctccttccagcttcctgagccctacagagataacaactagcagagtgcaccagcacgtacattggattatccttttcattgtgtctgagccaatctgcttaatgttcagatacacgtggggaaaaaaaggcaaaatatttttgttttagatcctttcagaaggcacaaaaaaataaagtacaaacacgaatcacttgacaattttatgattaaaaccaacaaatggaaaacagacagtgttgggtgttgctgacataatcaagcatttcgtgcggacccactcaaccaccccatttcttggatctatttctggatgtaccaaatgtgtctgaagatgaactcactttcgcacatcaaagatgtatccagtgttaaacaccggagccagaacccaggtgaaaatctgctggttcagggcaacaccacttccggctttattaaacactcaaaagtcaggttcccaagaaacgcttggatctatgcgcaagtataacatgtcaaaactgttaaatgtgaccatgagaaaaatgacatgagcatgtttcatctttgggtagagggtggtggttttctgggaagacactgtctgagacaccgagtagagaagtcaaatggaagacgtttagcatgtgcttaattcttgcttgataagaacaagaaatcccggaaaaggtcacccacagaacggtaagcaaagtccccagtgaacaagtttgaggtggggcttagcagtttgtttacagttgtggaaaactgttttagtcacttggccaaaaaccatatgaggggaggcaacctgaaaccctagactacttgactctccctgcatttttctgctagaagcaggataaaaggcctaaaattttggctgcatctctatttatgtaacagccacagctgctccccaaaatagctgctgttggccaaaagaattacgggattttgttgctaatatgtgaatctatagtcaatagcactctgctaagtttccttcccttcccttttgccgtcccaggtctaaaaggagatagggaatctcattatttgcacatcaatggtgccatcagttggatgtggatagattttaaaatcgaggctcatcttttcggcaagagcaaattgacatagaacatcttaactctccaccttctgcaggcggcagtgtggctaatattgaggcccttcaaagtcacaactccaaaagagaggaacatacagtgctcctgtgattttgtgggacaaacccagacccggactgctggcgtggcatttaataggatgccctcccctgaaagtaacaaagagaaccctcgtcaaagctatcaaacacattaaaaaaatacaaaagttattttctccttttgattgctatttacttgtgacaatatttgttaaaaatatcacttctgtctttgagaagagatcattctcttcatatagtatggaaaaataaactctgctgaacactcagtcaacattccccaccactgccaggggcttttggctttcacatctccaaataccatcatcagcataaaagtattatgtttttgagtaggcaaacacttttgctatgtctagtgtgctggaagtaagagaaaaaggaagtggcaaggctcatgtagcattttgaagggggagagttacaaaataggatggtttatttgctaacaaaatgaaaggtaacaaggtggtttcaggccttcctaaaaagtcataggatgtcccctcacctcttagaccactttcagccttgctaatgcttggtagattcttaatggaagggtagggagccctataggctaattatcagtgtcaatgcaaaggagggctcaacttctgcacccaggatcatcttaaaacactgagctggatgaatgggagaagacaaggatccataaaaacagtaaaatgtttattttcttagaaaaaaaagtgaggaagagggattcaaaatgattgtgatcacacttccatctgcatctgagcaaagccaatgttgcaagcttaattcttgattaagatacctattaaatcaaacaacctgccactcactcctacgtcacttccaggagtcacatcacagcatgcttttaattgataatagcttctctacttcttctgagcagagaaacaaggcttggcatagcaaccatcccatctccaaagctcaacactgccagtgagaagcaaggctcagtccatctctagactgcgtgcgagagatggggaggaaggagagagggcaggagatgcttgtcttagaagcagaaccagtttagaagagaagtttgttatctgagttcaccactacctcatcttatagaaaataggttggagagcatctgtaaaaccaacagtatctttaaggtgaaattgcagaattttgctgcatacctggacacaagagaagtgaaaagttgcaacaagttttaactagcagcaacaaagaaagttcgataacagttttttttgtttgtttttagcaatattcctttgcaagttcattaagaaacactgtaatttaatggggcgtacaatatggaacgatcttcttttgctatagtgctgttcgctgaatagaaccgacctttgcaaagatttcaactggggtgtaacctatttacacagtagtagctcctggtttgagtggtaaaattggtgctatgtgatatcctcttcttccgaacagtaatcccgacccttggagggaaaaagaaaaaagagcatgtgaatgagaaattcaaagcagagcctgaaatagttacttgtaatcaattttctctcaatatatgtctccttgcaacagaatccaggctttgtcagtgatagctggcacaggggtagctacgtcataaatacatgttagccaatttataagctatatatacttcaaggcatgacagttttaccaagccccaaataagcccttactttatgttggtaagaatttatattataacagccatattcaagagtcagcctttcactaagaaattaccaaatggccaatccattcaggagatcaatttcttatcaggaagaatgaacaagccacattctacagctacatccccgtgcctgaaaatcaacattctacagacagcatacaatccagggatgtctgagtttaattcactctaaaacggattacaaaaaacaacaaacaagaatccttaaacacgcataacaggtctgtgcttggtatgtgtgggatgcacaagaaaggcaaagatgcttctgattcatttgctaactaaaacaggttatctgaagctctaaggactatgtacaatggttatttgtgaacatattttatcctctctcctctaggtcataaactcaatgaagacatgattggggctgggctttaaggatccacatttaaccgagctggcttgtcttggtcaaaacacatgactctcttggtctgtaacccatcacagggcacctgccctgcctgtgtccgatgtcatagataagggttttgtaaaaagtcaggtgttattattatttgtttccttcaactttttctttttcttttaaaatacacactacatgtttcatttttcttggggggggggaatgttcttttaaaagcagaacttatttctaaaagtaccaatacttaacgatactaataataattttgcatataactatttctcagatgtattacatgttttttggtcacattatctatataacagaaatattttacattttcctaatatttaagcattatcaaaatggattattttgtgccacgtggctgggtgctaatcttgactctgtgacttcctagctctgggatcctggtaaaattacctctctgtgtctcagtttcttcatctgtaaaatgaagagaacaatagtacctatttcacagaatagttgaagattaaatgagttaatagtaataaagtgattaaatcatttctggcacatacttttacacatgatgtatatgtgcccatgcccgtgtgtgtttggcaaattacaaaatactgctggctggacacggtggctcacgcctgtaatcccgcactttgggaggccgaggcaggtggatcacctgaggtcaggaatttgaggccagcctgacc

SEQ ID NO: 273 - DNA, 2011 bp, Homo sapiens
caggaagcaagagagagagacagaggggaggtaacaggctccttttagccatcagctctcatgggaattgacagaacgagaattcactcacccccacccacctcctggaggggattaatctattcatgagggatccacccccatgacccaaacacctcccattaggcctcacctccaacactggagatcagactccaacattagatttggaagggacaagcatccaagctgtagcatggttccaggttggaaatcattttcccttcaacattcgaaggcagtgcactcagtgttgctgttgagaaatctgaagccgtgcagattcccatctccgggttgtatctgtttgctcgggatgccataacaaaggaccacagactggggggtttaaacagcagaagtttactttctcacagtactggaggctggaagtctgaggtcaaggtgctggcggtgtcggtttctcctgagccctctctcttttgccggggctgttctgcttgctggattggaaatgattttagcccctcatgccaggaagaaaacataggcagatttctcaccagctaaaaaggaaggaaaaattgtgaagtgaaattttctactggctgtggtttatccatgttaaattgtaaagcatataacacagatggaatccggcacatgcaaaacactcacaaaacctagttactactactgctggcgctgcggctacacgactacaactactactacagccactactctcctcctactgctactgctgctgctgctagtgtttcgtaaagtggagctacagaaatcaacattttttttcttagctgcacagtgaattcgttttttggactccagtattcttcctgaaggtctgtttcatcctagtatgactctcacttttttttcaaaattttattttattttatttttgaaatggagcctcactctgttgcccaggctggagtgcagtggcgtgatctcggctcactacaacctccgcctctgggttcaagagattctcctgcctcggcctactgagtagctgggattacaggcacgcgccaccacgcccagctaatttttgtattttcagaagagatggggtttcaccatgttggccaggagggtctcaatctcctgacctcatgatccgcctgcctcggcttcccaaagtgctgggattgcaggcgtgagccaccatgcctctacattttaattttttaaaacttaccatctttatcatttttaagtgtacagttaagtggtaataaatacatatgtatctcctatctcatttccttattttcatcccccatcccatttctggactctggctaatagcagtctactcggtatcatcacgagatccacgtttttagtttccacatatgaatgagaacatgcgatatttgtctttctgtgcttggcttatttcacttaacataatggcctctggttccatccatgctgctgcaagtgacaggatttcactctttttatagctgaataatattccattgtgtaaatataacacatttcctttattcatctgttgatgggtacttacgttgattctatattttgaatagtgctgcagtaaacatgggagggagatatctctttaatatactgatttcctttcttttgagtatatacccagcagtgaaattgctagaccaaatggtagttctatttttagtttttttgcagaacctccatactgttctaatttacattcccaccaacagcgtatgaggattcccctttctccacatcttcgccagatctgttatcgcctgcctttatttacttatttttatttttaattcttgtgggtacgtagtaggtatatatgggatacattagctgttttgatatagacatgcaatctgtaataatcatatcatggaaaatggggtatccgtcccctcaagcatttattctttgtgttaccaacaattcaattatactctttcagttattttgaaatgtataattaaattattattgatgt

SEQ ID NO: 274 - DNA, 2313 bp, Homo sapiens
tctctggtaaatatttcattaggggagatgcggatgcagcagggctgatcctgtctaagcctcctcttgtctcccctcgcccactggattcccaagtggctcctccaaagaagtcccacctctctctcctaccccaccctgccctccctcaggctgctctcctgggtgacgctgtgctccaacattcatggcctgacagctattgcacatgttcctgtgtggcctctgggtcatcaggtatgtgttgggaagtggggatttgtctcttgctcaaaccacgaggaccctgggaggaagaatggcctactttcttcctttcctaaggtcactcacatggtacgggagggggtgatcctaaaagcataggaccatctccattatttctcagctctcccactccactccctgctctgagcttctatatgctagtcctgcctggtggtggcggtggtggtggtggtggtggtgtgtgtgtgtgtgtgagagagagagagagagagagagagaaagagggagaaaaagccatcacagcattctgacccaggcagaagagaagagaggagaaagcaagtcccggtaggaggaggtaggaaccactataaccaaagccagcaggcaaccaggctcagcctctggaatgctgcagcctgaaatgacaggaaacagaaatgggggaactcacagagctccacgcgccctgctcagccccggccatgcccagccctatgctgctcagaggaaggcactcaaaggacacaatgcctccagctcacggaaagccccaccccaccttctccctctccccatggacataggctcattcatgtggggtagggactggaaggggtgtggactccaccgtgacatttaccgaagacatgaactcagcgaacattgtaatttgctgattaaaaatttaatccccatcttaaggtcagaaaaccgggtacgaagaagttggcagaaattggggctggtgggtggggaagagtggagcaagtcagtctgcgttagctgaggggaggggtttgtcaggctggtggggtttgggggcagagtgtagggggaaattgaggaggacccaggagcccgctggcagggataaggatgggggcaggacacatcttcctaagggagctgggtggggtagatactcccagtctattcccagttgcaggagacagaaagagtccggacttcagagtgagatggacctgggctagcatctggctgtgtggccctggggacgagagccctgcccaatacagagtgatctaataccagccacttggatagatgcatttcgtttcttccatcctaggatttctggagaggcagcttgggaaggccaggtgtggataacatgtgtaaagattcattctcattgtagatcttagcaacctcagcatacagattttttttttctatccttaagtcaaaaacttttaccttttcacttaaaggaagaactttccagcttattcaacattaatatacagtatattcaaattgccatgatcactgctactgcactttagggcaattattaagtaaaataagggttacttgacacaagcattgtgatacctcaacagttgatcggataacctagagggctcctaagtgacctgagagccagtagtggatacactggacaaaggatgattcacatcctgggcaggatggagtgggatggtgagatacttcatcgggctactcagaatggtgcacaatttaaaacttgtgaattatttctggacgttttctttctcttttttttttttttgagatggagtctcgccctgttgcccagactggagtgcagtggcaccatcttcgctcactacaacctctgcctcctgggttcaagcaattctcctgcctcagccttccgagtagctgggactacaggtgtgtgccactatgcctggctaatttttttgtattttagtagagacgggcatttcaccatactggccagactggtctcgaactcctgacctcgtgatccacctgccttggcctcccaaagtgctgggattacaggcatgagccactgtgcccggcctggacgttttcatttaatatttttcgactgtggttgtaactgaaaccatgatagtaattttcactttcggaaagtgaaactgcagataagcaggggagacatatttagtcatgtattacaccatttttttctgttttatatattggggttctgcatgaaattgaagtttgaattttcctttgctctcccattatctcgcttgatctcacaaaagccctgcataatcaagatattagtattattcc

SEQ ID NO: 275 - DNA, 18420 bp, Homo sapiens
agctcctgcaaaggggcccagaatggtggggaagcagaacttctgcctccaactcactttctcaccgtgcaactgcggatccagaggaatctctgcatgtgaggctctgccaggttggggaggagtgtgcgctcaacatctctctccactttttaccattgcaacagcttttcttagctctggggtccaggagtgtgtctcagccttagtcctgaattctgggacatgcacgatggtattcttgcctgtggagagctgctagttgaatttctgtggtggtgagtgatgtcagtgaagtcccattctggtttctctctgatgtcacactgagagcacagttttggtgagaagattatctttgtgtaaaagcaaagaagagaggaaagaacctgcgtttctcctctgcactatccgctgcgtttttctgtagaattgggtgtgccatttgcaagagctgtgtgtgtgcagcagagcaggcagccaaccaatccttgcggttcagtgtgagttgggagggagaaagcgcaaaccactaagtgtagacaacacgcagggagttcatttgggaagtttagcgagtggtgtccaaagcagagttgctccctcagcactatgggcagtttgggccacacaattctttgttgttggggagagaaggctgtcctgtgccttgtaggaggtttggcagcatccctggcctggacaccccatgacagtggcaacccctcccctagcggtgacaaacataaaggtctctagatgttgctaaatgtcctctggtgggggtgggaagggcattgccctgtgtgaggaccgctggtagagactgttgcagggttcagaaaagagatttttgtttttcagttgggacatacatgatcagtcttggggaaggaagcagaagcaatggtggaataggacaaagataaaggaaagaggtggaaagtgatgaacacagaccgcgatgacccggtgtggggtgatatgggcgaggacagcatccagcgaagaggtcctggctcctgactgcaatttggtggctctactgtaccctgtgcaacgggtataggttggtgcttattttctctccatgtggtcagaagtctcatcttcaaagtgcttaagctgtagcccttgccctgtcacctctggttattgctgggacctgggtcacactcctggttcatctgctggccccaggccgggtgaggctcccatgtgcctgctggcctgagaaaggcttatgtgagtcacgggctactaggggcagagagaagggaacaggatggagaaattaagtgaggaataagattgtagaaagccaggaagaagccgaaaggggacttggctctggcagcattttgttttgcatcagtctgtgctggaataagctgtcgaaaggttgtctacccattgccccctggtaccttgtgctgtgctcattgttggcaaaacacttgaatgattgtggcctaaatgtgcagtgataaaagacagaacatagctttgttatttttctaaccagaataggagagtggcttttggaatcaagatttaaaattcagccttatcctcatgatttgcttgtgttttggcttgtattttggcttgtgcttgaaatgacaagaaggatcaagggtttaaatgtgatcttgagaagacatgagagagagaattgatattttcctatctaatatttatattactttcctgtatagagtaggctaaggattttatttggacgctaattgtatgtaattcctatagcagttattttgattaagccaactagatttacctctaattattcattttaagccctagatttaaagataactttttattctctgtaaacaacctaaaagttgccttagatttatttcataatatgtaaaaatgctgaaaaagggctagtttggctggagagacattttaatttttccctttaattttaaatgacaatagtgtgtgtataggagctgcgtttcctaccgaatattcacctggtgtggagactgaataacatgccactctaagggttaataaaagcattaaataacttgcatctgggaaacatcaattgaatagataattgcttctttgtgtttctgcttagtagtggctggacatgtaaagtttctataccacaaaatgaaaacagatgagcaaacaagaggcccggggtcacataaccgatgcgtgctcaaagctcgaagcagcgtcaatcaaacctggagggtaccatgtcgagagatggtatctttccattaatcaggaattggtacccgggtgatagacggcctctgtaatgaaaacctcagttagcaaacagccagaagagagagaaaataatccaaccagccaaataatcaaagaacacatgaggtgtctgtagggagatttccacagtgggaaacccatagaaaaagttctgtctctcactcttgtttttgttttttggttttggatacaatttcatttaagtagaaagatcatccatgattttctcaatcttccttatgtcttttatgcactatacttgccaaagtagcatagacagaaaaaaagcaggaatcctatggatttccacccttagtccttcaactaactttaaaataacttttaattttcttattcaggtctacattctaagtcacactcccctcccacatgtctttgcctgctattttacttcattaatatttaccagcttttctgaatttagacacctaattttgtattttcatgtatttctctgcatatccttcagatccttattttcctcaatattcatgtaaaatatataaactataatttctgtgttcttttaagagatagcaagtacctaaacaaaggggtgttctcccgtgatttttttaactcagcattttttgccagaaatggtcatttgggatttattcccacgcccttgtgtttttccctccccctcccctttccctcccttccctccctttatctttttctctctcccttcctcctgcccacccaccctacatttttccctccctcccttcttgctccctccctctctttcttcctccctcccaccctcctttccttcttttcctctctttctttgtcctttcttctcttccctcctcctttccacccttttcctttcaccactatttattgagtgcttattgcacaagagactttgagtgtccagtgctggcttgtggcaggacaagctgcagacaaaacccctcagacaccgagttgtagaagaaagggctttattcggctgggagcttcagcaagactcacgtctccaacaaccgacctccccaaatgagcaattcctgtcccttttaagggctcacaactctaagggggtccgcgtgagaggatcgtgatcgactgagcaagctgagggttcatgactgggggctgcatgcactggtagttagaacggagaagaacaggacagggattttcacagtgcttttccatacaatatctgtaatctatagttaacctgaccgattaggtcaggggtcgatctttaactaccaggcccagggtgtggcactgggctgtctgcctgtggatttcatttctgccttttagtttttacttcttatttctttggaggcagaaattgcgcataagacgatatgagtagtggtctcctcccttagctaaggactctgactcctccttctgtggggctccatgtattctttctcattggcaacactgggaatagcagggcccagttgagtttggagagtgttgcttagtgctctttagttgcaaccatctgaaaataacatgaaaagaaaggggaatttcctgaaaaatgttggtggtagcaatgagagcaaggctcaaagaataaactggaagctgagaaactaggcttgaaaatagaaatcaaagggactggggaagcaaggaccctgcattcgtctctgggcaggaagggttcgctcagcgcactggtgctgcgataaatatcatgtgcctctgctgttctctcatcacggatcaagagtccaagcctggagggagagcgactgacagccatggtctggtcacacgcctgcctgagagctgcacgggagccggcgaggaaaagcccttgctgcttccagtgtaaggcaggtgtctggatttttcttcaagagagccaacacgatgaatgaaggaacttaaatcatggcacggttagaaagaaaagtagcaagacaggaactactccttccctccaaacaaaaagaaaaacaaaatgagatattcactgtaattaatatgaatttgcaagggaaataatgcagtatatgatctcagtctcaacttatatctttatttcaactatatctacttcagaaaggatttgaagggtttccaataaaagacaaataaaatgttataaatggtagataaatgaagatcaaatatgaccctggtagaggtatgagaattttgtctgtcttgttcaagagctacactggctgcacctgatatagtagatgctcaataagtatcattaccttctgccaggtccctcccaggacacatggggattatgggaactacaattcaagatgagatttgattagggacacagccaaaccatatcagtattatattttattgcaactattggctcaataggtgcactatgtatttttgttcaaagttattgctcaagcgtttaccgtgtatattgttaacttatcacagtttattcttaagtactattatatcatctcccaagtaatataaaaatcttacagcagtcctggcttttcgtggttcttatatgcaggaatttttgttactgtgctttggttagataacatatataattccttcatggacacagtgcaaatttcactttccacagtgtattaactatgtgtaatttcattcagtacaaattttgatgctggtttttagtacaaaaattagtaagtatttaatggacaagcatgatgatcagtgagcaatcatgctgtctctgtgaaagtgtgctggttatttgtcgctgtgtacctgtgcgtctgtatgaatttagtttagacagatatcaaggtgtgtagttgtgtaaactacttgtcctccagtcataaactcacataatttaacttttaaagcaccatcactgttggataagtgtccaggtcacctttattcatttggatacctccatgaagatgttaaaaagccgctttttactaacaaatacaactttaatcgtccagctagtggaccaaggagttatttcaatgtttaaagcctactgtcttagacaaacttttcaacagactactgaagctacaactggagatcatgcaatttttaagcgaagttttgaaagatatattacttaaaaatgcagttgaaatacttaagcatcatggcggcaaagaaagtgagtaatatgtgtgtgcagtacagcagaaacttgtattgctctgtgaaaataacatgcaggataccaacagaatgcaagtggagctattggctcattttgctcctgcttgtgcagaacttttcatgtcaggccatctcctgggctactggtgagtttatggatcggcccagctgtagtctatcctgttgttcctgaagtggggtggaggtcagccagcagcctgcaaaaatgttagaaaataagagtcaagcaggacttctgatgcccccagatcatgttattgttatgatcagccatccacagcaagtgtcttatttgcattatatccgatgatagtgatggatctgcattgctgtttgcctcttgtaacccacagtgtgagaatgcaaaatccagggttaggagtgcagtcagtggcagtgtgactaggtgtttctctgtaggatactaagaaaaatacagcccaggaaactgttagtgctttcattttgtttcactataggtctgcctggatgatcaaaacagatgggaaggagccatggtggggcaatgatcctgttctgttgcctcctggagattcaagcattatatatggagagctatcatctctacccctcctcccggtttactctcatggtgagctcaggtagagtttagcagggatgttcatgtgaatatcgtctgtgttcgtgaataggctcgtatttcagttgcaagcaacatgataaccttaaagttcagttgctggttaataactgtcttttttattaagttgatactgaacttgatgtctttttgcagtactaacagagattactggtgctaccttttagcttttgatcatttatgcaagcctagatctttagctttacgttgtaaaaggggtatttttttcaacatttttttggtgagagtattaaagttgacattattatgatcacaagtgtaaacaggtatataaggaagtggcgatacattgttaagactgctgttattcatgatgcttagccaaatggaggtgcaattaatactgccatgtagaactggaataacgtcagctcaggaacagcaagtttagatagtttgactgtagtgaattttcatgaatggaatagttaatcattttagtggatcttgggggtcaattcaggctgttttacttgatccacttcttatcattatcctaacaaagtcttctgagataacacagcactgatagttgctaacagactttatatctaccacgttattagcattttatcttgatacactgataaaataagcttcaggaatacttaaaagattgcaatggcttccagctgccaaatgctagatttaattattttttaggaccaacatgagggtttagacacaccacttgtggtgcagcacacatgtattatccaaactgaaattagcaattcaactgaagtccatgtagagtcgaaaaatgtgaatatttggagatgatctagctcactttattttgtagaaaagaaaacagattcagggaaagggcatgcattgcctaaggtgattcagcaggtttggagcagaaatgcaatacaatctctgttcttttgcttctcagatccagaattttttcacagtactgaactacttatgtttctgattccttattttttctgttttatattttgccaatattgtcttaccaagatcctattctttaccccaaatatttaaattcattaccactattgtctctttataagtaaaagtactagttgttattataaatgattattcgatcacttttcatttttttttgggtccagcacaaagttagtaacaaataaacattataggccttggcaatccaaggggagctcaagtcctccagggcacgtcaggaaaaggctaaacgacagctgagcttcgagtggacagaatacagctctcatacggactgttgagtatttgatgttcttcaacaatttcattcatcttcagttttttcctctttgaagtgatggatttagtccttgctatactcgactttcaagtttcttttgaaataattatagattcacaggaagttgcaaaaggtacagggatgtcttaggtactcttcactaattctcccaacggtgacatctcgcatagccatagagcatatcaaaacctggaaactgacataggtacaattcagaaagcttgctcagatcacaaccattttgtacacatttgtttttgtatgtatgtgtgtgtgtatttgtgtgcatgtgttctgtgcatttttatctcgtgtagatctctgtaactacaacctcgacagtcaagatacagaactgtagcctcaccgccaggctccaacttgcaatctttgtggacactctgacacattttcctccatcccttccccttggcaaccccatagtctgttctccatctttacaattttatttctataattcatataaatgtaattgtacaaaatcgtatttttgaagggaagaaacaagtcacagatatttttgttagcactgcaaaataatctttaatgctaatttattctatgttctatttgtctcaaaaaatgtgctttgttctttcccatattttctgatatcaggataggaaatcaatagcaaacaaaacataattccattcatttttttccacagcttgtttctcactgctgtttcctaacggttattgttccatttactctttctctctgttttccatcacataaaagtaactttgtgttccttatctcttctaagaaaacttggtaatgagtctttaattgaagcccagaccacccttgttttgattttgtgttatgggtgttcttttttgtgatcgctttcatggagagtccttgtgaagctgggcttttccaatggtttgtcaaaatggaaatagatatttaacaaaccaaacacaaaatgaccttgctccaggaatgcatcatttctgagaaaacactacctcttccaactagagattgtgaatattactcatattatcctttactcccttttattaaaactgtattttttttacacatttgtataactcgggtaatgaaatgtgaaactaagtgattgcctaccaattacaattgatattaacgatgctagtgagaggccacctctacagtggctgcgccgtgtctagggacttgctagctttgctaagttacatgggattgcctgcgtactaaatgcaaacttactcatgtacataggaaaccatttgtattaatatgattaagaagccctgcctaaccctgatgaaaaattacttgaaaataacagaagacagagtccttattttaaagtacattaactattgggagtaattactattagtccaaccataactggatctaatgagactgaatagaaacaaattagacataattggaagctaagcaaaagtcaattaaattcctataattttacctttataaaaattattgaattaaatgacccggatcaattagcagaggaaataaagccatgaagaatatttccaggaaactattaccttttttgagggaaaaatattgtttcacttaatgattagagtttagtaaaatgtagcttaatgaattttgctgccttagcagtttaataacttcaaatgaagtaattatgcaaattttttgatagttttacctacaaagtaatgcaggagttgttttaaggaatccaggagtagaatttatttgatagaataaaataacatatttataaaaatcagcaaattcagatggtttggaataaagatatgattgcttttactcaatgttcactttagggctgggtcagctgtgtgggaattgcagttgacctgttgtagaaattgtgtgcttggaaatatatcaccacattgctccatgtagactccctctgtgattcaagtcttgttcctacagcactgctgtcaaccctcaaccaccgtcaccctatagaccccaagtcagtttgtattcagtaatgcaagtggtgttctgtgcaactggtcacccaagaacttggtgctaagaaactgagaaagtgatgaccaagacaatctcatcaaaacacagccagggccagtcacagtatcgtaatttctgctttctggatgttcaaggaaatgtagatcatggctccttctgtgatgcctcattatcttcaaaaggagctataagcgtacactcatttccaaatgtgatggaataagatcgcagtttcaatgaggtcctgaaggataattaattatataatagttatcaaaatattaattctgtaaggacagtcacaaaggaaagaacagtggcaaataggtctcaggaaatacatcaaatgggatgttcaggtgtgatgcagcttcgtacatactatgctaaatacattatgtctgtaattaaaccagctgcatacacaatgcaggtgtggcaaattctttgctgaaacatgtatgccagtttcctcattttttaaaatgacaagtgcatgcttaatcaggttagagtggatagattatgatattatcaatgcactggacaaatccattaatgatacagtgagattttgtgcagaaaaatggaatagagaggtgtgaatccaaactttgaagaataaagaacatacatttgtaattaggaaatatctctcactttcatcccttatgtgccacacatagcacaatccagccccacccagccatgactcttacatttatcactcctgacaaagccggcctggcaattcagacccggagcccggagaaaaaagaggaatcccatgatttctggcaaacactgctgcttcttttgtagtggtgtgagatgaatgcctctacatgcacacaagtgccatgttgagggggatgaatctttcaagatttgtttaaagtcaaataatgtgaaggtccatgactgacctccaggcctctcagagcttcagttaactcctttgtgttaggggatgttagaagaacgtttacaagtcagagcaggtgatgctcaggagcaagagtgaatgaggaggaggaacccaaacaggtccagcacagaacatcagcatctgagcatgaagtctacccctgagaaaaagtggtccaaaggtttgtgtgaaccccattctccaggccttacaaaccctgtgatttctgcctcattctgtcccgtcctgtcactttgagtctgaattggaagagagaaaaacagtaactagattagtaaagtaaggaggagtgaagagcaggaaggtggaggtcgtggtggtggaagatggaaacctctgcgagtgaaatagaacagtttggatgtcagctgtgactgctctagatctcctaaaacccactccatttttattaaaaatatacattgcatttttccagtgtacacgatatcatgttaagagttcataaagttttgaggatgtgagtcatcagaaaggaggtttaaagaaccgattattttggtggtctgactcctttaccccagtaggaaaagctgccattttgcttatgccctgtgctgaatctcagaatgcctgtcaacccaacacgcttcagcatgaactttaactcaaaaaatcaaaaagtaccaggatcaatttacaatcctagctatatgatattttagaaattacaaagcctgtaaatgagctattttgtcaacttcatagatgagaaatctaagagtgggttagtaagttctcttagatttctcatatccataaagtggatagaacatctaatttagaggcttgttgaaggacagacagaaatggcatttataaagtatctagtgaaactactgctagggattatatgctcagtaaatgatgagcactataatcacaaataatttgatctttgccagtgtaaaatgtatttgtctgtctgcttggtttttctcggaggcatagtttccctctgtcactcaggctggagtgcagtgctgtgctcactgcaacctctgcctcccaggttcaagtgattctcctgcctcagctgggattgcaggagcccgccaccatggcccaactaatttttgagtttttactagagatgggatttcaccatgttacccaggatggccttgaactcttggcctcaagcgatccatccaccttggcctccgaaagtgctgggattacaggcgtgagccactatgcccggccacatttatgttaattcagagaacaatttttcagtaaggttgtacaaatgattgtcctacattcctgcatgtttgaaactctttttctcttttcatctccatatgtgaatgacagtttggctaggtatagaatgcttggtttacactttttattgttcataaatctatagtcttatctttgtttctatcctctataccagcttgagtaggattaagtgtgggattcactataaaactctatacccactgaacaagtcctcttttccccctccgctagtccctggcacctgtcattttacgtctctgtttctaagagtttgactactttaaaaacctcatataagaaggatcatgcagcactgtgtttgtatttttgtgactggtttatttcacttagtatagtatccccaaggtttatctatgttatgacatatgacacgatttctttcttttttaaggctgaataataatttattgtgtatataccactttttaaaatccattcatctcttgacagatatttaggttgcttttacctcttggctattatgaataatgctgcaatgaacatgagatgaacaagctccttttttatctctttacttttgttagaagcttttaattcctgattaatgagttctgaatgtatgcagaggtctctacctggcagtgacctaaaagccttgtcttctgccaccctgctcagccttcagattcaagtctctagattcttgaggttgggaaatgtttccggagcagccatggttttgcattcattggccattcaggttttctgctttgccgtttcccccccattcaggttttctgctttgccatttccccgggggtttccttaccctcttggaagaacaaccatgcattaagtccatgttgactgtattttacctgctgtttctatgtgttttgcaataagggcttttcaaaatacccataacttgtggctaaaaatgaggtttgttccaatgtgccttagaaagatccagtttcatacttacctggcagggcagataccatgatcttaaaggcagttttcccagggcaaggcttatccattccactctggatccattataggggcatgctgatccctggaattgccccaaatgtgggaagctctactgcaaaatttttggtagtgagcgatggcattatgcattcatgtacgaattcaactgagtatccagtttcatacaaataataataacatcttctataaaatgtattcttgtgtattaacacatggggctctgtagtactccagctgagatatatgggaatcttaccctagttttgccattttctcctaacatcagtctacttcttttaatattcattgcttctccccatttctgtagttcagtgcatgttcctttcctctgcaggaactacttctctttcctcacccaactcataaatctctgcctcccaccctaagggtaggcacatgacccaacctgggagatcagaatgccacacccccaatacaggattggtttgtgagtaggcagatgattctgtccatgcacagaactaagtagaagagagtttttacacctcagcttagcttgatgctagcagagagctactggagttctatttcctcctctagggaagaaaaggattttggtttggagataaagccaagataccaagaaagtgggaatgaaagacttagagacagggagtcctggccccttttcagatgctcagatgctggcactagcttgaggcccagtcctgcttctgctcttcccaacagccccttttcagatgttggcactagcttgaggcccagctctacttctgctcttctcaacatttggtaaggggagctcccaatttcttttctaagatagctggtttgacttggatatccatctcttctaatcaagggtcctgattccttgtcattgtcatcaaaaaaatatttgtaaatatttcacttctcgctggtgttgaacaaagtgatttgcacagatacaatctctgcatcttaatagcttacattctaagagctgtacacctggcactctttctctggaactataactgctaagttcacgaatctttattaataatgcttttcagatatatagttaaaaaataattttaatagttgaaaggcatccatctttccaagaggttcagacatactgcaattgagtgctaagtaacttttattttgtattttttaatatttgtatttccataggttattggggaacaagtggtactcaagatggatgaaggacttaaatccaagacaagaaactataaaaattctaaaagacaacattggaaaaactcttctagacattggcttaggcaaggatttcacgaacaagaacccataagcaaacgcaataagaacaaaaataaatagctgggacctaatcaaactaaagagcttttgcacagcaaaaggaacagtcagcagagtaaacagacaacacacagagtgggagaaaatcttcacaatctatacatctgacaaaggactgatatccagaatctacaatggactcaaacaaattagcaagaaacaaataatcccatcaaaaagtgggctaaggacatgaatagacttttaggtatttgtgtgtgcagacctcttggtgtcaaggctaaactgttcctttctctgacacatgggaaattgatgcacaataccttgcagtgtataattccaggcccctaggcactggagactgggttatcttttcactcaactgacagttgatacattgtttgcactgaaaaatctggctttgttgaaccacaccagtttatgtttttaattccaaatcttaccttgttatgaactatttttttgtcctttcctctagagaaatgctaatgctgcttgcttacatggaaagtaaagttaaggagttggtgttgacattttggcttgctgtcacaggcaaaaaagaatagtgctgtttttgtgtgtttaattttctttcactttccccactctgtgtattggaggatgcctttagcaataagtagtccttatccaggtcactcactcattaaccgccaaccactgacagtaatgtctttactagatattttgcttcttttgattaatttgtctctatttcctttgttctaaagcctatagtgagtaatcatatttggagtaatagcagagctccctgctgtgttttcatttgcttaaatcaagacttagctgctgtattgaggaaccaagactgagatgtggggctaggagggcctagggtctgtcaggcactcttcagtgacttgaggtgctgaatgactcacactgtactgggagatgaccacctgtgtgcatccaacacagtcacagatagtgccattgagccaccaggagcagccacagaccatcagtggttgtgctttggaatacgcaattttgtgtttctggtgagctgtaatcttttcttttcccatagaattatttttcattgaattatgctattaaaactcatctttgggtttcttgtaacgtcattgccgagaacgttatttttgcatttcacagtgatttcttgaggaggaagtaagaagtaattgttttctggactcactgtctgaaaaacttgcactttactgaagcgattgttttgtttacactaagtaacaatatgagttttgttagctttttggatggactacaaagcataaaaccaactttgttcctcatctctggcaaagatggagggttgttggcttgtgttgtgtgatgagtcttatacctggctctgtctgctcttgccttttgccttacatttcaaagacctcacttttttcttttctttttttaaaaaatattttatcacatgattttctatacattttaataaaatttcttttttgtaaaaaaagcaaagcataaataaaatagggtagccatttcttctaaggttatgttgaatctaacccaaactcttatcagagaaaactctgctttagatgtagcctaaagcaggaagcaacaaacctgtatacagccaaagtatcatctcaagggcctgcattcaaatctcacacatgtggcttgaaagtgatctcttttgcccttatttcaaggcctaatcttaggttacatagtacttaaagaagcttcagtatgcaatttcaaagcctgtagtagatgtaaaatgagaaaattagaaataaggagaaaagctgctacatgaggacactgacagcaaggaaagggagagaaaaactcacaaagtaagtggaaaaatagaccaatgcaaataaccccacatagtttaacagacctcatcatatctattgtgtacatgtttgtatgacatagattatatctattatatgtaatccagtgttcatagtgttgacttagaaattatcaaccaaattcaaagcttttaggctttgaaaattgtttgaaaagattttcacccaaaatatttaaattattaaaaaaaattattgttgattaaagttgtaatcctcaattaattagaagttttggctatccagagaccttatattccaaagactttagagagttgtttgttagatcacataaattattaccaatatcctacatttaagcttctaatttacgtaaattgtgagcaaaattgagagccacacaaatattcaatctctgaagctcttatggcagcattgatcaaataggttagagaacacatggatacagctttattgccttctagttttactgcaaacgtgttatttaatagtatgcaaatgattggctagatgtacagactgccagggccttcatagcaaacaggttttgtgtttaccctagcatacaaaaatgcttcatctacgatgtatgctgtaactgtgtgtattgtctaccctagcatgcaaaaatgcttcatctaaaatgtatgctataactatgtgtattatattatctataattatatttctccttggtttaatattagatattttcaggtacaagaaatgtatgcacattatagattcaatgcatgtaggttatatgtgtaaatatttattgataagaggcattaaacccctgccttctatgctggataaactcctgaacttagcctccaaaacaccacagtagcctccctggtaagcacagggctctttctctacccttttgtgtctcccacgctcccacttgtctacaagagctgagtgtagaccaagagcaataaagttcatttccccaaaataaggcgtagcattcaggttttgtgatacctgattggtttacattgtttacaggtggggcctcgaaggggtaaaaatcagaagcttcttattctgagcgcaagggcaagatcattgagcagacattgacctcccttcagacatttcttgggaggaacagaatgagaatttcaggggccagtgcctgcaccctactagctgtggcagcctggtgctcatctacttctccagcttgggaaggcctaggttaaccccagtctttggaggcattgttattcctcttctctccctgcttccccgtgtttgtgttctgggcccggtgtaacactgaggttcagaattgctttcaagagaggagcccatttctgtgtctatgcaaggctggacaatttctccaagtggttcagcctgtgggggttaacggggcaaaagcatctcagctagtaataaacactgcttcgcctcttgcttttttatttttatttttgcaaaacttctctgtaggtgtgtatttctctagaggatttcaaaaattctctgtaggtgcgtatttctgtagaggaaggagtggtgactgggccagggtgaatggattatttgatctatattatcttgaattttatatcttttattttaaaatttgggtgttttttgaagtaggaaatcaatgcacatggctgaatatctaaaaagtgtaaaagtatacattgaaaagtcttcctcctaatctcgtgattgtcttcgtttcagtccccatggccacatcatgaggctactgatgtcattagtttcttttgcgttcttctagggtttctgttggcatatgcaagcaacaataaatgtatacctttatgttttctctttttacagcaaggacagtttattaaacacactgttttaaaccttattttttctctaaataatatttcatataagtcagtatgtagactttatgtatttttaaaatgaagacatagcgttccactgaacttagacaataatttacttaactagtccaagattgaagaataaaattattttgaatcttttgttaatagttaatagctttgatgagtacacttatgcatacattattttacacatgttcaagtatgttgtataaaccccaaagtgggaatgctctgtcaaatattacaggtatttgcaactttgatagatactaattgccctcgatagaggtagtaaaagcttacactccacagccttactgatgatatatattataaaacttttagttcttgccaatctaaacgtgaaaaatggtatttcatggtaatttaaatgcttttctcgttttataactgaggttgacatctatcaaaaaattatttgaatttttctgagaactattaatctttgaatccttttctgttgtttatcttttccttcttcatttctaaaagttcctatacagagagattcacccgttatctgtgatatgattacaaatgtctgccctccaatttgttatatgtctttagatccaaataccttattttttgccatgtagaaatttttaatttgtatgtgataaaatgttaatactttatggattctggattttcagaaataaaaaggtcatcctcacttccaggttttaaagaaattctttaatgttatttta

SEQ ID NO: 276 - DNA, 2307 bp, Homo sapiens
gccgcgccgcaaagcaaaggtcgtgcgttgccggcttggtagcgccttccttctccgacttcccagacttcccagtctgcgcaggcttacttggggacgcagggaactaccaagaaagtgtcagaggaaaggaaaggtgaaacagacgaggaactggaacgggaataagtgggaaagaagccaaggggtttgagagagacttgctgccctgggtttttggtttttgttttttgagacaagagtctggctctgtcgcccaggctgcagtgcaggggcgcgatttcagctcattgccgcctcaacctcctgggcttaagcgagtctcttgtctcagcccccgacgtagctgggactacaggcacacaccgccatacctggctaatttttgtatgttttgtagcgacagatttttgccatgttgcccaggctggtctccaactctcaagctcaaataatccaactgtttgggcctcccacagtgctgaggttacaggcctcagccaacgcgcctggccctgctctggtttttttagggagtaagttgttgcggaaggacgcaggtcttagccatatttttgaataatacttcgttatgggaatgaaaccgcctttgcaaaattatgactgatttgggaggccgaggcgggatcacttgcagtcaggagttcaagaccagcctggccaacgtggtgaaacctcgtctctactaaaaatacaaaaattagctgggcatggtggtaaacgcgcctgtagtcccagctgctcaggaggatgaagcaggagaatcgcttgaacccgggaggtggaggttgcagtgagccaacgtcgcaccactgcactccaccctgggcgacaagagtgaaactacgtatcaaaaaaaaaaagaaaaaacctctgctccctgaatgctcagggagactgatttgagtaataatagaactccggtctcacacagctggctctgcatgaattactctttctctattgcaattcccctgtcttgatgaatcagctctgtctaggaagcgggaaaggtgaaccccttgggcggttacagcaagaggagatagtccagagactcagccctcgtatcttgaagggtttcttggttttttgtttttgttttcttaaccaagttgtctgctccaattgctggatttcattcacaaggctttgctaggaccagttgtggcccttggaaactcgtggaggagaaaagctgtgaaaataggcacacatgctggaggaggaacagagggcaacacacataatactggataataaacttgagaggcaaaaattaaacaaaccgacaaacaaagttggaaacccagactgtccaaagcagcttgtaatcaggcttacttcatttatattagcttattgatgtggcaactatttgacttttacttacatgatccgctgtttctgtggtgtggttccaatacaccgacgttacaaaactttgaccatcttaaaagccagattaatcgaattttaacaaccattgttctgaaaactgcagaactctcgacaggtattgactgttcaaactacactgtcaacctagacgctgaggcacgagatagaacttaaagcatttactttagccaaagtgaggacagctgcccagaagacccagacccaagtaaccttaaatgtgaactcctgtccacctttgttacaatcaggtttttaaaggcaaaaaggggacagggagttgactgatacaaagttgtaaagaattactggtttgtagaaatagtattggttagtggttggctatacgttaagctatagggtgcgagttacagtgtccagtgtaccattattaggttaatttttagctacttgtggctatagtaagcagtttaaagagatgaatgcataacaaagtggggagtaggatgtaattgctgtctcattttaatgtctctctgggcctggtaatttaaaaggatttaccttcctcatataaaagttcttttctcggcactgagagatttgattatactctagcatagcttccagtagcttaaggccttgtccctaggctgaccccagatcccgttaaaatgcttccctgaaatcaaaactcaatgcctggagaatttactgtttgttccagccaaaacttgatgataggcagataggtccctgaaccccttcttagagcagtcactttagaaagcttgtttctctacccttggtgatgtaagtctaccacccaacacagtttcctcaaagacttgggagccatctctttgaaatgcaaatattcagaaagataactcaccctagctccta

SEQ ID NO: 277 - DNA, 32707 bp, Homo sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaaggtcctcacaacattgtgcaacaagtgtgaaagatgtagtctccatttacggctactgaaataggctgagagaggagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 278 - DNA, 32633 bp, Homo sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 279 - DNA, 33633 bp, Homo sapiens
gcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctaggtatatgaataagaaatacatctctgctgtcctgagtcacttagctatttggagttgtttggtatcaacttttgcatactaatataaaaattggtactggaaatagggtggtgctataacaaaaatctaaaatatgagtcactgacatatataataattgagttagaaatactagtggttggttgttaggcagcatccagctttgactcacttatgcatttcccagtgaacctagctcagaagtttgcaccatgatattcaataaataattcttaaataagagagattgtttcttgtaatttttccctattttagggaaaaactttttttttttttccatatcacatttttcttgaaacattggagtgccacgaacatatcatttgatgctctgtttgagtgccaccagtgagtttcccgatgtttaagtttggctcgtgggcagcccaccttcttcctctccactttctcttgggagccatcctgctcatggaaagtgtgctttctcctctgctacctcacacaagtttcaaaggagcttgctcctgccaggggaggcttggggtaagccaaacagcatcagctccccgggggaagggaaatttcaggtttggagctaagttcacttccagggagtgacaaagcctgtttgaactttaattcacagagtaaaagagttcaatgttggccattaatgatttggactttaacatgaagttggtactgattactttgggccataatttagaaggacagagtgatttaatctctgaacttttaatttctctctggaaaattaatactgggagagggttaaaatcaaattgagaacatcttgttggttcttagttattaaagtatttgatcacattttagaaattctgataactttgggcaagctgacaggacatagtttgagatggcgatagaacatattgtgaattacagccttggatacagaatagcattggaactgatttaatcgataaattgttctgacccattcagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaagttcttttctaaatgtgatgaggaattacggaatcataaaatggaagcagagttaaactcagacatgtgggcactcaaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaa

SEQ ID NO: 280 - DNA, 8305 bp, Homo sapiens
ctttccacccgagcgcgaggtagacgccggggccacccgcagcacgcagagcttctgggagccggtggcaaggccgaattgggatgcaaaccaaatggacgtgggtgactggcagaaaacgcctcccacaaatgggagggatttcggagggaaccgaaagaaagttgctgcaattgagtgaagtcaccttgatgcagaagtgttttctcttctcattcctgttaggaaaccaagttacagctgaagccagggccttctcctacccgactcccgcggcccattaaaacctacgtgagcttatctgataccttcaagccctgttttgtggccccatctcctcttcagatggcaatgtgcctagctacactacatttcctgcctcccttgcagctagaggtggccaatgagatataaacagatgctgtaagacatgatgtctagatccctagcagtcatcccagaccatgagataactttgagaaggaacaccatgtacaaaggactgtgcagaagagggttggcaggagcctggatctctgatgacttcacccttgactgcccacctcaccaggctgtacaagccactgttactggcagatgaatgcaagttctaaaacatacaactactgacctactgaattttccaaggagcacatttccactggagacatttggtgcctgcagaaaatacttactgaggaatttctatgggaccagcctgaagtagaagccactgaagagaggccctgaagcagcttttcttccttatcccagagaccaacatggttaccccagcccagagtcaccctccttcctctaagctgtcaaaaccctggctgcctttacaatgattctgacaatgaatcccaccctgctggtgatgtctattgctttactgttaaactttttaagggttaaaattcctttttatttttctttttaaattgattaataatagttgtaccaatttggatggtacctgtaatattttgatacctacatacaatgtgtgatgaacaaatcagagtaattgggctagccatcacctcacacatttatctagggctgaaatccctgaaggacaggattgtgtcttacaaattgtgtattctaatctgcatttacatttcagaaattctggactaagtaggcaaaccaacagaaactcttgctatgaagatctggaggtttcctggaggaagtggtgaatagggccttgggactgatgttaaaagccctggaacacaatagggagactcctgaactaggaagaagtcaaaagctctggtagcagcccccacaaattaagaaacctactcagagtaaaagaaacaggccatggtgggtggccggggagcaaggaatatttgtgagtaaccccagatggtggcaatcatttaatgccctccatccctctcagtgtatattaggttatgttttttttttagaaaatggaggaagggttttactatgttgcctaggccagtctcaaactcctaggctcaagcgattcacctgcattggcctcctaaattgctgggattacaggcatgagccactgtgcctggcccaagaagtctgagccagacgttgctgcataggtcagaactctgtgggctatgaatgtaagatattcacgagtcacatctattccattcattggcaaacacttacctgaaaccatacagcaaaagagattctggaaaatgtaccttccagccttagaagaaagtgatggtggtgcccagttgaccccaggcaagccggcccaggaatgcagacattttggactgctcatcttttactactttgtgtagcctttcacagaagaattacacaagaacttgactcttgattccaaggattctggaagaatgccaaccaaactgaagtctacaagcctaaccatgttatgaaaaggctggatgtgacatggtgaatcctccttagatgtgttaactagggttagggtaccagtgacatgcaaggggttggccatttgattaagtagaggaggcatgagtgaaagcagcacacctccaccctgctcaatggccatcatcacctagccaggctgtgagcctccatggagtgggtagctgagaacccacaacccacaatatatcttctttctggccctgttaacatggacctgtctctatgaggtgatggttgatatccagctaagtatggccctcttaatagtaatgtgggtggctttattcatattggcttcatgataaatggtatcactgagctgacttctctatgttttagataaaacaaaaataaaagacaaaaaaaaaaaaaagaaaaaaagcaaaatgacacaggcagtcttgctgccagacacatctgcaatcagaaagcttggaaaattagacttggaaatggcttgaaaaaacctttaaactttttctgaagagcaagtacaggtttgtctctggggtcagttctaattctttgaccagctaattttaagtggctgtatctcgaaaaaagtgacagtgacattttggtactccagctgaacttttagattagtcactgatacaactgcaacttttggcctatttgaaggattttaagggcaggataaataacaaaacccaacagtcttagcctgagtttcccagaaatcagagcctgagacaaaggcttgccttttaagattatctgagaatgtgatcttaggtagcaagagtacagggtaggggagtgatcagggaaggagggaaagctaatgcaacatggattattacgttgtctactactatggacaattgttcatgtggactatgctgtggactaccatatggactaccactatcactatggatacaagtcctgcttggaatttttggggagatttatggaaagtactagagaactgtttgtccaaaggaccaaagatggaaacatttatccattggctccaggtccccattggtcaaggatgacttggttgcatttctaagtaatgtatgctgagcacagagcagattcaagtggttgccctgagctgcagatacctctgggcaggaaatgagagatactcagtgcagacctagagtgagacccgtgatctgattgcaccagcatagagatggtcaaaacctaggtggaagcagtttcttcagttgtaactggagatagaggtgggattgagaggattttaaaaaggggcccaggagttatctaaagcaccaaacagtaagtatacattaactatgttctgggtgttgggcacaagcatgggaggtagagcagtgacatgataaagcctttactcttccccaaatatctatactttctctaatataaaaaatcttaagtatatgaaaaatatcacatttattataaaatgtaaactgcaatgacatctgagagagttatatgttgaaatttaaattcacattgagatataaatgttagatacaggtattttaccccaagtaaggctttactaggggaaggaggaagtgcacaagaattctgggagtctgatgtagttgtgaatcaaaatttccaatccttatatatatttttattatcagccttgctttgcctagtgcctataatcgtgtgagaacttgccctgtagccccccatgagtggcccttttccctagtcatccttctttggctttagccatgaggagcctgatgtgaggagagaactcagcaaatatttaagtaaatatttatggaatgacatgaatgaatacaaagttataaatagaacattatcttattctactcctggactagatgtacgaccaaacaaactagaatagattttgcatagattaaatttcacctttctgacctccccaagcaagtgcttctctgtttttttccagaccaccatgtatattcagtagctgtagcccttattttctgttttagttattcaaagcttgctggaatatgagctcctgaagggcaggggccatttcttattaatctttctgttgtcagtactgagcaaagtctacggtgcctagaaatgtttaattaatgagaatctgaatcaagactataaccatacaacctcaataatgcaattaaaatgaagaatctgtggaataaaatgactgaaaagcataccttgggaatacatatcccagctgagagactataggcaagtcactgaatttctgtgtctcagtttctccaagtgaaaaatgagagaccaatcagggttagaggatatgtgatgtgcatactgtcactctgttttctgtgtcttggttgacatttctaataaatcatgacttttcttcacactgatttcagatataagcttagtagtctcaattcacttcagtcagcttctttgaaattcatcagaaatatttttaaaagcataaatcaaatgatatctttcccctgcttaaaaccctctaagaacttctaattccatcctgatggcaaactagggtcatctaaaaaatctccagctatatgtccttagaaatgctacccaaactatagcaacaagtcaaaatgcatggtggatcctttagtaaagaaaggaaaatcaccaggtgccagaaaaaggaatgaaactgaaaaacatagggaaaagcatatgagcttatgctgtggctaccctggaagaagtgtggaatgagtggtttggtgtattattacaccgggtaattaaggttttggtcaaattagaggataagagatgcagtcttcagtttaaatgaatcagggagttggaactgaaaactctacatgagctaggatgcttgaagggctgacctatagagagggtgctagagaaaaaaattacaactgttaacatgaagaaaaaaggaagtgtttctttgctttggctctgggcaaataatgataataataattattcttgaaaaatttacaactttattctgtgctttatggaaaattagaattcaaatatgttctttcccagttctccatgaaaccaaaactgcagaattaatatacaaattgttcttaagtgaatgttactccttggattcctggcaaaaaaaacacacaattcttgtggaggaacatttccattactcccatgccacaggagctccacagattaagcacaactgaagatgaaaccacaacccaaaattacaaaactcacaaaaaacaaaacaacattagagagccaacagacacaacaatattagataattaatatttctaagtacctgggacatagtaagttttatataacgtttgactgataaataaatattaaaaaatgaacataccaggaatgtaggttaatggagaaattcgtaataaactttaaagtaggaggaattaaaatgattaaagatataaaagcaggaataatttacataaaaaagacactatgataagataataggcaggcttgaagatccatatagaacttctagaaaaaaatgttatttgaaataaaaagctcaataaagagtggtttgaatagagctgagaaaattgagtgcatcacagagaggttaagatatagtaatatgaaaaaggttaagagatgtgaacaatagaattaggaagtgtaatgggaatttcagaagaagagaatagataatgagaaagaggcaatattcaggaataatggtccagtttttcagaattaatcaaagacagaattgaagaagtacatacagtcatgagtaggaaaactataataaatacacattgtaatgaaattatagaacttaagaacaaaaaatagtttggtaaattccctcttttaaaagatagagacctactgaatggataaaaacagaaggacctcattatatgctgcctacaagaagctcgtctcacctgtaaagacacatgtagataaaagtgaaagtatagaaaaagatattttatacaagcagaatccaaaagtgaggaggagtagctatacttataatatcagacaaaacatgttctgtaaaacttcatgttctgtatcagacttcatgttctgtaaaaaaatgaatgacattataaaataataaagagatcaatttagcaagagaatataacaattagaaaatatatgtacccaatactggagcactcaggtaaataaagcaaatatcattagatctaaagggagagataggccataatacatgtaatagttggggatgtcaatatgcctctatcagcattggacagagcatctagactgaaaatcaacaaagaaacatcagatttaaactgcaccatagaccaaatggacataacagacattatagaacgtttcacacaacagctgtagaatatatatgtttttcatcagcatattgaacattctccaagattgaccatatgttaaggcataaaacaagtctcaaaaaattttaaaaattaaaatcatatcaagtattttatctaactacaatggaatgaaacaagaccagtaataagaggaacataacaaaactacacaaataaatggaaattaaacagcatactctgggatgaccaatgtgagaaggaaaaaattaagaataaaattcaaaaatttattgaaccaaatgaaaataaaaacacaacatagcaaaacctatgagacacagcaaaaatagtattaagaggaaagtttatagcaataatgcctacatcaaaaagattttaaataaacaacataatgatgcacctcaaagatccagaaaagcaagaacaaaccaaacccgaaattagaaggagaaaagaaataataatgatcagagcagggctggattgtgtggctcacacctgtaatctcagcactttgggaggaaaaggcaggaggattgcttgagcccaagaatttgagacctgcctgggtaacataataagactccgtatctacagaaaaaataatgaaaacaattagtcagggatggtgcaacacacctgtagtgccagctactagggagacttaggtgggaggatttcttgagcccaggaggtcaaggctgtagtgagctatgatcacaccactgcactccagcataggtgaccgagtgagaccctgtctcaaaaaaaaaaaaaaaaaaaaaaaaaattagaacagatataaacaaaattgagacaaaaattgaaaattgagaaaagatcaataaaacaaaaagctgtttttctgaaaaaagaaacaaaattaacaaactattagctagattaagaaaaaaagaggccgggcgcagtggttcacgccagtaatcccagcaatttgggaggccaaggtgggcggatcacgaggtcaggagatcgagatcatcctggctaatgtggtgaaaccccgtctctactaaaaaatacaaaaaactagccaggtgtcgtggcaggtgcctgtagtcccagctactcaggaggctgaggtaggagaatggcatgaacgtgggaggtggagtttgcagtgagccgagatcacaccactgcacttcagcctgggccacaggtgagactctgtctcaaaaaaaaaaaaaaaaaaaagaaaagaaaagaaaaaaagagagaagacacaaataaataaaatcagaaataaaaagatgttacaatgaaaaccacagaaatacaaaggatcattagaaactactatgaacaactgtacaccaatacattaaaacacctagaggaaatggatatgtttttagatgcatgcaacctaccaagattgaaccaaaaaggaacagaaaactggaatagactgataacaagtgtcaatactgaattagtaacaaaaagccttccaacaaagaaaagtctaagaccagatggcttctctgctgaaaaccgctaaatacttaaagaagacttaatatcaactattctcaaattattctggaaaatttaaagcagagacaattcttcctaattcatcctatgagaccaacataaccttgataccaaaaaccagaccaggacacaacaacagcaacatcaacaaaactacaagccaatatccctgatgaacagaaatgcaaaaattctcaacaaagaattagcaaactgaatcaaacaacacatcaaaaaaaaaaaaaaaaacacacaagaatcaagtggaatttatccaggaatacaaggatggctcagtgtacagaaatcaaaaaccatcatacatcacatgaatagaatgaagaataaaatccatgtgattatctcaatagccacagaaaaattttttgataaaactcaatatcccttcatgataaaaactcttaataagttaggtatagaaggaaaatacctcaacataataaaggccatatatgacaacccaaagctaacattttactgaatgagaacaagacaaggaggccaactct

SEQ ID NO: 281 - DNA, 1755 bp, Homo sapiens
cttaattcctaccgattactattaccttagtcaactcctgcaaaataggctcatacccaaattatgtaaaaacatctatcgcatatgccttcatcgttagcctcatcccaacaacgtttatatgcacagaccaagaagccattatctcaaactgacattgaatgatgatccagactctcaaactcttactaagcttcaaactagactacttctccacaaaatttatcccagtagtgctattcattacctgatctattgtagaattctcaatatgatatataaattcagaccctaacattaatcagtttttcaagtgcttattttcttcatcacgatattaattctggttactgccaacaacctctttcagctctttatcggatgggaaggtgtaggaatcatgtctttcttactaatcagctgatggtatggcagagcagatgctaatacagcaggcctctaaacagtcctgtacaactgcatcagtgatattggctttattttagctatagcattgttcctgtcctccaacacatgagaattttaacaaacatttattctagaccagatccccatctccttccattaattagccttctcttagcagcagcagaaaagtcagctcaatttggcctccatctctgacttccatctgcaataggaggcccagccccagtctcagccctactccactccagcactacagttgcagcaggagttttcttgcttatccgcttctaccctttaatagaaaataacctatcaatccaaacctttatattatgtctgggggctattactaccttattcacagttatctgtgctctaacacaaaatgatatccaaaaaatcatagcattcttcacctcaagccagctaggccttataatagtcacaattggcattaatcagtcacacctagcattccttcacatctgcacccatgcctttgttaaagctatattatttatatgttcagggttcatcatccatagcctcaatgatgaacaagacatctgaaaaataggagggctattcaagactttgcccctcacttcctcatcctttattattggcagtcttgcacttacaggcatgcctttccttacaagcttttactctaaggcctcatcattgaaactgcaaacacgttcatacaccaacgcctgagccctttctattactcttattgccacttccttgacagctgtccgtgatacccatattattttcttcgctcttataggacaaccttgcttcatgactctggctgctattaatgaaaataaccccttcctaattaactcaattaagcgcctaacagttggcagcatattcgccggattcctcatcaccaaccgtattattcctgcttcatccccaaaaacaaccataccactccacctgaagctcacagccctaggtgtgaccatcttaggcttctcactagcaatggagcttaatcttgaaactaataaccttaaaccaaaatacccattacagacattcaacttctccaacatactaggattttattcatccacaattcaccatacaaacccccactcaggcctatacacaagccaaaatctggcttcacttctactagacctaatatgactagaaaagtctataccaaagaccattacacaacccaaatttcagcctccattaccatatctactcagaacggcctaattaaactctactttctttttttatcccatcccttctaactctgctcctaattatcta

SEQ ID NO: 282 - DNA, 2795 bp, Homo sapiens
cagtcatggtctggagtcaagaaatgaagagggcaagcaatgtttttggcatcctgactacagttacatgcagtttggggctgctgcaatggcaactcaacggagaggttaggaacaccaactccaggatcaggcaatctttgaatccctgtcactagcagctttgtatattggagcaagttacttaacatctgtctgctggagtttgctggaggttcactccagaccctatttgcctgggtatcaccagtggaggctgcagaacagcaaagattgctgcctattccttcctctggaagcttcttcctagagagtcacctgccagatgccagccagagctccccgaaatgaggtattcagtgacatctttctaaattgtttaaaatgagaagcattgcacactgagagtcaggatccaagtgtctttgactgagccaactcagctctgctattaacttatggtgtgatcgcaggctgtctagaaaaggacaccaacaatcacccatgaagattgcccttcaacctttgggaggaaatgatcgaaatgggagctagagaagattgttgttggaatctcagttcttcagagagctactatcaacagattgagttgacaggaaaaagtcataatccaggccaaagtgagcaaactcccaagagcattcctggtcagcaccgcagcaaatccgtggcaagtgcagagattataagcaatttctccatggctggaattcagttgatctgggactgaacctatttctaatggggtcttgatatattgcccaggctggagtgcaggggctattcacaggcacaatcatagctcactacagtctcaaactcctaatctcaagcagtagctgggactgtaagtatgcaccaacactcccggtttgggtatctccattgattggcaaccagcaccacagtagatgctgatgaaaagaaagttatgaatgtcatgtaaaatgacagtagtattagcaaatgtgcttttaattataagaaaattacaatatgtaaaaaaatttcaattttcccatattatctcttaataataactgccatttgttgagcccattgggtatgttacatatattaacacaacaggatggacattatctatcttatatatattatgtgtatatatacggaaaacaggacacaaattgtctgaggccatggacaattagcttgcagtaaagtaggattctaaattaggtttctctagctccaagacccatgccattttgtttggtcatttgcttctgatgaatcaaatattaattcagccaaagacagctattcaaagctggttgaataacttactatgtgtaattcacttgtgtcctgcctttcttccgaacttttgtacaaaaccttgattattttaataaggcattctatacataaagtttcaaataaaccataagtacctcaagaaaatgtcatataatttagaattgaatcatagcatatttttaatctggaagcaacatatctaaataagccatttttatattataaatacaaacaggtacaaagaagtatagttcactttacaagctgttgtacatgcataataccatattatgctaccaaagaaactattaagttatacatattttttacagctttaactatttttgttgtcaatttcctctaataagattttttctggataaacaaaaatttatctactcaaatgattgtttttcttcaacatcataatgttgcaggcctattgatgtatatttttgtgtactaaatagtttgtggagctcttcttgaagaattatcttcagagctgattaaccagacacaccctccagacatcatagtcacagctgctttgagacagcaacaacctcatccccgcaaatagtatggattcctgtcttattcaataggtctgaattttaaatactcttagcttatttcaagaactaaatctatcctccacaaataaaaatgtgctgccgctcagaatatttaggagaatatgtgatagccaagatacttttggcttatttcaaaaattcatctatctccacaaaggaaaatgtttcaccattcagaatattcaagagaattttcttagaaaagaaatccaagattgtattcattggaataacagacctttcttcaaggtgacttctttcaaaagaacaatatttaggggtatatagaacatcatttttaaaataatttattttgctatatttaccacatttcatgacaccctaaaagattttggctaatgaaatttatacagttcaaatgtgtattcctgaagagacaagactgagggaaaaaaaattatctcaaagtcattctcaaattagacatgaaatgaattattaatttctacatattttaccatcatgcttgtagttttaataaacaaaaatcaaatgcatataggcttcacacactttgtgtaattgcttgtttaacatccccaaattccataaatgcaaaaactagatctgtctggctttccattaagtccccagcacctagcaaggtgcttaacaaatagcagatggatgttggaaggaataaaggaacaaagaaaagaatagaagaagttagtgacttgattctatacagagtggaccttgacacatactgcaagtgaatgttaaactaaaagtataatttctttatcagtgaatatatttccatgaattttaagtattttgctgatgatttattaaatatgtatttcactactttcttttcttttaatcagtcctattccatccccttcaaataataaaaaagtttcaatg

SEQ ID NO: 283 - DNA, 3002 bp, Homo sapiens
attccagaattttttaaagttcacaacacgagagtggacgaaatgtcggagcttttgctcatatccagaaatgtggcctctgcctcccactcgggccctgcggtgcagacgggttcagggcggcgaggactgagccaggagcgccgagagttccagctgctcccaggctgggttctaattaacgctggacccctgctgagatggagtctcactctgtcgcccaggctggaatgcagtggtgcaatctcggctcactgcgatctctgcgtcctgggttcaagcaattctcctgcctcagcctcccaagtagctgtgactacagagaaacgtgaacaggccaaacaaagcctcacctggctatcccgccaccctggggttgggcctccaaaggcccgggaggtcacctaagacacggtgttctgaacatgcaagcccgacagcatcttctctaccattctgccagagtccagagacctgggaataggtcataccccccactgcattttacaagcttggcatacattaggttctcaataaatactgaattaatgaaaaaattgctgaagtaactgaaaacatccatccaaaccccacaccatctggtagataagtagtctgtggggagtcccatatttttcttaccttagatatttatttggaaatggactgtaggcccaatatggtcaatgaaacttgcagaggaacatttcatgcctttaattagttcttcataactgcagggacctctagagttcctgaaattgaactgggttgtaatactgtcaagaaaaaggaggacctatcttaaatctatttcaagggtaatactattttactatgtaaattttcccctggtcagggacagcctgatcatgcatggtagactcgaagcatgcaaatatttcaacatgcaaaaccgccctaaaaatataaccgaagcttatggagttgtccagggtacagtggtttactggcccctgaatgcgggactccatcaaactgggttccaggctgggaggtctctgaacccaatttctagacagcctgctttggagttcaactgatgggaccttagacaccagccttaccctctgcaagtcttgtgatttggagccagatacttggcctctctgtgctccagggagacaccactgcacctacctgagaggactgaaggagaggatctgtgcaactcactcaggatactggatcttaagccaatgggtggacttacattcgtcacctctgattctgtctcctcctgcgcggtgacttagcaaacacttcttcctctccagctctgcttcttactctccagctctgctgccctgttccagtgctgacgccagacaacagataatttcccaaatgcttgtattagcccttaggagttcatgtgttcctcccccagccaataaagctgttaaatcccaataactgtcaggaatggagccaattgctataaagtacttccagcttcttggcatgaagaaataattagttccagttgccactgtggcatgaaaaaaaaaaaacctcctgcagctagctcggtgtctacccaaacagctgcctagttttgtgcttgaaacctagggccttggtggcagaggcactggagggaatctcctggtctgtcgattgtgaagaccatgagaaaagcatagtttctgggtggagtgcaccgttcctcatggtaccacttttgccttttgtcctaagtggttgtggacatctccaggggctgataccaaggactaggaacagctgagggaggcagaaaggttcagagtacatctctatttacagggaacagaacaccgccttgagagggccatctgtgctccagatgtgagagttcatgtgaatagaatggctgcaattcaaagaatcttcacaggaaaacagggctcagagctcatccacaatggacagacagggagggaaacaggtggaggttagttcaccacttcctcataagaaggtaataaatagtttggtgaaataaaatggtagcactgagtaattgcgggcttctggataggcagtcaggttgatttcatgttgctactgctggacttgagggctggcttggctgtggtggcagacacagcagcagctcaggatgatggtgatggtccatgccagccagaaccaccaatgttcatagtagtagttacaacactgagactgcccatagcagtgtcctgttgtgtcacagatgtagctttgattgttggtacacacacaggcttccttatcctttgggggttcagccctggctgacacagggctgggcagtgcctagaggtgcaagagctccatgccacccaggagtcttccctccatactcctcctgctcctccgacccagcgtgggcacctccctccacccttgctgcacttctcctctaccctcttcttccttcttttgttcttttcctgtaatatgttttgaagtcagattgtgaggccttcagctttgttcttattgctcaagagtcctttagttattcaggatcctttgtggttccatataaattttcaaattgttttttctatttctgtgaagaatgacattgaaattttgataaatattgcattaaacctataaatcgctttgggcagtaaggacattttaagaatattaattcttcctacccatgaacataaactatctttccatgtatttgtgtcatctacaatttttcatcaatgttttatagtgttcagaatacagatctttcacctccttggttaaatgtactcctaagtacaatcctaaatgtgctcctaaacaaaaaaaatacgttttttttgatgctactgtgaatgagattgatttctttatttttgtcatatagtttgttgtgagtgtaaagaaactactgagttttgtacattgattttgaattctgaaattttattgaattcatttatcatttctaatagctttttggtggagtttttagggtttcctatatataatatgtcatcaaacag

SEQ ID NO: 284 - DNA, 3293 bp, Homo sapiens
gagtgtgagagcgagaacagccccgcaggtcccgaggcgctggctggggacaatgccgcggaaagttcccagtccccagccgcagatctgcagaattgaaatgaaatgttttgagctcttcaagctgactcgtcagaatcctggagccttttaaaaaatgacgaagtgcccaatgtggaaatcatagatttcaaggaaggaacaagaaaattgatgaaacaagttcaaaagaaagaagcttggccaatttgatgtcaatggaaatgcgtgagatttttattcagcattcacacctgagcaatgcttttggtcatgatgtcatactaagaagaaaccacctgagatgagactgttagatgttcagagcaaacaaaaacaaaaacagaccaacaaaaaaaacccaaaacaaaacagaagtttctgaaggacagcagaaatggctttgcaggaccacaacaaccactcccagtcatgatggagagaagtgttcaatacccacagatcctgaacgttgagctgattatactaactagatgggacttagttttgtctaccgtggggtgagcgtatactacctgagggaacaggttctctatggtgaagatggcaacttgctgactcagtctcagaatgcgttaaatccacatattctggcaagtggagttctgcttctccaatatctcttccagactaagtctcgaaaggacagtaattgatccaccctgagtcatatgcccatgtccaaagcaatgagtttgggaaatttcatgacacactcctaattttgtggtaggagacacatcagaaccacacaatgagtcagtcctatttatgaaatagaggttcatctatcagatgaaagggaaaaaagttgtaaaaacaaaacagatgttcactaatggggatctatctgaatttcacctgtaactacaaatgctcacaagtagatttacagttttcctagagtgtcatgaatttaaaaacatatgcatggaatcataaagtaatatcctaatcacctctcacaacctttctctccttaacataaaatgagaatattttagcagcaggagaaggattttcatttatagacctttatcagacactaatgtaggattgagtttgacctgatacagtgttctatctctgagtgttgtcactcagttttatcataaataaaatttattttatatgatatcatatagagaacaaatttacttatttttctcatgtaatcatgtaatcaattgttccaacataatccattgaatagatattgtggcatttccctaattatttataaaggcactgttactagatatgaatatttatatatgaggatatgaatcgtggctctctgatttgttcattatttgcttgtctattcctgtgccagtatcatacaattggtactaatatagtgttctgatattgacaggatgaagtgctccttctaatgatgtagctttaaatttgtcttggttgtgcatttctttttattcttccatagagatttgtggttcagttgtcagctttgaaaatcacttttgggatttgaatttgaattgcatgaaatttgtagactaacttgtagaaaatagacatttttatgatatgaatttacacatccttgtaaccatgggtgtgttatttattttcacttttgaatattattgtgggtatttagtaataaaaataacaatcgacgagttacatggtggttactatgtgacagatgttgtcaaagttccatccatatatcaacttattatatattcttatgggaagagaccgttattatctccattacacaagtaagaaaatcgaggtacaaagagcttaagtaacatgtgctaagtcatataagagtaaagctttatttgaatccatgcagtttgtctccagagcttgaaatccattttattttattttatttttgctttttaaaaaaaatttttttgagacggaatctcgctttgttgcccaggctggagtgcagtggcacaatcgcggctcattgcaacctccacctcctgggttcaagcaattctcctgcctcagcctcccgagtagctgggactacaggtgggcaccaccacgcccagctaattttttgtatttttagtagagaatggggtttcaccatgttagccaggatggtctcgatctcatgacctcatgttccacctgcctcggtctcccaaagtgctgggattacaggcgtgagccactgcatccagcctgaaatatttaccagtatctgatattgcctcactaagaactttgcccaactccttagtgattctaccattggcttagtattttggattttctagtagacaataatatcgtgtgcataaagcaaatacaattattattacaataaaatttttaaactactcatttgtacttgctttcataaagccttagctaattccaacaaaatattgattactgtgggagagagtggtaaatcttattttgtacctaatattaaataaaatgctactaaatataagtgagatgcttgctataagttttagtagttaaacactataaagttatttcttgtctattttcaagaattttttattattttaaatgcatgtgcaatttttttaaaaagtattgttttgcatctaatgttaaataaaatgcttctaagtattagtactaaatatcagtgagaggcttgttgtaagttttagtagttaaacactataaagttatttattttctattttcaagagtttatattattataaatgcatgtacaattaaaaaagtcttatttgctcttcttttctaatgttaaaacatttgtgctttcctgagatgaatgctgtgctctcatgaaagattgcagagtcaaaaagtagcctctggagttaagactttctggttttagagcctcctatggccacttactaattatgggtcttaggagagttactgaaccttcataatgggtaccaatcctagatcctgtcaaaagggatccttctcttggcgatgactttggaagatcctttgcatgacaataaaaaaaaaagtattattagatctaatttattagataacacttgggtgtctctaagtgttatggtggtaaacgttcaacaggctctcaaaaatgcatatatgtatatgtttatatagatacatatacactcaaatgtgtatatatgtatatatacacactaatatgtttatcataaattttattgatataaaggttgtgtaacacaagttacaaataataataaaatattcaatattatttattgtaaatt

SEQ ID NO: 285 - DNA, 2493 bp, Homo sapiens
agaagagaaactcatgtcagccccagccctggggctacctgacctgatgaagccatttacactgtatgtggcagagtgaaaagatggaagttgggagttttaatccagacggtggggccctggccaagaccagtagcctacctctccaaacagctagatggagtttctaaaggttggcccccatgtttgaggaccttggcagcaactgccctgctagcacaagaagcagataaactaactcttgggcaaaacctgaacataagcaccccccatgctgtggtgactttaatgcataccaaaggacatcattggctaacaaatggtagactaactaagtaccaaagcttgctccgtgaaaatccctgcataaccattgaagtttgcaacaccttgaactccaccaccttactcccagtgtcagagagcccagtcgaacgtaactatgtagaggtgttggacacagtttattctagcaggcctgacctccaagaccatccttggacatcagtagactgggagctgtacatggacaggagcagcttcgtcaacccacaaggagagaggtgtgcaggatatgcagtggtaaccctggatgctgtcactgaagccaaatcattgccccaggatacttcagcccaaaaggtcaaactcattgctttaatttgggccttagagctaagtgaaggtaagactgtaaatatttatactgactctcggtatgccttcttaaccctccaagtgcatggggcattatataaagaaaaaggcccattgaaatctgggggaaaagacataaagtaccagcaagagatcctgcagttagtagaggcagtatggaagccccaaaaggtggcagtcatgcattgcagaggacaccagcgagcttccacctcgattgccttggggaactcccaagctgactcagaggcttgaaaagtagcatccacccccttctgggcatcaatcacagcccccctattccctcaggcacctgaccttgtacctacttattctaaagaagagaaggactttctctaggcagagggaggacaggtgatagaagagggatggatctggttatcggacaggagaatagccataccacaactgctaggagccgcagtcatattggctatgcatgagaccacgcacataggccaagagccacttgaaaagttgttgggccagttcttctacatctcacatctgtaagcctttgccaaaacagtggtgcagcagtgtgtcacctgctagcagcacaatgctaggcaaggtccaactgtcccgcccagcatacaagcttatggagcagccccctttgaagatctccaagtagacttcaccaagatgtccaaatgtggaggtaacaggtatttgctagttctagtgtgtacatactctaggtgggtggaggcctatccaacacgaactgggaaagcttgtgaagtaacctgtgtgcttctccgagatctcaaccctacgtttggactgcccttacgaatcagctcagacaatgggctggtgtttgtagctagttggtacagaagacagcaaaggtgatcgggtatggatcacggattggaacatagcctccttgcagccacggtggagaggaccccagaccatcgtcttgaccactcccacagccataaaggtagaaggaatcccagcctggattcaccacagccatgtaaaacctaaagcatctgagacctgggaggtgagaccaagcttggacaacccatgcaagatgactttgaagaagatgacaagccctgctccagtcacacctggaagctgactggtccgtgcatggctgaagcatgaggaaactcatcgtgggactcattttcctaaaattttggacttgtacagtaaggacttcaactgaccttcctcagactgaggtagggcaaaaagttaaaacagactttctgtttaaaagggacttgtgtgtataatgctacccagtacaagatatgcagcccaagaagtgaccagcttgatgtgtgctataacccattggaactagtttatccctgttggaaaacagagtatgtaactctaggaattgatggaactggactggaagacctgggtagtgaagatgacagtgagaactcccactagtgagtgagattctcaaaggggggaatgagaagtgaggccatttctcttactgtctcctgtctctgaagaggaggaggaagtaaaagttgaaaaacaacaggaatgaagtcattggcaagaccagccggtgccactgatgaccaggcctgaggttaaaagatcaaccccccactctaaccacatgtgctctcaatctatcatgaccctttcatgtggacccccttagagttgtaagcccttaaaagggccaggaactctgtcttcagggagctcggttcttgagacatgagtctgccaaagctcccagctgttgagatgcgagtctgccaaagctcctggccgaataaagccaaatccttcctt

SEQ ID NO: 286 - DNA, 6662 bp, Homo sapiens
ccagttaggtttaccctttgactctccacttctgtgaatagtccctccatttccagttattttaaagtcagaatatgaaggccgcttagtccatcggggttaagccttcccatcaaatcaaattcttcttccttgcattcttctcttcaagccatttagtgaaacaagcacaaattgttaacttcagattaatatgtttaataagtgaaatctggactatttcaggaaggcaggcaggccagcatgactcttagcatcccactaactcgctgtcgggctcccaggcagcggctcgggcaggcggccttgtggctccgcaacccaacctcttcccctccgggcgcctcccggctccggggtcctgctgcctctgggacctcctcacccccagacgttcttcctctgcttctagagccaccagttcccctcccatgataactcattaaactattaacccattagtccattcatccatgaatgaattaatccattcatgagagcagagccctcagctgttcactatgcacacttgcttgaaaaggtgatcggaaacaaaagacagtgcctccacttgtgaggtgcgtagagatgtgagagacccatggagaattgtcttccaactgtagataattctcatatattcccatgttaacattttagtagctaatcagaattgccaatcaaatccttgacattcttctgatcaatagagtaggtcatcaaaactggaatcccgtgaggtttaaagtaattgttttgtttgtaaaatacatcctgcaaatatttttatttttctgaattgatccttaaaaaaaaaagttattcttgactggtctgaagcatctattgtccattttaagctttacatctggacaactagtttccgagacttcatgtatttaagtgtatttaagggcaatgctttttattttctctgcattagccatccactggctatttatttaacaacaatcccattgcactgaatacattgtccttcatgatgtagcctcagccttcttcaaactcattcacccatgtatgctctgccccagcctaattactggaagctccccaaacatgaccggttcttccatcctccatgccttatgtacactgtttcctctgttggaaagcctgactcgtcaagcaaactcctacttgtccttcaaaactagacttgtgctttacctcccctccttccctatgtcccctaagtggaattattgacctcttcgttcgtgacatttgttcatttctataatagtgtatattatattgcattgtaattatttgtttacataatgatctccccacagttagcgtgtgggcagaaactatgtctctatattcccagtgtgaaacatagtagatgttcaacaaacctttttctttgaatgaaggagtacattagtcagacttcctagttaggagttactgaaacagactcaaatggtctcaggaaaaagtaaaggatttgctaagtagctactgcagacagatcaaaaggctggaaggctatgtttggaaaatgggcaggatgtaaggaaactaaggaggccaatcagcagaaataaacagattttcactatcatcttatatttgtgcatcattcccatgagatcctcaggctggggagggtgttttattgactgagcctgtgtcactcatggacaaactgggataaggttgacctacccccttaagcttgcaaggctgagggatgggggaagacgctacttcccaccaagcttacacacaatgggggaaaagcaattatctgaaaggaaactggaatgtcatcagtaggggaaagaaatgtgtctaactccaaaaaatgaccaatatgtactactaataactgaaactttccaaaaaaaagagactatgatttaaaaatcaatttaacattgaatggtttgattatcagcaaaatcaccatgacatttagcacctttcttttccttgatgaactaagaactcttgcatagatttaataatgtgttatgtaccccctgggtgtctgatttactgacttgagctgaatgattggactcaatacaaataaaaagagcttgcaaacttcgcccatggtttcccagacatcaaggaactaagctcttttgctccctggagaggctaaaaattctaaaatgaagtgccctctgctctggtttctgcttttcagcatttctcttctgttttcacatacttttgctgctttaaaattaaatctaagaaactcattccatatttttcatcatctgcttttgaaagtgaatgttatggatttatggtttgggattctttgatgttagagcagcaactatgcttgcttcacttgtttttgtttcatttttttttttacatttatgaggctttgataatttgatttattaaaatgccacagtcaatgtaggggaactgacaccattcgcattgttggaaagcgtcatgaaacatcaggcgctagttccccatggagcgcttacctctattattatatctccccctcccctttggtcttcaggaaagtttggcattaaacttaagctgcacgcaaagaatattcattcctagaacatttcagtatttttggattggattccatcccccaattttgattttgtatctgccaagatgtacagagtggtacatctaaagctagttatgatacacaagctagctttccttatcaaggaacagaaatattccttcctcttaccctgtaatcattgcatatctggtatattaaaaattgaatttcatatcgtatccctttaaatgtattaacaagtgcaggttggaactttacattatgaatccctaaggatgagtaatgactaaaggacaagactgaccctttctgcaagtggagggtgtttttttcttttccatttctataggaagagacagatgaagagagagggagagaaaacaggacaagtttacccagaatgaaaacctggataagaagattaccataagagcttaaaaccatagaaaaaaatgtcagggttggaaaagtccctagactcttcattcattataattccctctaccagtccactgggtttcaggaaaacaggaacactcatatgctactgtttaagtgagtgagtgagtgtgtgtgtgtgtgtgtgtgtttgtgtgttacaggatattataagaatagaatagggaatcttccaggtatctgaggaatagaaaaaagccaggtcacatgggaaccaggactggaaagtcagaaaccaacaggattctatctctttccatttgtcagggactacacagtctctttcttctcctcaaaattgaccattcagctcacagtggaatatagccttattacagtagtcaatccttatccaaggcttaatttttttgtggttttagttacccacgattaaccatggtctgaaaatattacatacaataagatattttgagagagagagagagagactatatttatacaactttcattacaatatattgttaagtgttctattttattattattattgttaatctcttactgtgactaatttataaattaaacttcatcataggtatgtatgtacaggagaaaacatagtaaatgtaggattcaatactaccggaggtttcgggcatccattgaatgtcatgaaacatttataagaggggactagtgtatattttttcattcaacaagaaaataggcaattagaaaagtcagaaaatacaaaaaatcatggtttaaacatgaagcaaactaatctatgggattattttgaactgatgaagtgtcaagagagagaatccgtttaactgtggtactcggaatattcttagcgtgatgcaagtttgataacaagaattacaacaccttcctaatggattcattcacgtgacctaataataataacaataatgaacacttattgacattttactatgtgtcaggtactgtgctaatgctttatagattatttaatcttcaaacaattatttgagggtaggtattattatctcatttttttcagatgaaaaattgaggcatagagagattgagtaactctaccaagtcacacggctcttcagtggcagagctattctaagccgcatgatttacttctatgatatattgcttctggctaagctatgttatccaatcagcaataaattatttacacaatcattattataaacgcttttttgattttttaaagaattattctataaataaagcatgtgacttgattataataacaagagaatataaacattatcaaccttgatcacataaaaatagtaatataaagttaggggaaagagaggggaacaaaaggaaaagaacactgacttcctcatatttctcagtaaaagatattatttaacattactacatcaaaaagctgtgtttttaaagttataaacatagccaatagaactaaaaataaaaacaggttaacaaaagttggaagggtggttaatatatgtgagtcaaattcgtaattttttaaagcactattcaagaaatccttgaagttgataagcaaagaaacagtataaacatgttatttgaattatgtagatgactaccaggaaaaaaaaactataagcaagtgaaaaccagttacctacaaaaagtgagcctggggtgctgattatggagtgagatttttactctttattttatttctttccatttaagtgattatttccatgtgcacacattactttttataataagaaccatgcccatattattcacttcggtaaatctacatctaggtttccatcccagagaaatgcacatcatatacatgtaagtggcaccaagtgggatgaggggcttcttccaaaggctggaaccacagccccccagggggctctgggtaaacattcctagccccagtggtcttgggttcttttgtacctatctgaatgctattacacgcccacccatcccaaggttcagcccagagatgggagaaaacaaggacacttctgaacttttcactcactcttctcttttacatagtcccaggtgggagttccacttcctcttccggtctgtgtcttaccattctaatcccagggcacaaaaagcctcaaggtttcgccttaagggtggatggggtacatgaaggaaaagtagcttacagaaatgggtacacaattttgggaggtatttgaaaggtattgtctcctgtacatatatagatgcatggaaaatggtctgcaaggatacaggccacttcaaaagcagttggcacctctagggagagcagtgggggaggggaggatgcattcatgtaggacacaggtaattgtgggtttttttggtgctatggacatttatttagtgcttttgtatgttttacccattttaatcatcacaatagccaagtgaggttagtttttatctccacttacaaaaaaattaatagactattctttgaaaagttttaggtttacagaaaaatcgtatgggaagtatagagagttcctatatacttatcctcacgccctcctccccaatttcgcctattattaatatcttgcattagtgtcatacatttgttatattgatgagccaatatgaatacattatcatgaaccaaagttcatggcttacaccaggtttcactcttggtgtacatcctatgggttttgacaaatgcacaatgtcatgcgtccaccatgacagtatcatacagaatagtttcaccaccctaagactccctgcgctccacctgttcatctctccccctaattgatttttttaaaatccctgattatcctgcttgccctgcatgcatttccctcttacccacgaagtgaaacctggtccactgcacctgttccttcagttactgactgctgcctgtgataatagtagcatgagtggtcttcaagcacctcatatcctgccactaccgccacttgtcaggggaaaacccagacaggatgagatccacattcccagctgtccctgtcttccaaggaagagaaaccctaaaccagaagctaaagagtgaaaccagatatcccagggaaggggtgggggacgttaggtccccagtggtctgcgaaagaggtgccaagccagaagccccaaagtgctgggaaagccagcacagagaagcagataatgccaggaaacatctcaggcatggtggaggggcttggggggtactcaaatgacaggactgaagatttgtgaggatttgtgaggcactcaaaaattgcagagcgattatgaacactagggagctctcctgcttcctggaaaaaatcaaagcctgactcccaaggttggcattgggggcatctcttgtggagacagctcagagtgaggttgggagatacttttctaggaagtgtttttcaaatattttttaccgtgacctacggtaagaacatatttcaggttgagcacggtggctcacatacgtaatcccagcactttggaaggctgaggcgggagaatcacttgatcccaggaggttgaggctgcagtaaaccatgttcacaccactgcactccagcctgggagacaaagagagaccccgtctcaaaataataataataataatatatttcatattggcatctagtgcacacatgtggtgcacacacaaatacccacacactttcagcattagctggga

SEQ ID NO: 287 - DNA, 2666 bp, Homo sapiens
aaaccctcgataagatacaactgcacacccactagattggctaaaattaaaaagaatgaaaactttgacggttggcaagtatatggagcaagaggacctttcatagactgcttgagggagtatagattggcacaatcattctggaaaactgcttgacaatatttactaaagctaaatatacacagactttgtgaccaagcagttccactcttaggtgattgcccagtagaaatctgtacatgtattcactgaaagtcaagttccagaacattcaaagcagtgttctttgtagtagccccaaacttcaaacaatccaaattgtgaataatgctgctaggaacatgagtgtacaaatatctgtttgagtctctgctttcagttctttttctttttcttcttcttcttcttctttttttttttttttttgagacagagtcttgctctgtcatccaggctggagtgctgtgaataatgctgctaggaacatgagtgtacaaatatctgtttgagtctctgctttcagttctttttctttttcttcttcttctttttttttttttttgagacagagtcttgctctgtcatccaggctggagtgcagtggcatgatcttggcttactacaacctctgcctcctgggttcaagcgatttttgtgccttagcctcccgagtagctgggacttcaggactgtgccaccatgctctgctaatttttgtattttttgtagagacagggttttcccatgttggccaggctggtcttgaactgctggcctcaagtgatccgcccaccttgacttctcaaactgctgggatcataggcatgagccaccacgcccccgcctgctttcagttcttttgggtatatacccagaagaactggattgctggatcatatggtaattctgtttaatttttggggaactgccacacttgggtattcttgtattttagaaacttcttggttttaatttcttctgtagatataatctacataaacaactattgggatcctcagtaattcaagaactactttaatgaactgtattatcaaggagagggttgaagcagccattgtcagtgagtgtagaaagtgataacgtgggtgagttgggtgacatactcttttgctctcaagtgacccagtttgggtgatatattatatggcccccctagtaatggagttcatattaggcagatggtcacacttggtaatgaggtcgccttagtgttggtgttcctgtggagctccctgaactcgcaaactttaatcttcctatgatggccaaccttggtggaccaaggtttagaatgaaagaaattgctttggagactacatatctcttttgagatttgacatacttaccaaaatgagtaatgattctgacgttcttccagtgttatttgaaattcaacatgaaacttttcctacatgtttctttgttaaaaatgttgagtaaattttgagacaaaatgtacatttttttcatataaacattgaaaccatcatgttgaggattacatgcattctgtgaagtttgtgtattaacaatccgtgtatgtcttcccaggaaaatgttaactgcagagggtttccaactgtgttggcttgatccggtcctttcccctctggcttgcagaacataacacttcctccctaagtgaggcagcatgaagccccatccagttactactattgtgagtggctcagagttcagcatcacagtttaatgcccagtagtctccttcttaggtctagtgactgtgcaccaaagggttatctgtcctccctttcccctccaactgcatttgtggaagaggaacaggatggagtagggcagaataaccaaaataagctttcctattctgacaaggaaagaatggggagacaagacacagtagtgtcttggctcacctctctcctgagtggaaattggactaagatctctgggcgcgtagatggagtcttttgcccggtagacctcattttagggcgaatgggtagaaaggaaagacccccccccccgcccccgccaccaaatccaagaattgggagagttccattctagcgctcaatattcatgctggaagcttaaattaacccagatggtctgtttggtttatttaaagataaaactagttttgagcctggaggaatagccacgttctctgcaggtgagtctgggaatagagcttgtaatttgcatagttgtttcagtgtacagaccttcaatttctgttacaatccctagttcttgctctcatccactatcccgtttgccagatattggtctggagcttctccagggtttcagagggcagacgctccttcttcctccagagccttcctgaagtacactcttggctgcattttctgttttgtttcatccatcttagctcttcagactattttgtcatccagaaatttgctgaaatctcacatccactggtgatgcctgtcccctgctgtttctaaggccatagtgtccttccttgctgtacttactgacattcatttcattgggatattggggcccaaagcatgggctttatctcctatcttctgcaggaagttccaagttgtgtgttttgctttttgtgtttttttttttttttttttgagacaaagtctcgctctgttgcccaggctagagttcagtggtgt

SEQ ID NO: 288 - DNA, 9172 bp, Homo sapiens
atccattgcctccggctctcggcggggccgctggcgacccgcaggctccgcagtctgacctcttaggcgccggcccgaggtcgccagatcaaatcgccgataaaagcccggcgcccacgtcagggggctctgacaaccgccccacctgcgcgccccatctcttcaggtccagcgccgcctacccccatttcgccatttttaccggcgcgcccgccccgaggcgcagaagtagggcgaacggtggccgcagctcctttctcccggctcagccgccggccagcagccgcgccggaacctcggcccacgtgacgcgggcgcgcgcctatggaactgacggtggagttcagcgaagaaggtgccgcagagaattcgcaaacaccaaccgtaaccagagcagctgggggcgcggcggcgagagaagctgcgaagcgcatgcgcgcaggacgctgtgggaggggaaaggaggggaggagcgtggagcgatcgcctagttcccgcgttgcggggcgcatacgagacttggcgactcgctgcctcagggttgcgtgcctccggccctagcctgcgcaggcggcctgagcttggggctctgctacgccacccacgcccaccttggcggagggcggggccccacggctctcaaacttgcgcgccaaagacggagccacctggcgtactggtggaaagcgcagacttcagagccacacccgtagttaagtattcggactctgagattccagggtggggcccaggccatccgcgttttcacccagcatcgtgtgattcggcagcaggtggtctgtggcccgcactttgagaaaccctggtgcagaaggttcatggttagtggttctctctggaaggaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaaggtatttcttcaactgaagacctttacagatactcagatgactgaaatcctcttatcactggctggacatggtggctcacgcctgtaatcccagcactttgggaggctgaggcagattcatcatctgaggtcaggagttcgagaccaccctggccaacatggtgaaaccctgtgtctactaaaaccacaaaaaattagctgggcattgtggcaggcgcttgtaatcccagctattccggaggctgaggcaggagaatcacttgaacccaggaggtggaggttgcagtgagccgagatggtgccattgcactccagcctgggcagcaagagtgaaactccatctcaaaaaagaaaaaaaatcctctattactatataactacttttatgtaccaatttgtagtctcaaaaatataccatcaatttattatatccagtgggggaaatttgtaaatattcaaaataccatttttccctttgccctctcacccaagtttattctgtgcttcaataaatttatggttctatacagatatgttgtcatgtacatctggaactatacttaatcagctatttgttttccaagaacaaggttatgtgctctattgtcaggcacatataatgaagaatgtgtgatttgagatgatttataaaagcttatcatatacatacttttttttgcatttaatttactagcatgtgacacaaccctgttttaaattctgtctccccattacctctattccctgttcaattgcccttccttcctccatcattcatctccttgtgatataacagatacatctaaggtatcattttatcgttctaagcagatattattctattttttcccctccatttgcaatataaagtattcttgatcaaactgacctgggtaattaacctttctgatttactctagctacaagcccataattcaaagtatcttaagccaaaatttagtgtagagttggcaaataaatatcacatatgcagcccttcctccttcccatgctcgtggcagactacgctattttctgccatgtccagacacagctccttgatacagcactctaagccacccttttctagacatctcagtctcactagtacttacaggaaccagctaagctgctagattttataagtattaccaagttttctgccatggttacataattcaagacagcacaattctttattaaccatgtcaagtccaaatgcttatttttaaataaacagaaataagagctattatacttcagggtatcaggaaaatctttcaatagttcaaactgactgctgagtttcaaaatttaagttacatcaggtttatttttcaaagcaacactcagagctaaagctaaacaaatctaacctgtcaactgaaagcattacctccaggtctgtttgcttctgtagtttttgtatcatattcatagtctttttcacagtagcacaaatgcggctcttactctctttctgctcaacagcaactggtttaaagcgggcatacaaagtttgatatcgagactttatcactgacaattcctttaagagtgtaactggatttttctatgtcaggaaaaaagtgaacatgtattaaattatgaaagattaaactttttaagaattaaaatactgtatacatacaacacattctaccatccatttaattgaacactgttgagtatttaattatgcagccacatgacatcagatgggaggtggggaagagagaaaagtataagacctagatcctattctcaaggaatttatagcctaggtacagaaataacccaccaaaaaaattagcaatattaaacagcaaataagggtcaccttagatatataacatttgatggatagttcacaataataaattatacaatatttctaaaatacaattctaaatgctattcagaagaagataaaaggcactattagtatttgttcttaaagaataagaacttgaaactacttataaaaatcttttttttttttttgagatggagtctcactctgttgcccaggctggagtgcagtggcgcaatctcagctcactgcaagcttcacctcccaggttcatgccattctcctgcctcagcctccggagtagctgggactacaggcgcccgccaccacgcccagctaattttttgtatttttagtagagaaggggtttcaccgtgttagcaaggatggtctcaatctcctgaccttgtgatccgcccgcctcaacctcccaaagtgctgggattacaggtgtgagccactgcgcccggccaaaattcgtaaacatactatcatggggataaagtatgtataaatatcaatttacttatatacacacaaaatataaaattcatgccaacccaactgtatttataaactatgctggttttccagatttattttgtaatatacattaccactattccataaaagacatttcaattggaccccttctgccacttggtaattcttttctttaattttttttttaaatagatacaggaatctcactgtgttgcccaggctggtcttaaactcctggcctcaagtgatcctcctgcatcagcctcccaaagtgctagaattacaggtgtgagccactgtatcctgccagatttctttttttatgattaggtaagattcatatattttcaggccccaccaagtgacagcacaattaataaaaagatctataccataactgtaaattttcgcaggatagaaaaaatattctgaaacttccaggtgataggtaagggactggggtaggctgaggaggaaagcacagacaaaggatcaggaatgagaatggcatccatttttcaacagcaacaatagaagctagaaaaccacgaagtaatgatgttaaaattaagagaaaatctccaatctagaatcctatattcaaccaaaccactcatcaaacaaagggttaggccgggcgcagtggctcacgcctgtaatcccagcactttgggaggccgaggcgggcagatcatgaggtcaggaaatcgagaccatcctggctaacacggtgaaaccccgtctctacgaaaaatacaaaaaattagctgggcattgtggcgggcacctgtagtcccagctactcaagaggctgaggcaggagaatcgcttgaacccgggaggcagaggttgctgtgagccgagatcgtgccactgcactccagcctgggcgactgagggagactccgtctcaaaaaaaaaaaaaaaagaaaaagggttaaagggtacaataaagactttttcaaacattcagcatctcaaaaagttaactttctgtgtaatcttcctcaggaagcgtctaaatgatatacttccagatcaaagaaataaaccaccaaagagtgaaacatatgatacaacacaggaataaaacaaagggaagtaccaaaataatggtaaagaaatcccagaaatgccgggcgcagtggctcatgactgtaatctcaacactttgggaagccgagacgggtggatcacctgaggtcaggagttcgagaccagcctggccaacatagcgaaaccccgtctctactaaaaatacaaaaattagccgggcattgtggtgggcgcctgtagtccttgcctcagtaggctgaggcaggagaatcacttgagcctgggaggcagaggtggcagtgagccaagatggcaccattgcattccagcctgggtgacaagagcaaaactccctctcaaaaaaaaaaaaaggtcgggcgcggtggctcacgcctgtaatcccagcactttgggaggccgaggcgggcggattgcctgaactcaggagttcgagaccagcctggccaacatggtgaaacaccgtctctacgaaaatacaaaaaaaaaaaaaaaaaaaaaaaaaaaaattagccaggcgtgtcggcatgcgcctgtagtcccagctactcgggaggctgaggtgggagaattgcttgaacctgggaggcagaggttgtagtgatccaagatcacgccactgcactccagcctaaccacagagtgcgactccatctgaaaaaaaaaaaaaatcccagaaagacagcaattcaagaagcctatagagcaggaggtcagatgggagcaggatagagacaccagaaaggataggatgtttccatgggagaaaataaaacttaaagaacatgtagtgtgtctgacaatattgagaagagttttacagttgttagaaatgtctgaggctgaattagtgaaaagtatatagaaaaactaagcaggctgggccatggtggctcatgcttgtaattctagcactttgggatgccaaggcgggaggatcgcttgaggtcaggagttcagtaccagcctgggcaacatagcgtgaaacctcatctctacaaaaaataattcaaaggctgggtgcagtgactcacgcctgcaagtcccagcactttgggagaccaagaggggcagatcacttgaggtcaggagttccagaacagcatggccaacatggcgaaacctcatctctactaataatacaaaaattagccgggcgtggtagcacacgcctgtagtcccagctactcaggaggctgaggtgggaggatcacttgagcctgggaggcagaggttgcagtgaaccaagatggtaccactgcactccagcctgggcgacagagcaagactccatctcaaaaaataataactattattattttttaaattagccaggtgtgctggcacatgcctatggtgctagctactcgggcggctaagcagggaggatcacttgggcctgggaggcagatactgccgtaagccatggtcacagagtagctgggactacaggtgtgtgccaccacacccagctaatttttgtagttttagtagagatgaggtttcgccatgttggccaggctggtctagaactcctgacctcaggtgatctgcctacctcggcctcccaaagcgctgggattacaggcgtgaaccactgcgcccaacctttaaattattttttgtagagatggggcttccctatgttggccaggctggtctcaaactcctgcactccagcctgggcggcagagcaaaaccttgtctcaaaaaaaaaaaaaaaaaagaaaagaaaagaaaagaaaaactaagcaaatggaaggaaaaaaaagaaaacaattattagctctagaaaaataagttgtgaagaaaggaaagcagacacagtattcaatagggcttatataaaagagttacagaaattgtgaagacaggaataaatatgggtagtaaagtatttaaactttatcttccatagtacaaaattcttttttttttttttttttttttaagagttagaattggctgggtgtgatggctaatgcctgtaatcccagcactttgggaagctgaagcgggtggatcatgaggtcaggagtgtgagaccagcctggccaacacggtgaagccctgaatctactaaaaatacaaaaattagctgggcagggtggcatgtgcctgtaatcccagctactcaggaggctgaggcaggagaatcgcttgaacctgggaggcggaggttgcagtgagccaagatcatgtcactgcactccagcctgggcaacagagcaagactctgtctcaggaaaaaaaaaaaaaaaagttagaatcttactctgtcacctaggctggagtgcagtggtgcaatcatagctcacttgaactactgggctcaagtgatcctcccacctcagcatcccaagtagctgggactacaagtgtgagctactacatcaggcctatagtaggaaattattattaatgataacagctaatgtatagcacttactctggactaaacagttatatatgttaactaattttattttctctcaatctctgaggtacatagtaatattcccattttacagatgaggaaattaaagtacagaaaggttaactgacttggctaaaatcacagtgctaataagaggcagagccaggatgtgaagtataacagttcgtatccaggaaattagtagatgtttcagatcaggaaaaataaagatgcagtacaaggaaaactatttagaaatataaaggaaataccataagacactgagatgagtggtatccttcttgagggtgggagtgtgaagcattattctttgtaattataagctttatatttctgcaactcttcaaatatattcaagaatttgacaaaaataaaagtttaggccggggtggtgactcacatctataatcccaacactttgggaggctgagacaggaggatcacttgagcccaggcaagaccagcctagtaaacatggcaaaaccccatccttactaaaatacaaaaaattagaaccaggtgtggtggcacacacctgtatttccacctacgcaggagactgaggtgggaggatcacctgagcccaggaggtcaaagctgcagtgagccatgatcatgccactgcactccagtctggacaacagagtgagactctgtctggggaaaaaaaaaaaagtttaacattgggagggaaattggtaggagggaagaagtcatcttcctcatgaggtgataataaattatgtaacttaattataaatgatctttaggtaactggaatgtagctcagtagtgaaatacccagagatctgcatgtattaatataactcaggagaatgatgagttccccaaatacagattcatacaggaaaaaataaaagtgacaagaactaatccttgaggatctcacaaaactaggaaaggaaagttggtatataaagcataagaaataaatggccatagagctaaaagagaggacagggtagttgggcagctacccataatacatgtttttatgacattagctcgatcaataagactgacatggcagtgagtaatttaggacaacatgatttgcatttatggcctgtttatgacaggttaggactgtggttaggacttagcaccataccacaaaggaaaaactgttgtgcgcatagcctgttttatttgagtaactggctgttgggaaccactacattcttttttttttttttttgagatggagtttcgctcttgtttcccaggctggagtgcaatggcgggatctcagctcaccgcaactttcgcctcccaggttcaagcaattctcctgcctcagcctctcaagtagctgggattacaggcatgcgccactacgcctggctaattttgtattttttttttttttttttttttagtagagatggggtttctccatgttggtcaggctggtcttgaactcctggccctcaggtgatccacccgccttggcctcccaaagtgctgggattacaggtatgagccaccgcgcccggccaggagcctctacgattcttttattagtgtttgtaaactgtgctgcactttagttaattttgtgcctataatacttcaattcattttagggttttagttatcatgagtggatgataaaaggttacaagaatggctgagcgaggtggctcacgcctgtaatctcagctttgggaggccaagactggtggatcacctgaggtcaggagttcaagaccagcctgaccaacatggtgaaaccccgtctctaataaaaatacaaaaattagccaggatagtagcgggtacctgtaatcccagctactcgggagggtgaggcaggagaatcacttgaacccagtgagccgagatcatgccattgcattccagcctgggcgacagggtgagactccgtctccaaaaaaaaaaaaaaaatgattacaaaaatacataaaaatactctgctaatgatagtgctggtgatgggagaaaagaaaagccaatatatgaacaaaaagctcagttcaattaagtcttttgaaagaaacaaaaggaaatgaattatactactaagcttaaaagaatctatagggaaaatgttcataaaataaaattatgtttctctgccgggcgtggtggctcacgcctgtaatcccagcactttgggaggcagaggagggcggatcacgaggtc

SEQ ID NO: 289 - DNA, 2068 bp, Homo sapiens
tataagtgagattgctgacacacaaggaggatgagttccacatatgctcaaatacaaaactatccctcataaacagaataacctcatggttgagtcctttggtactgcttaaaatttgggtcactctcagttaccttattttacacaataaaatagcatgagatggagacatcttaatttgaaacattctcagtcatagctggagttggatgaatctagaaatataatttaaattaaaaaaaaattcaggagaaagatacttactttgagataaaaactattagggtcaaaatattgccattgagaacagtgagcaagtgtgtgccagtgtcagatattgtatgcatccaaagacaatggctttcaaggagaaattctgaaggaagtttggcctcctgtcttagtattcagatttaaatcttggcatttaaaaatgttaaattaatgaccgatcaattccaaataaattaccatctttagaggtgacgctaatcaatggaggacatggcatggttggtttgagaaaggcctcatttgacattgaggaagatgggataatgatggcttagtatttgtgatttctactccaggtcattaaaacagcaaacttaatagctctaatttttctaaaactcgacccatgcatgcattaaaataatcagcctaaaagcttgatttgtatttgattagaattaaaagacactatatgtcacaatggtatttgatgacaacccctgaaatgaaaatatcttgacttaaatactgtgctggccattagtagtctcatcaacacacagaataggaagagtagatttgcattctagtgatcatgagtcaagtgaacatagaacttttaagagacaagtcaggttgagagaaatgccatatatgaaacttacgtcctaaaggaaagaagttgagctctaagttaactagtctttggaaatttgtgattctgttcatggcatgtagaacttagagactggtgatatttttgtgtggtctctaaactgttgcccattagccagttcatcctcacctgtcctctaagctaatcacaaatttgcatccagattatataaatgtcaaggtcacagaaaaatatgaacgcagccaaaattagctatgctttctaaaatgtttgttccacccataaaagctttgcttaattatacaaataaagacttttgtttgttcatcataaaaaaaaatctattcaatactctttttctttttcttgctattatttatcctcactcccagatcgactttgcctaaattaactggccactgcaaatcaagataagaaaagcaagattactttcagtacaaaattgtatagacagacactgaattcagtctgcttcttgggtcctttctctggctcaaagttaagatgctcttgtaatgttccatttaggagcttaatgtttttccgataaagtgattataaagtttatatgtttaattaatttgcagctaaataattgtaggccctgctcttctcagtgaaggaggaaaactaacaacaatagagggaagtttttcttttcaaacatgagacaagaaagagaccaaaaagtttattgattctaatttcatcatgttatagctaaggaaactcagcccaaatgagttacatatcttggctcaagtgctaacattagccaatgaaagtgccaggactaaaactcctaattcctaatccattgttctttgtacacagtgtaatttgcaaaacacctttatttgttacttcatttgactctcaaaaatgtctttggaagttacctagtaagaaaactgaaacttaaactcacagatttaaaatatagttcaagttatatttaaaatataagtttaaatcagctggctcctcaattttatctttagcccttacctgtccctggataccaaactcatatatccacctgccctcctgacatatctaattaaatatctactttgtatctcaaacttaacatgccaaaataaaatctcgatctccttatccatcctctgttcttacccagcggaaccatgggctttcaaatcttattagatggta

SEQ ID NO: 290 - DNA, 823 bp, Homo sapiens
gtaaaggttgaagtcaatagatttggcagtattaggtgtctggttacagggctcctttcaacactggcaaaatgaacattattgccaccaatgatcccttcattgttttcaactacatggtcctcatgttccaagttgattccactatgtcaagttcaatggaatctttaaggataggaatgggacgctcatcatcagtgggaagcccatttctatcttccaggaaacaggtcccaccaacctccaatggggtgatgttggtatgggggcccctggtgtcatcactatcttcaagaagattggggttcacttaaaggtgaagtcacaaaagtcctcatcgctgcttcttctgctgattcccccatgtgtgcaaggagagtgaaccatgagaaacataagcattccctcaagactatcagcaacaacacctgaaccaccaactgtgcagccctcctccccaagaacatccatggaactctcccagcagggaggacctcactgttataaacaatgccatcagtgccactcacagactgtggatggtccttctggcaaaccatggtgcagtggtcatcgtgctgcccagagcagcatcctcaccatcactggcacggccaagactgtcatgaatctgacttgccaccttgagaacattgccaagtacaatgacatcaagaatgtggtgaagcaggtgatgggggcttccgaagagcctcctgagcaacattgaagactagattgtctcccatgactctaatagtgtaacgctgtggatgcagggcctggcttcaccctcaatgaccactttgttaagctttttagt

SEQ ID NO: 291 - DNA, 3784 bp, Homo sapiens
ctgagagccagccccccgtcccccacagcttaggacctccatcaaggatcctaagaaccttaggacccacctggaggactgtgggtattaggtgtccaagaagaaagctcaaatctgctgacggcaggtaccttgcttgggatttactatccgacaggggtccgaacgcagcccgggaacagaaagaaagcaggttatttacaatctaccggagcctaagggcagaaggcaggtaagggaattcttgggagctgtggggttttgtagactggatcccaaactttgcagtattagccaagcctttgtatgaggtcacaaagggggcggggaacggaacctttggaatggggatcccaagaacaaaaagtctttcaggagttaaaggaaaaacttctggcagccccagccctggggctacccgatctgacaaagccttttccattgaatgcgtcagatagagaaaagatggcagctggacttttaaccgaaactctggggccctggctgaggccggtggcctagttgtctaaacaactagagagggtttctaaaggatggcccctcatgtttgagggccgtggcatcaactgccctgatagtacaagaagcaaataagctgactcttgggcaaaacctgaacataaaggccgcccattttgggttgggtgacagccatcccctcttccccccctgccttaggacccccatcgcgtatcctaagatccttaggactcacctggaggactgtgggtattaggtgtccaagaagaaagctcaaatctgccaacggcaggtaccttacttgggatttactggaggactctgggtattaggtgtccaagaagaaagctcaaatctgccgacggcaggtaccttacttgggatttactatccgacagcggtccaagacaggggtccaaacgcccgggaacagaaagaaagcaggtcatttgcaatctaccggagcctaagggcagaaggcaggtgagggaattcttaggggctgtggggttttgtagactgtgcatcccaaactttgcagtattagccaagtctttgtatgaggtcacaaagggggcggggaccgggaacctttagaatggggatcccaacaacagcaagtctttcatgagttaaaggaaaaacttctggcagccccagccccggggctaccagatctgacaaagccttttccattgaatgcgtcagatagagaaaagatggcagctggaattttaaccgaaactctggggccctggctgaggccggtggcctacgtgtctaaacaaatagaaagggtttctaaaggatggcccccatgtttgaaggccacggcatcaactgccctgctagtaccagaagcaaataagctgactcttgggcaaaacctgaacataaaggctccccattttgtggtggctgagagccagcccctcttccgccccaggctcttaggacccccatcgcagggaggggaggcaccccccacgaggtagggactgagagccagcccctattcttgatttagccaatttaagtatgtaaaacggggggaaaaatgtgatgacagcctagttttaaggcattgatttgattgtgttgtaaaaaatacattcttctttttctttttttgagacggagtcttgctctgtcacccaggctggagtgcagtaagcccatctctgctcactgcaagcttacaccattctcctgcctcagcttccctagtagctgggactacagatgcttgccaccatgcccggctaattttttttgtgtgtgtttttagtagagatggggtttcaccatgttagccaggatggtctcgatctcctgacctcgtgatccacccgcctcggcctcccaaagtgctgggattacaggcgtgagccaccaagcctggccaaaaaatatattctttcagaaagataacatgtttgttctttcattcagtcaatatatatttattagtgttattgctatgccagtgtcttagtccattcgtattgctataaaggaatacctgaggctggggtggtgccatgttggttagaatggtgccatattttctgggatagcaccatgctggctgggatggtgccatgttggctgggatggcacctgcctcagcctcccaaatagctgggattacaggcatctgccaccatgcctggctaattttttgtatttttagtagagaaggggttttgtcatgttggccaggctggtctagaattcctgacctcaggtgatccacccacctcagcctcccaaagtggtgggattacaggcgtgagccaccacacccagcccagatttcttttatcacgctccataggctcaatagcaggaaacgtgtagagattcctcttgggaactggtcaccatatcatttggatgagctacagacagaccttcaatcatcctgtatcttactgttttgctatctctgtacactgcagttatgtggacatgtgtcacctccgccccactatccagaaatgtgggctcctatgtgcagggccagatctgctcccatgtgcatcctcatcacctggcaccaggcctgcccatgctaagcctccataaaattgttggactaaaaggtgacataggatactcaacttctcccagccatatgtcttcatgaaccaaatggcagtgcagaaagggaatgtttgcagtttcagtgggcctttctgagggcactgcagggcacacttctcccaccaggcccttggtggaggtgcagaatggggtctcttcagaagccacttccagagcccctaccaagggtggctcagaaggtctggttttcaatgagtccactagggaagtccatgtgtgactgattcgacctcgatgcttctacttcgccttctttccatctgactgactcagacctaatagtagggttctaggctgctccatgagccaaataaattttctgctcttataaatgactcagtctgtggtcttctgttatagtagcacaaaacagactaagacaccattccagagatatgcaaatattcaactgtaggtctccaaaaatgagatggcaatttcaagttcagctctgacagaagtaacaagaaggtacacacaatgagcagcacacacatctcccaccttctgggcacatgtggcccacatctagccagtcttcctgagccagcgggtcccaaagctgtctttggatcattgcttctccatgacaatttttgccagctcttcactggcctgcagcgttcctttcaagtaaattcctgacctgtgggggacaatctgggcccagcgtgcacccctggtcgcgaggaccacatggccagagaagcagaaaggaggcttcaggcacgagaatttaggttcttcagctgccacaagtgaagagcaccacttgtattttttattactacctgctatggactgaattgtgttcagttcataacacgtagtaataaaaatgtgtaggtcgaagccctaatccccagtatgatggtatttggagttgcagggcggggggctttgggaagtgattaaggataaggtcaagagagtggggtcctcatgatgggattagtggctttataccaagaggaagagagaccagagttctctctctcccttccccgccctccccccacctctttctctttctctctctgcaatgtgaggacatagcaagaaggtgccatctgcaagacaagcagagagcatcctccccagaaaccatgtctgctgcaccttgatcctcaattttccagtaagaaataaatgtctg

SEQ ID NO: 292 - DNA, 3386 bp, Homo sapiens
gaaggcgggggacccgggacttccaagtgtgttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgagtgtcttaggtgaggctggactcttcctccgagaagatctgaaatgcagtgagcacttttgcttgaagacagggactgattttggtagcatcctttggtctcttctagtctgggagtcagagaaagtttgcatcaaaatgtcatcaggccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaagcgtgggaaagtcctggagcatcgattgtttcctcctctgcacccccgataccctggcattagcactctcccagaatgtaccttgcttgtttgattggaggaggtcaaagccctgatgaagaatgagtggaattccacaggattggagcagtcttgataaatgacagcaggggatggtgtggggaggggaaaggatcagaggaagtgtggataaatgaatggcttaaaaaataatccacctttgcctcccccttttctaccagtctgtctagtgcttcagggtgaaaaaaaaaaaaaaaagcttgcctttctaaacatttggagtttcagaaatgatctatagagcatgtttagtttttcaagttaaaaatattaaaagaaaaaaaatgtttgagggctttactgctttcccgcaaagagctagagccacccaagcaggattgactgtcattggtttgaggtttctgtttgctttgaggctattttttccttagtgctataaactagatcagtccatttttagctgataaccctttccaatttcgctgtgaaatgaggggctggttgggtggtttttttttatgttctttccagcgttgacttttatggtctttgattccaaggtacctcgtcgactctgaagacgagagatgggtaggttctaactccagatgagccactgcaagatggtaccaggatgagatagagagtctctgtactatcttttatatgttctcaaacccagccagggatcagagtgacaatataacatggggaatcatagagatgtttatggtaattctgctatgagtcaactgagatgtcccttatggagataacttcccatactataggcagttggacaaagatgtaaatgccttgtttacaaatgctacccagatctcctaattaggaccacacatgcggagaacccaacagcttttggacttatcggccaatggtcttcttgggaaggtctctcctagtcatgggaattgtctttttattgttcaagcttttgcatagacctggaagaggcatccattgctgttacccctgagtttataatcatgctgcaagtccagtggggaactttggcacaaagcattgaatgagatgggactgcacttatgtagcctgcatttcttgagaataaagatttctgttcatttagtgcagtggttatcatctgggggaaaaccagtgagtagaggccagggatgccactaaaatccctacactgtgcaggaaagctgtcagccctttgtcccacaagagattaactggttccaaaagtcagtagtgctgtggttgagaaaccctgtttaccacctgtaggttccagagagctcggatggtggtggtcattgtgctaagtttcaaattcagtatttaggtttggtttttagcttataggcaacaaattggctgactatggggtgaaaaggaagcacctcctttatcaagattggcttcaaaagatgtctgcctccccttctggtgggtcctgtgtccattcacagtgtgagaaatggaaaggaggtcactaagagacttgcaatggatgtaataactggatgcagaaactctggatctgaagggaatgttcatgactatttcatccctcctgctgccttggagaaccaaacgcaggagccacccaaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttctacttgatgtggaaatcctttctacagtaactctgtgtgggaatcacagttcacttaggggcttagtctcatagtcaaaatgtcttcttcctaagtgggaaattacttccagcttctattcattcagtagttgtttaatactatctctctctctctctatatatatatgtattatatata

SEQ ID NO: 293 - DNA, 1030 bp, Homo sapiens
ctgttatcagactgtatagaggtgggaaggctaaactgaggaattatgtctgacagaagggaaaaaatgactgtggtggccttctcagaccctgtaggaaaggcctctacctatccagtaaaagtgtctacctagattaataggtattttagttatctgacttggggcacgttgagtaaagctaatttgccagtcctgggtgggagcaaatcctggagcttgatgtgtagggaagggaggggggcctgaataatccctgaggagtagtagaatagcagatggaacactgagaagttatttccttgaggatagatttccacgatggaaaggaaatgagaggttctaagaggcaggctagtggcttgtactacagcatagcctgcctttgctggtgtgtggcgattaggcctggtggaaccgccatcaataaatcaagtgtgatcagggtgaggaacaggaaagaaggaaatatggggaaatggggtgaatgtcaggtggatcagagagatacagtcatgggggtcaggtgtggtatcaggaataatgtgggaggccagattgaaatcctggccaggaacaatggtaattgtgggacttaacaaagagtgagtacagctgaaggagctggggagcagaaagtatatgcatcaggtatgaggaagaaaatagattttggaagttatgagaaatgtagagagtgagttgagcatatttgtgattttgagggcctctgaaagtattaaagcagtggcagccgctgcacgcagacatgagggctaggctaaaacagtaaggtcaagttgtttggacagaaaggctacagggtgccgtcctggctcttgtgtaagaattctgaccgcactaaccatgcctaggaaggaaaggagttgttattttgtaagggcttgaggtttgggagattaatcggacatgatcagcagggagagcacgtgtgtttttatgagaattatgccgagatagggctgtaaagcgtgtcagggttgctgccgaaggagccatgaactgggct

SEQ ID NO: 294 - DNA, 755 bp, Homo sapiens
acctgtctgctctctggcctgcctcagtggtctacagcagttacacacaggcagtggtatctgtgagcagctctgtggactcaaaggttttctccctgagaggcatgacccaggccagctgattcatcagaatcagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggt

SEQ ID NO: 295 - DNA, 8400 bp, Homo sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagaatcctaccaacttcacttcttggccttataggaaggagccacagtcccaaagaagtctggggagagcaggatgtggcagagaacaatgatcggtgccttgtttcaggaggcaaacgtggcccaatccagggaaatcagcagatggcatgtcatggccatcgcagatctgaggagctggcctttgggtgatttctggtccacatgacaaacattcaaggtgaattagaggagaaaagctacatgaagtgatgtgcaagttgaaaagagaaaagggtgtggtgctatccaggaaccatctaacgaaaaacctcttgcaaggcagattgagaattttaaaacaacactctccgacccaactgccccgtgacatctgttaacacaaaaggcagaactatttccaggaaaagctctcagtgtttgcaaggcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 296 - DNA, 8300 bp, Homo sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagatttcaggaggcaaacgtggcccaatccagggaaatcagcagatggcatgtcatggccatcgcagatctgaggagctggcctttgggtgatttctggtccacatgacaaacattcaaggtgaattagaggagaaaagctacatgaagtgatgtgcaagttgaaaagagaaaagggtgtggtgctatccaggaaccatctaacgaaaaacctcttgcaaggcagattgagaattttaaaacaacactctccgacccaactgccccgtgacatctgttaacacaaaaggcagaactatttccaggaaaagctctcagtgtttgcaaggcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 297 - DNA, 734 bp, Homo sapiens
tatttccttaagataaatttctcaaagaagaataacatttatctagatggatatttaccaaattccacctcactccctcagaatttgatgcctctttcccaggtccttatgaacattctcaatgacagtgtttaaaagtgttggttttcccttttcttcatcaacactaggtattgccatttgttagcataaagagtataatctttgccattctgatatatagaaaaacagttacatatcactttaatttgtatttcttcaacagctagtagagcaaagtcttttattacatgtttctggtcatttgtaattgcttctggcaacaaacaaacaaaaaaccttaagcaattttttaaaagcccatgacattttattttaaaggtccattttaaagcaaaaaagtaaaattgaatcattgccataatcagattacttttaattaaagcatttcacacctagagccctcttgggaaggtatgaagtttttacttcaactaataatccattcttctgtaacctaaatggttcctatttgaacaatgaaacatgcattattcctttaggacacatgatcagtagcctcgggataaaaacaaaaccagaaatattcagtgtttggatagataaaatggcaacaacatttcttcctctgattatatctgcttcatctgcatgcagttttgcattgggcaatagatcttgtgtttcaatactgattggtatgaattccaaaa

SEQ ID NO: 298 - DNA, 1524 bp, Homo sapiens
ggagttacactgtttgtgatatggtacatgacctggtcaatcttaggctctgaagctctccctggtggaaatttatttggattgttaattattttttatagtgccattattgggggaaaaaatttacaactcattagaatacctttagtgccgccatttccacctcttcttgggatgttactggctggttttacaattaggaatgttccattcatcaatgaacatgtccatgttcctaacgcatggtcttcaattttaagaagcattgcccttaacattattctaatacgagctgggcttggactcgatccacaggcttggaggcatttgaaggtggtttgtttcagattggctgtaggtccatgccttatggaggcaagtgcagctgctgttttttcccacttcattatgaaatttccctggcaatgggcaattctattaggttttgttttaggtgctgtctctcctgttgttgttgtcctttacatgatggtgttgcaagaaaatggatatggtgttgaggaagacattccaacctactaatggctgctagcagtatggatgacattctggctatcactggattcaatacatgcttgagcatagtcttcttctcgggtggtaagcttaataacgccatagcctctataaggaacgtatgtattagtcggctggcaggaattgttttgggattttttgtttgatattttccaagtgaagaccaaaaaaacttacattgaagagaggattccttgttttgactacgtgtgtttctgctgtcttaggcagccaacgtattggtttacatggatctggaggattatgcacattagtgttgagtttcattgcagggacaaaatggtcccaagaaaagatgaaagtccaaaagattattacaaatgtatgggatatttttcaaccacttctttttggtttagttggagcagaagtatctgtttcatcgcttgaatcaaatattgttgcatatctgttgccactctgagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctctgcaccccacttggaaccatatgcgaaggatgtgatgtcagtagcatttttagccatctcgatcacagctccaaatggagctctacttatgggcattctggggcctaaaatgcttacacgccattatgatccaagcaaaataaaactgcaattgtcaacattagaacatcattaaaaagtttacctgtcatcatctgcctgcttcttttaatgaattatttcacatgacagaagaattttaaagtagaaatatgtagggactgtacagaaaatccaggatttagtaaacatgtgatttcagtacagggcttttcttggactttttactccaaagttaatttaataaaaataatattaaatggaa

SEQ ID NO: 299 - DNA, 12631 bp, Homo sapiens
gctgtgttctcatttcacccaagacctttggctagatcagaacataaaaaattcatttcaaaaagtgatactgagaagatatgagaaatctagacatgagaatttacaaataagaaaaggctgtaaaagtttgaatgcatctaagttgcaggaaggaggttataatggacttaaccaatgtttgtcggttactcagagcaaaatacttcaatgtaatacatgtgtgaaagtctttaggaaattttcaaattcaaatagacttaggagaagacatactggagagaaacctttcaaatgtaaagaatgtggccaattctttcacaggttctcacacctaagacaacatgagataattcatactgaagagaaaccctaccaacatgaagaatgtggcaaagattttaagcagtcttcaggtcttactatacatgagagaattcatactaaagagagaccctacaagtgtgaagaatgtgacaaagcctttaaacaatcttcaaaactgaataaacataagaaaatttatactggagatacaacctacaaatgtgaagaatgtggcaaagccttttcctattcctcaaccgttactcaacataacatagttcatactgaagacaaaccctacaaatgtgaagactgtggcaaagctttgaagtagtcttcaaacctgactatgcgtaagattattcatatgggagagaaaccctacaaatgtgatgaatgtggcaaagcctttagaatatcctcaaaactgaaagaacataaaagaattcatacttgagagaaaccctataaatatgaagaatgtggcaaagctttttactgttcctcaggccttactcaacataacatagttcatactggagacaaaccctacaaatataaagattgtggcaaaatttttaagtggttttcagaccttactatacatcagagaattcatagtggagagaaaccctagaaatgtgaagaatgtggcaaagcctttaaacaatcctcaaaactgaatgaacatatgagaactcatactggagagaaatcctacaaatgcgaagaatgtagcaaagcttttaagcaaccttcaggccttactctacataagagaattcatactggagagaacccttacaaattcgaagaatgtggtaaagccttttattggttgttaagctttactaaacataattgataggggagagaaaccctacaaatgtcaagaatgtggcaaagcttttaagtggtcttcaaaccttactatacacaagagaattcatacgggagagaaaccctgcaaatgtgaagaatgtggcaaagcttgtaagcagtctttgggccttactatacaaaagagaattcataatgaagagaaaccctacaaatgtgaagaatgtgataaagccttttactggtccttaagctttactaaacgtaagatagttcatactggagagaagcactacaaatgtcaagaatacgtcaaagcttttaagcgtcttcaaaccttactatacataagagaattcatactggagagaaaccctacaattgtgaaaaatgtggcaaagccttttactgttcctcacaccttattcaacataacatagttcatactgaagagaaacactacaaatgtcaagaatgtggcaaagcttttaagaagtctttagaccttaatgtacataagataattcatagtggagagaaaccctacagatatgaagaatgtggcagtctttaaacaatcctcaaacctgaatgaacgtaagataactcatagtggagaggaatcctacaaatgtgaagaatgtggcaaaggctttaaacaatcctcaaacctgaatgaacataagataactcatagtggagaggaatcttacaaatgtgaagaatgtggcaaaggcttttactgttcctcaagccttactaagcataagatagttcatactgaagagaaaccatacaaatgtgaagaatgtggcaaagcttttaagtggtcctctgaacttactatacatcagagaattcatactgaagagaaaccctgtaaatgtgaagaatgtatcagagtctttaaacactcctcaaaaccgaatgaacataagagaaatcatactggagagaaaccctacaaatgtgaagcatgcggcaaagctttttaagcagtcttcaggccttactatacataagagaattcatactggagaggaatccagaaatgtgaagaatgttgcaaaaccttttactggtctttaagctttactaaacataagagagttcatattggagagataccctacaaatgtcaagaatgtggcaaaactttttcttgttcctcaagtttactcaacataagagagttcatactgaagagaaatcccacaaatgtaaagaatgtgggaaagcctttaaccagtccttaagccttactaaacttatgagaattcatactggaaaaaaatcatacaaattggaagactgtggcaaaatcttttaagtattgctcaaatatatccagccataattcatactaaagattatgcctatgaacctaaggaagtttggcaaagcttatgaatacacctcaaactttcctaagccttggagaaatatcagtgagaaacctcagaaaactgaacaatgtggcaagccctttaaatggttgtcacatcttactgtaggtaaaataattgatagtggagaaaatctctacaaacaaagaatgtgtcaaaacttctaacatgctcatactttatggcacataaaagcgtttatacttgaaaaattatacagagtgtggaaaagccatttctatctgctcacatcatagtcaacatcaggaagttcatacttaataaaattattataaatgtaattactgttcaaagaccttggaaaatataaacccttaaaataaaaaagagtattctggagacaaacattacaaatataaagagggttgtaatacctttacttgccctatataatgtacagattttacactagaagaaaactctaaaggaattactcaaacttgtttggcatcagagaatttatgttgaaggaaaccgtacaaatgtaataagtgtggaaaaacatttgttcagaaactacagcttacaaaacaccacacagtttataataaaaaatatttttgcagatggaatacatatgtaaaaatatttagtcaaaattaagtctttgtaaactttagaaaattcacggtagggagaactaaggcactggcacttaagacgttacactaaatcagaatgttctgtaaagaaagtaatccaaagctaaaactgttggataatttatttgtatataagtttaagaggagtggaaggttattttttggagagttaaaattacattcaaggtatacgtttttccttgaaaaaagtgtaagttttttgaaaagcaagtaggtaattcaactgtaaaattgcttcatgctgttccttttttcctgttgtttgtgtaaaagcatgtcatcaatttctgttgcatcagaaatctgagagattcctttcttattaggtaggcatcattcattaatttttccatggaagagtaaggatattaaaatgtaagatgataatgaaaatctgattggagaggctctttatggctgacttttaacattgttcatgtgatgcatgagttatgtgtttagagtaatattctgcattatagtgagaggaaaactttgagttttagtagtaaattgttttaccaattgtacttttatgtaataaaatgtagggaattttaaaattcttttataagactgtgataacttaacttttaaattaaacgaaatggttttaaactttttaagacgtgcatttagtaaagtgttatgtcaccaactttaacgtatcccactgtattaaagatgtagataaaagatggtaacatagtagaatgacctctctagcaatctcttttgcctgtggcattaaactgaaaagtttaacagtattgtttcaatgggtaaaatgtacatttgtttaactttttaaatttttgtaggaacataatattgtttacctatttatggcatatatagaatattttcatacaggcatacaatttgtaatcacatcagagtaaatgaggtattcattacctaatgcattttttttgtattacagacaatccatttaaacatttttagttatctaaaaatgtacaagtaaattattacttgctacagaggttttttatcgtcttgataataattacatagtagtataataaatctcacatttctaagtcctgaatgaatatttttaaaaatttgtcatatatattttgaacaagtggactctctgcctgtaaactcatgcagactgttagtttttacttacatgatgctaaatatacaaatatattactcttaagataaacattaggtgtaagaaaattgtggggcaagtaattgtgtgtgagagtacctattttcagaagacaagcaatattggaacaaaatatcactttaataaagtggacaaatcatttactagaaaaccagaaacctcagtgattttgaataatatctgtattctctgcattttatttaattaattactgtgaagtcttatggactgtgtttccgaatctttccatgcaaattctttctttcatttgcctggtactcatggtagactgattttttttttcatattttttgtgtttataatttattaagtattcattatgtgagttgctcagatattctaagaatttttataaaatttagtaatgcatgcaaaataatttttcaatgttatttcacaatgagtgtattaacttatatttcttttgttgctttcttttttcttttttttttttttgagatggtgtcttgctctgtcacccaggctagagtgcaatggtgggatctcagctcactacaccctccacctgctgggttcaagcaattctctagcctcagcctcctaagtagctgggactacaggcatgtgccaccatgcccagctaatgtttttgtatttttagtagagactgtgtttcactatactggccagagtggccttgaactcctgacctcgtggtccacacacctcatcctcccaaggtgctgggattacaggcgtgagccactgcatctgaccaacttatatttcatttagttagaacatcccattttgttattttaattggagaaacctgtgtaagctaagtttccttattgttccttttactctttataattgacataggtgaatttattcattcagccaatttgtttaagtaaatactggggaggcttcataagtcacaaagatattttgatatgtaaatgtagcaaacacaatgcttgctgtaatagaggcaccattattggccataaatatttctgctggagttagtttgtagctccaagtaaagataaagaaatatgcgtggtgaagaaataaaatcgattctgtatgtggagaggacgttgttcttatgctgcaaaactgactctttctgaatttaaagagacattcttcttattttctgattatctttagttttgtttttgtgtctacttatgtttatcccaactgtgtatgcatcacagcccttctttttcttctttgtgttatggctacatttttattgctgtttgttttgtgccatgtcatttcacacagtactttgtaggttctgatgagaagtttgtcaatgtaactttcagatccgttaattgagataaaaggcatccggtgttcacaggtgagaggaataaatcagtcagaatttcttgtctttgtaaaaccaaacttttattaaattttaacacagtctgtgtgtggtggctcacgcctgtaatcccagcactttgggaggctgaggtgggagaatcactaagtcaagagattgagaccttcctggccaatatggtgaaaccccatctctactaaaaatacaaaaattagctgggcatggtggcatgcacctgttgacctagccattcaggaggctgaggcaggagaatcgcttgaacccaggaggcagaggttgcagtgagctgagatcgcaccactgcattccagcctgatgacagagcgagacttcatctcaaaaaaaaacaaaattaacacaatgtgtggaaaatataaaattagttagaagatatgtcttagaaattaaacttttagaagagttaatggtaagtggagaatgttaaattttttattacatacttacagctcaacttaagttttcattcagaatcttttattttggtgtgaatgttaaatattcaaaaataatagaatgacacctgtggatttcacatgtgaagtaatctttttcatattaacattaaaatcttgaggaatttctcacacttgtataatgtacttttttattgggtgcagtttacaatttagaggtttcattctttgtcacctaactagtcaactccttggtcattttatctggaaaaattttaaggatcatgtcatcttttgagttaaaaaatttcttcagtgatctgggatgcaaacttatttactctcttcagagtggtttaatcatgtgaaccacagcaacacctgccctttttgtgtcttccctatcattaccaccagcaccagaaactccaggtgtcccaagctcaaagtaaaaggcctaaggtacgttggcttctcccatattctgtgctgggtcccaaaaacatggtggtaaatattagagttcatatggtcatgactgactaggtgaaaaaacagcacaaaaactatgtatctttcatactattcagacaggtttatgacaaaaacacagagtcagaatttgaacctttgtcatttttaatagtttttataaatatatttttaaattcactgataaaatatgtatttattttgtaaaatagtattttgaagtaaatatacattgtcaatgcctaattttaggtaattgtcaagtgctttgcctcacatagttactttttggtgcgaagacaacatttactgtcttagcattttttcagaaacacaatacatgcattataatctcttgaacttatttttcttatccaactgtaattatgtaatcaatatatgttttgtagaatccacatgtgagtgaaatcatgagatattaacctttctgtgccttatttcaacaactatagtgtcctttaggcttatctttgtgattaaaaataagattttttgtttaaaatatagtattccattgtatatatacaccatagtgtgtgtatttcctcattggacgatggacacatacgttgattctatattttggcttctgtaaagtgtgctgcaacaaacagaattgcagatgtctgttcatcaatctagtttcatttgttttgtgatagatatccagtagttcaattacatgttagattttaattgttttgcaaaatttctatttttcataatggctgtttttatttacattgacacaaacagtgtgaaagctttcctctttctcttttttcaagtttaccaacaattttttttaaacattctaacaggagtgagtttatatcttagagttgttttggtttgcctttccttgatgataattgactgagccatattcatctatctgccaagctataagtatgtctttctttgaaaattatttatatagatcttttgcttatttttaatggttatttgttttttgttttatagtcctttgagtttcttatgtatttttgatattaactgcttttcacatgtataatttgcaaatattttcttccatttttcagttatgtcattctgctgattgtatctgttggtgtgcagcagcttcttaattttaagaaatctggtttgtctatttccccctaaaattttgaggttaaacccaagagtcactgcccagaccaatgttatggggcattcattctatatttcctcatcttagttttagattttcaggtctcacatttaagtatctaatttgagttaatttttatatatggtgtgagatgaaggtctgattttattattttgcatgtggatatatattttctcaacatcgtttataaaagactttttttttaaattgtcatctttatttacaatcagttgtctgtaaatacatgaatttatttctggtctttctcttttgctctattggcctatgtgtccatttttatgcaagtaacactctgttttgattactgtagctttgttggacatttaaaagtcagagtgattccttcagccttttatttttcattttttgcttgattttcttagctattcaaggtcttttgtggggcaatatacattttagattttttaaaaacacttctatggagaatttaactggattttaatagaagttttattatatctgtatatcagtttgtgtaatgcagttatttaacaatattaatcgtgcccatttatgaattagaaatatctttttgtttgaatattatttattttctaaattcttttttttttagattataatgtaccgatcgttcacctttttggttacattcatttctaagtatagttactgctgcaattattgtagataggattgttttttggttttattttcagatactttattgttagtatatagaaatattacggaatttttttatgttgattttggatcctgcaagtttaataaatttgtatattctaataattttttgtgaggtcctaggtttttctatacttaagattatatcatctgcaaggaaactataatttatcttcttcattttatttaagattgctttgattttattgaatattttttctgtcttggtcattttgtattatgttcagtaagatcgaagaaattgggccaggcgtggcggctcacacctgtaatcccagcactgtgggaggcggaggtggggggatcacgaggtcaggagatcaagaccattctggctaacaaggtgaaaccccgtctctactaaaaatacaaaaattaggcaggcgtggtggcacgcacctgtagtcccagctactcaggaggctgaggcagaagaatggtgtgaaactgggaggcagagcttgcagtgagccaagattgcaccactgcactccagcctaggcaacagagcaagactccatctcaaaaaaaaaaaaaaaaaaaaagattggagaaattggacatccttgtcttgttctagctcttagagaaaaggcttacagtttttccttatttagtatgttgttaggtgtgcattgttgttaatgacattaccttgaattgcatttattttataactagttcaagagatttattatgaggagatattgaattttgttacactttcattatgcatctatttgaatgttacagttgtgacagccaatcccacaaaaatacaaaagatgcttgcagactactataaatatctgtgtgcacaccaactagaaaatctagaggaaatgaataaactcttagaaacatacaacctcccaagattgaatcaggaataaacagaagtcttcaagaaaccaaaaatgtgtaagtaaattgaattggtgataaaaaaaatctaccaattataaaaagtactaaaccagatgcattcatagcatgattttatcacatatacaaaaatgagttggctgtaattctacagaaattattccaaaaaatcaaagtgggactccatcctaattaattctatcatataatatcactgtcatcttgatatattaacctagtaaagacacaacaaaaaaaattacaggccaatgtccctgatgaatacagacccaaaaattattcatgaaatgcttgcaaactgagtcaggaaatcaaagttatttcactgcaactatgtggacattattctgtgaatgcaggaatgttttaacgtgcaatctataaatgcgattcaacatataaaaataattaaaaaacaaaaccacattatctcaatagatgtggaaatagcaattaataaaatgtaatatctatttatgaaaaaaattctcaaaaaactaggcattgaaggaacatacctcaaaataataacagccatataagacaaatcctcagccaacatcatactgaacaggtgaaagattaatgcatctttcctaaaaattgaaataagaaaagaatgtgcactttcaccactcctattcaacatagttctgaaggttttagccagaacaatcaggcaagataaagaaagaaaaacactcaaataagaaaagaggaagtcaacttatctgtctttactgatgatataactgtctacctacttcaaagactcctccaaaagactcttaagcctaataaaagacttctgcaaaatctcagggcaacaacaacaaaaagcaaaacaacattcaaaaatgaggaacatttctatacaccagtaacacttaaacagagcaaaattaagaacacaatctagtttacaatagccagaaacaaaaaataaaatagtgatccattaaacaaaggaggttaaatatctctactagaagaactacaaaccactactgaaagaaatcagacacagtgcaagtaagtggaatagtatttcatgctaatggattagaattattaaaaagttcatactgcccaaaacaatcaacagtttatttctatttctatcactctaccaatgccatttttaaataaaattagtcaaaaaactattctaaaatttatatgaaaacaaaaaagctcaaatagccaaggctatactaaacaaaaagaataaacctggtgacattatgttaccaaacttcaaactttaccacaagctacggtaaccaatataatatggatgcagatacacacacacacacacacacacacacacacacacacacacacacacacccttacggaacagaagagagcactgaaatgaagctgaactcttaaaattaattgatttttgacagcatcaacaaaaacaaatggaaagaactccctacccaaaaaaaggtgctggaaaaactggttagtcatatgcagaagaggaaatcgcaacacctacttctcatgatacagaaaattaaatcaagatacattaaagacttatctgtaagtgttcaacctataaaagtcctagaagaacacctagaaaattctctccttggcgttggtctctgtaaagaattaatgactacatcctcaaaagtgaaagcaacaaaaataaaaattaaaaattgtgacctgtacagcaagagaaactattaacaaaataaacagacaacgtacagtatgggctaaaatacgtgtaaactgcatacaataaataactaatatatacattttataaggaatttaagaaaaaatgttgacaaaaatgtgaacatatacttttaaaagaaagacaaaaaaagcagccaacaaacatatgaaaaattgatcaacatttctaatgattagagagatgtaaatccaaaccacaatgtgataccatctcaccccagtctaaatggctattattaaaaagtaaaaaaaaaaaagttaaaattatgtagaaaagagaaccctgatatactcttagtgggaatgcaagttagttcacctcctgtagaatgcattttggggatttctcaaaggactaaaactaaagttaccatttgacccagcagcttcagtactgggcatatacctcaatacaatacaaataaattattctaccaaaaatacacctgcactcgtatgtttattgcagcactagtcacaatagtaaagacatggaatgaaaccatgtgctcataaatcttaagatggattttaaaaattaggtaattacacaccatccaatactatgcagccactgaagaagaatcatgtaatactctttgcagcaacatggatgcagctcaaggtcatgatcctaagcaaattaacacagaacagaaaaccaaatactacattttctcacttataagtggaagctaaacattgggtacacatggaagcaaagatgagaaaaataaacactaaggattcgaaaatggagggagaaggggtacaagggttaaaaagtacttgtcatgtataatgtacactacttgggcaatgggattattaattgcctaaacctcaacgtcatgcagtatacctatgttacaaatctgcacgtgtatccttgaatccaaaatacaaataataaaatactttgtgatataatgccatgttagatttctccagttttggttaatggttggaattaagggtggaagacatagaattttgtcccctttagacataggggtgaatgtttctataacaggtctcctgacatcctataagctattttctctgaaagctctcggccttagttttgagtgtgcagctaaaataaatgactgtacatcaagcttgtccaactcatggcctacgctccatgtggcccaatatggctttcagtgcagccctaaacaaatcagaaactttctaaaagcattatgagttttttgtgattttttaaatcatcattggtgtattttatgtatggctcaagacaactcttctagtgtgtcccagggaagccaaaagattggacaccccagctctacatctttatttttcatctatttacagtgcactaggtgatagtgtttatttattactctactcctttgggaaaaaaagatggtca

SEQ ID NO: 300 - DNA, 3483 bp, Homo sapiens
cagaggctagagctcaggctcaagcaggccaagaaggagttaacctccaaggagaatgcgggcttctcccagactggaggtctgtgcccagttttgctggtgccaactccgggaagaagtcctgggatctgtagtttgtgccaccacccacccctggcctgcctgtttatcaacacggtcttgtagactacagttcccagaaacctgcagaggctaggctttgggggaaggggtggggaaggaggctccgtggcggccagagggagagggagagggaggaggtggggagagaaaacccaattcacccccttcgtttttaattctttctcctggtgtgtctgctccaccgcccgagctaatcccccaaatccggtctcctaagccgcagctgcttcccttcgcagtgatgaatggctcagggagggaagatctctggtgagtgttcccccagcctggcgtagggcatgccccagttcactttcgcctgcttctgtggtctccacggcttctgcaaaatgaagaggaagaaggaggaagttcacagagagcgggagacggcggtgtgatcagaaccagggcccctccatcaagcccccagcaggtcccaggcctgatggtgcctgcttctggctggggcttggagcaggaagccgtgtgtgtatcttaagtcttgatttagccagtgctcttctcagcctgactctcacccgagggcatcagcctcctgtgtgcctctcatcctcctcatgcccacacccattagcttccaattctcagacctccttggagagaggccccagccacacaagggggaaccccaggacctgccgcatgccttccagagactgagaagccccagggaggccaaggagtgaaacttctttcctgccctgagagcttcgggggactcttctcagggtaaccgcatgaggcatgtgccgccttgggctaggagagctgttgctaaatgggaaactggctgctctagcagagaacttccagcagccctgaccctggagaaggcctccagggcggaagtgtgagactctcctgggattccaggacctggggcaagaatccttttccagccccctgccagcatcctcctgggccaggtggggccaggcctgaggtggccagcccagtgaggaggaaggcagaggtggccagtggctccgtggctccctctgttcttgctctccagaaagcagtgtttcctccagccccggccctgacccacccgtgttcatgatgcctgtgcctccttgccagcatcacagatgtggggaggcctgttccccaggccctgactcccctcctcagggactgtcttgccgtggccagactgagggacccctttcctggactgagccgtgccctcccttgattctcctgtctcccctgcctttttcttctctcctcagaagccatagaggggactgcgttcatatgtggtgccttcagtggaaactcttagggtggggggacctctaggaccttcctcgactttttccctcatcccccacccccgccaaccttccagcttcagcctctgcccttacccccagcccatttccaggaggtaggaagcaaaagaaaaaagcatttccttccctctttccttcttccttccttcctctctcccttcattttggtataacttagccttttgtctttaatcctggagttctccggggctagaagacaggcagagacgaatgccagcagcagagatgcttcaggcagattctgtaagcctgttctccctcatcagggagcagctcagccaaggagcaaagtcagaccccctctagctccccagggacagaatagcccttctgacaggtaaacaggtgacctgggtagagagggcaaggccccaagataggagagtcagggctcccctttccttggaatgtgggcctctctgggcaactagggagggcaaaagtcttcctcggctggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggacagaagaaaaactccctggttctttgtcctcttggatagtagaggccttgggtgaggcaaagagatgggcagaaaaagttaccttgatacagaggccagagagcctcctggagggcatgtgtttccctagcggtcacctgcgaggctgcaatcctagaaaagtcacttctgtggcagaggatgaaattgtatccccggagactcagagatattgggtgttatgtcctgaccacacaggctcaccaggaggaaaggttaggaaagtggagaaagtacgtcctggggagcgggtggccgaggagagctttccccttgtgcgcctctcaggccttggcagggattgcagctgcaggggtttggcagtgagcccatccagagagcttcctcccccgggagaactcccttggctccagagggatactagatatcttgagccctggctttgggaacatgggtggggtcccaaggtcaaagtgttctgagtggaggtccagttgtcctctgcctccaagccggcagccccttcttcacccagggctgaggttggggccagcactgcagctggaattgtctgagcaggaggtagcagcttctagccaggcacaccccaaccccacattctattgtccctcagtttccttctcaggaaaatggggactttgctccttttagcatctcaggaagcagtctggacacctgtgccctcctctaggcccttggatgagcccagggaatagggaaaggccaaagcagccccagcattcgcagaccctgcgccctgggcctctgacttcgggccaggcttctgctccttctagggttggcctggctgccctgccttcccatcctctctccatggttctctcccagagactccaccttgaggtgggggccctgagctcttggggtgagggaggggcacatgggtagatgattctgtggaggagatcaggcctcttgttcttgctgcgtggcactgattcctccttgcagatgggtgagggggccagttttccccatctgtaaagcgaggacttcccatggccattttccctcttgggcttcaggctgctgaatggaagatcaagaagtgtgaagggtgcttggggtccttgtgacttgagtgttgcctaggaccctggcccacaggacccaaggggcttcttgtctcaggttgaaacctttttatcagaatgtcatttccttc

SEQ ID NO: 301 - DNA, 6111 bp, Homo sapiens
agtgaagaagggaatgagggacggaaagagagagacagcgaagagaggagaaaggtgagtgcattctggaaatcaccggcagctccgctccgcagaaaggccttggcctgtgccatctgagggtgaagttacgtggttatcaaattccccttccctggagcccctggcaagaagttgatgccagaaacagacggagggggtgcgaggagggagggaatcagaccttttgtttctctttttccccctaggacctggtctcatgcttctccccctcatctctcccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacagcatctctgaggttggggtgcatcttaacatcattgtccacaaactgtcctgtgctgtcattttccctgtgtctgaacaaacttggtagttacacccgtgacttgattgggtgacctcaacctttgatgtttcagtcaatgaaccattcaggcatcattgagatcattttcatcttgcttattttcctgaacatctttctgtgaaaatcaaacaagtccaaggatcaaactcccaggtgtcaacagcttggaagggttccacacacttttaagaaattttctggccaggcacggtggctcatgccaggaatctcaacactttgggaggctgaggtgggcagatagcttgacgccagaaattcaagaccagcctgggcaacatggcaaaagcctgtctctgtggaaaatacaaaaattagccaggcgtggtggtgtgcgcctgtaatcccagctactcaggaggctgaggcaggagaatcgctggaacctgggaggcagagcctgcagtgagctgagatcgcgccaccgtactccagaccgagcgacagagcaagactcggtctcaagaaaagaaaaaaaaaaaatgcaactgaaggaaacctagtgtgcagaaatgttttgaagaaaacttcaaaaaaaaattctattagtcttaaagatatgagaagatattacatccattaaagaagaataatttaccataaaaaattcaaacaatgaaaagggctcttaaaaatttaaaacatggctgggcacagtggctcacacctgtaatcccagcacttcgggaggccgaggcaggcagatgacctcaggtcaggaatttgagaccaggctggccaacagggtgagaccccatctctactaaaaatacaaaaaattagctgggcatggtggtgtgagcctgtaatctcagctacttgggaggctgaggcaggagaattgcttgaacccagtaggcggaggttgcagtgagccgagaaaagaaaaagaaaaaagaaatttgtgagagctgagcataagccacactaaatgcacacacaggaaatattaatacgtattagttatgttttgagggcatatgttcacaaatacaaaacctctggggaggctgaggcgggtggatcatgaggtctggagttcaagactagcctggccaacacagtgaaaccccctctctactaaaaatacaaaaattagctgggcgtggtggcaggtacctgtagtcccagctactcgggaggctgaggtgggagaattgcttgaactcgggaggcagaggttacagtgagccaagattgtgccaccacgctccagcctgggtgacagagcaagactctgccttttctttctcaaaaatccctggagtctgcctttgcttcagaaattagtttatccagctatacttgatggaaaacccagtgtttcagtagcagaaagagctttgtggtgtaagccattctagaataagtagacaggctaggggtctcttccgtgggatgccagttagctgtgtcccaaagacagacctcaaagactccatcccagggacacaatgcctctcccgaagctaggactctggaatcaggacacaggttgctctctctggacatatttctctaagtaaacaagttgctcttccttagagtagctgttgtgttgctgtattcccatcacattcccaggggtgtgaaatagtagactctccagtctactagagatggggccattttctcagcaacacttgcttgttatatcctgttaaaaaatcttaacgtagaaaaatgggcaaaacataaatgtataactccatgaacaactgcaaagtgaaaacatatatagtcaatatacatattttaaaaaataaaacattgtgggcgggcacggtggctcacatctgtaatcccagcactttgggaggccgaggcaggcggatcacctaaggtcggaagttcgagaccagcctgcccaacatggagaaaccctaactctactaaaaatacaaaattagccggcatggtggcacatgcctgtaatcccagctactcgggaggctgaggcaggagaatcgcttgaacccgggaggcagaggttgcggtgagcgaagatcacaccattgcactccagcctgggaaacaagagcgaaactccatctcaaaaaaaaacattgccaacacaccaaaagccccaaacagtatctgctatcattgctatcattacttaaacactgtggtataatttttccaattattgaattttgattttttagtatattcacaagattttgcagccgtcactataatttagagtatttttgtcctctgtcaaagaacccccccatacccattcgctgccacttcatactccccacattctgtccccaccctaaagacctactttttgtctccatagatttaccttttctggacactttatataaatgcaatgagtcttttgtgactagcttctttaacagcataatgcttcaaggttcatccatgttatcgaaagtatggatatgtcatatctttttattgccaaataacagtccattgtgtggctgtaccaatattttatgtattcattcctcagctgagagacatttggctggttttcactttctcgctattaacaataatgcagctctgaacatttgtgtacaataaaaataaatagcatcctacaattaatatggaaacagcagaaatttatttctcataattctggaggctgagaagttccatatcaaggatctgatagattcaatgtctggtgaggaaatgcttcataaatggttcataaatggtgctttcttgctgtgtcttcatggtggaaggggtaaggtcttcctggggcctcatttgtttacgtatgtattcatttatatttttggagacccagcctgcatctggtttccccttcttccttgaatgtaaaccctagaaagctgggctttcttttgagagcttgggagatttttgtctcaactcaaagagactagaggatgacccatctattttttcattagttttaaactcagcttttttacttcctgtagagtttcagaatttggcaaaagtctcaaggctcaagctggttgtctgaagcctttcaaacccccagttttatcaccacatatgagaggtcccagcaccaaccgcaccagccacaggactcctcttctcggtggtacaaccagcagcttccaggcccagccacatatccagagcttggggatcaggtatagagagccaatcccctgggaacccatgcattagtcccagggggcctctcctccaagcgcctacattctggaaaagcctcaagtttctacagtcatgatacctgggaaactcagtgctcccttttggatttttcttagcccttcaacacctatgtaaatctgcatgaaatttccactgtttgaatagagtgtcattccctgctgagccctaactgatacgctgtgtttccagtgtccctcatccactagactcagtggtgtcaggaatggtgtggtattttgttataaatttaactccttagatggacacacagagagcctcgataaatatttttaatccatcaatgcaaggagtgtggttgtcagaagtcagctaaaagtccaagtttaaatctaagctccgccgttcacagcttgggtgacctcagcttcttttttggaaatgaagttcatattttccgagcactttttctgtgccaggtgcttccaaatgtatctcgtttaatcctcacaacatacctcagaggaagacatcatttttacaagtaaggaaatagaggctcagagagatgaagtggttgacccgggctgtctatcttgtaaatggtgggctgtgattcccacacgactggagtttctggagtcagaggctgcctggagtcaggggctgcctgactccagaaaccattttctgtgcatttcatgtagctccacctcaattgccttcctttcctcatctgcagactgattaaataaaatgtataatttggatgaaatttgataaataattctgaatgcattcttttttagaataaattatctgcagttcagtactttattcttactaataaattccaagcaacactcctactcacgggcctggcccttcccatgcattttcttttcttgctttttttttttttttttgagatggagtctcgctctgtcacccatactgaagtgcagtggggccatctcggctcactgcaagctctgcctcccaggttcaaacaattctcctgcctcagcctcccgtgtagctgggattacagggatgtactaccatgtccggctaatttttgtatttttattagagacagggtttcaccatgttggccaggctggtctcgaactcctgacctcaagtgatctgtgcacctcagcctcccaaagtgctgggattacaggcatgagccaccgcgcccagcccccatacgttttctcgctggccatgctgtgcaccgtctactaagttgccatggctgcctggccatctgacttgtcaccctctcatccctgacctgaccccagtgtgtctgcttttgcagggccaaggggtcagattcttctgcagaggacagccctgtgaggtccaggttacggactcctgctcaagcacatgtaggatgccagcctgatggtgtctgggtccttcagtagtattcatggcagcctgctgaactctgccttccaagatccagtttatattttagggccccaatgtaaatgttgcaaagtctttcccatttcccctgcctcagaacagcagcatggaaagcctagaatggaaaaagagaatgagcccaaacccagcagctcaggccaggaggcatgcctgttccacatcactccacgtggctttgtgtttgttgcctccacatctgttccaacccagctaggctggtgcagaaggagcccagggggtcctgcttatcactgaattcctttactgatgcattgttttaaagagaaaaaatccccatgaaaggtccaccacaggaactggggacctctcaatgatcccaataggtaaggaagactcatttgcagtgagctccaggggacctttctacaactcacagtgaccagtgggaataggacacacaaggtgatgccaagcctggcacaacagctgagtaccttgactcgtcccaaatcccagagtaaatgtagggcacctgaggcagctgccaagggacagatgtccttcagagcagttctggacaaggccctcatttatttctctctgtcacctgcccctctctctctttaaaaacctaggcattttgtcttcttttcctcatttttgtcctacacaggaacatgagagccacctggtggaaggttttattagcatggaggacgagggagagtttggcagcttggcagagctgcaggttgtggagaagcagctgagacaacagccctgagagaggagatctgtgcttccctggagcacagggcaggttgacacatcagctgcggaacagtatctggaccagaagcctttgctcactgtgagagacaggccgggtcacttacttgctcaccgcacatgggggctgagtggtggctgttacagatccatggaggccagtggttgaggctctgaaggggacatggctgtcgctgtgggag

SEQ ID NO: 302 - DNA, 4912 bp, Homo sapiens
tagttttattaattctcgctggcccccatctgtgctttcgactggattcagaactcagtttatcttccaggctccctgtctttgggtcttgatcaccacagaggggaaggggagaatccagagataaaatgtgagactgaaactgttttaaagaagcatacaagaaagaagcacacactttattagggagatgttgatgagatgcttacaacccgcccgccaccccccagccccagctaggccatctggcaggtaccgcccgtgcgccaggcatcgttttcaaattgcaagaccgaaatccaatcaaccgaaataatttcttaggaagataagcttgcaacacgtgcaataatgaaaaaatttaactagcattaaaaatattcaggaatgtcgagcaattaccacctggccgcagtcacaggacagaagacggaataaatgggcacgcaccaaaggtttatattaaagtgtaagtttcagcccctcagtatatttaagggaggctgctctgcagaggaaacctctgccttctcggcgagggagtttccgagctaccttaactggggcgcaacgcagccttccgccaccagaggcagcgggcgtctgcggcctgtcaaaaactggcgcttttttcctcccctttccgtggagagactatcaactccatctgtcacaaaaattaaggctaaatctcctctccagaagcagagggagccggggctccgacgcgctcagcgtcgggctgtctgcctctccctagaggccaagtgaatttgaaatggcaaaagtcacagccggaggcccagcactaggagattcctccggctgcgggaaatcttcctgtacctgctgaagctgctgcgttcctcagaggcgcttggtctgccgtgggaagctgcacctctgcagtccccaaaaccaaaatcaaaccttaaaagagccagactgaggtaaggcggaccgtcttgctctgatttgagtattggtagacaaacagcaatataaatcgatactaaaaaaatccagaaaggctgcaacttcatggcacatcaaaacaaccatatccctggctctctgtctctttttttttctctattatttggagttgtcctctcagtccggcctggaggacttggacaactcagacaccttctctgtgtctgggatccctccacagaagccagtcaccacgtaagacatctggaccaccttcagactcgcatgctgtgaggaagcccatgcttactatgtgtagaggatacatggagaaggaaagagatgcctggccagctccctgctgtttcagccatgtgagtgaagaaggcaccagacttgtgagtggagacactaacttggatgtccagcccagctgaaccttcaggcagaggtgctgagcagctaattggaggggatagtatgagcctccaaagattagggaagaaaattgcagttgaagaaaacttgctttggttcaatgcaaaaataatgggatgaatggcatgctgaaatatcatatgacttacgaaaatgatgaatgtgattcccaaactcaataagaggagaaatgatgacaagaagcaaaggccgtctacagccctcacgttaggtttattgaatctacatatgtggaacccatgaatgggagtcggagaagggggcaactgtatacgcaaaaagctatcataattgccaaaatagtgataacaatgttgaaacactactgggattactactgttaatgactaccagtgatcaagcacctcccctgccccagtgtttgcctgccttgtttgaagacacgaaaaaatgtacacaaaatgatttagaactgttgaacttttcagaaaataatttaaaatcatctacctcataactaaaggtgaaggaaatgaagtagaaggatgttacataccttgttcaaagtgacatagctgagtctgcttggactgtggttcaagccatgcagcctaactctagaacccatgctttgctacctgactttccagacgtaggaggcaaataccataatcagctccttgtttagaggtgtaggaattgaggcccagaaaaaataagtaacttgtccaaaatatgtagtgaaattggtacttgaacttttgtctgtctttcaactacactaccacctctaaatgctcaaattcagatcattttagatttaaggactagaaatagccttggagatcatgttattaaataattactcattttacagataatctgtaatcactaaaatcatttacctaaagcagtcaggaacaggttctatacagcaaagcaacttaacatacaaaggaaaattattgtttgaaatattatttctattttttttttttttgagatggagtttcgcttttgtcacccaggctagagtgcagtgatacgatctcagctcactgcaacctccgcctcccaggttcaagcgatactcctgcctcagcctcccgagcagctgggattacaggtgcccaccaccatgcccagctaatttttgtatttttggtagagagggactttgaccatgttggccaggctggcctcgaactcctgacctcaggtgatccacctgcctcagcctcctaaagggctgcgattataggcatgagtcatcacacccggctgaaatattacttctatttaatatttaagaaaacaaaatgaggaattcaattcttgatggcaacacagctcttgctagtaacttaaatgcctcattgtttctctgcaacaagaggaaaacttgggaaaggattctgtaggcactgagaccatcataaggaattgcaggacccagagattttcatgaaagtgaaattgctcataggaaatcaaagcaaatggccttaagagtggcatccagtggaccgtcctctgaaaagtgacccacaattctgcatgaatctttccaggacactgaattggagccagctgatgtaaggagcttaccttggttgccaccttctggtctctgtttgaggaacaactgcatgtgattaagggtaacagatacagaatttgtgttaagcccaggatgtaatttgttgaatgagtagcaattgacttgaaaattggatggatggggattgtgtttctttactctctctctcttttctttctccctctcaatacggctagattaaatcatctttagtctagtcaaatcagtgcttgctgttgttaagaaggatattcttgaggtatagtacttcagggatgctaattgggatttgagcaagatgaaatttctacccaggtgtgtgcatcgtatactggagatggcaaaaactggttccaaatgagggtgtgtttgtgttcctaggcatgttcctataggggccaaaaagatgcaaaatcttcttttctaaagcttttggtgttctcaagcttgtctacacaatggaatcacctggagaatttggaaaaccaaaaatactgataccactgatcctacccaacagattctattttaattggtatggagtatggcctcagcactgatattttttaaagtttctgaggcgatcctaatgtgcagcaaagcaccgtcaagccccctctctctgaggaggcaccagctgcaagcatgttttacaccaatatgtttgctgaatataaacatcccagtgcaaactcttgcaccccagaactctgggctgcttgtggacagtctttggcaaagtctgaatttataaactgataatacatataattccataggctccatatggttcgtgttatcctggggggaactatacacatttgccttgccccaggatggaaagataaataacagatgtggataatttttatcatacttgtactgaacaataataaaaaaattagaaatgaaggagcagagagagaagtaaaactcatgaaaacaaagctcaaatcaattattctacgttatatctttgcatttttaagaatccaaatacacagtagtactccatagaaaaacctgtcatacagttctccatttctaagggagactatctctagagtgatgagacataatattaaaattgtatgttaataaagttaatcaatttgttattagtgataaaaagtaaaatctacatagagcttactgtgtaccagacactgttctaagcactatacaagtattaacttatttaaccctcattataatcctgagacaaatcctattattatccttattttacagatgaagaaactgagaccccaagaatttaagtaatttgttcaaggcaacacactgctatgtggtagaactacaaattgagcccaaataatccagcttcagatactatgcaaaggtatcctaggtgtgggggtgataacctggtgacaatcccttctcagaaggaaaacaggtcccatctacagaggtgaagcagagtgtggaactgaaaaactcaatggaagaatggctattaagatttaggacggctgggaaataataaagtaataataataatactaggtattgacgtgtgctacatgccaggccttgggtgacatttggattgattcccattttctttacttttcagcagtggggtctttcacctttcaagctctgcctgagaagtcaacatggtggcatttggctaggttcttttaggcaaccaattgttttaacatgatttgttgaaaagcctattctctctttcattgaactataatgctagctctgtcataaatcaaattttcatttgatttatgatatgaaaattatatgcatttgattgatatgcattttttctccaatgatactcaactgtcttaattatataattttgtagtaattcttggtatctaattaggcaaatacccactcccaaccctgtttcttttgtttttaaatccaggggtgttttggatattctcgttcatttgtgcttccacc

SEQ ID NO: 303 - DNA, 6397 bp, Homo sapiens
ggagcgtccgggacgcggcgggactcgagtgtttcggaaaaggagcgtctccccaggcggtggttgtcttcactagcgatggggtaaaaggaggacgcaatacctggttcaacttgagcaggtacattttgaccatattccaggtgtcatgtgaagatttaagcctctttccaacccccactccccccgaatctactgcatcctttttggagtcttcattcttaggcacattttgtcaagacttaaaacctaccaaagaaaagatacactgaggtcagatccaatcccactgggggccagcgagtgaaatgcgacggtttccttttataatctctgtttttcataatgatgacattaaaaatcttgaggtttcccagtagatatttaagctgaaagcaacattgtgcttgtcttcagagaccaagactttctggctcttgtcttggaatatttcgcaaagtcataggcaaaacacacacaaacaaacagaaccaaaacacagcagaccactcacgggggaccgaaccaggcagttagcccagcatccccctgctgcgggaggagggagcttggatactcctctctggagaatcctgctctggaaatccccacaccccaaaatgcaatgtagaggggcagtgagtcagcacctcaccccaaatgaatggccgttctgctcagcaggctcaacgcttagatccccagatccagtttctctttgctttctgtaattggaagaatggaataggattgctgctagaaatctttgaggtcactggtttgaaagtgggattatgagcatgaatttttgttgttgttgtttgtttgttttcagacggagtctcgctatgttgcccaggctggggtgcagtggcgtgatctctgctcactgcaagctccgcctcccgggttcacgccattctcctgcctcagcctcccgagtagctgggaccacaggcgcccgccaccacgcccggctgattttttttatttttagtagagacggggtttcaccgtgttagccaggatgatctcaatctcctgacctcgtgatccgcccgcctgggcctcccaaagtgctgggattacaggtgtgagccaccgcgcctggccgagcatgttaatttaagcaaatgaatgtccctgggaatgatcttcaaggagaattaaagtgggatagagaagtcatctatctgcacctgtgtctgaaccagaatgacgaggcacttccatgtcagctagttactggagcaggcggagtaaggagtacccctgggcttctgccccgaaaccaccacggctacttcaaaacaatattacattaattttcctgcttgttcttgagaagcactggtttgaaaaattggatggggtgatacatgttttaatcagtatttacaaggctccttaatcacttcatcagacaattcattgagcacctactatgtgccaggcagtgtaattcattgagcacctgctgtgtgccaggcagtgtctgaggcacttctagctattatttcctaagggttccagcagcccatggataaacttcaaagagtgtaagctcctaaaaattgttcgtattttctgcacatttttgtagttttggagaagagagttaatggagttcttgccattctcagaattatttgatccctttaggaatgagcatctctagcctctgcctgttcatctgggacaatctgcacctgggcgtggacctgctgcttcagatcagtaggtatcagaatgaactcagttggatggggcagttcaggacccctggcctccttttagtctggaccccactctcattcctcatattctcaattcactctttctactgagttactatcctagtaatgacaatgcctcctatcatctagagacttggtttgatacaatgcattcacatacaactgctcgttttgatttctataactggggaatacagaaagcaaatatgcggtgcaatggaggatgtctccattaccccagataactccaaaattcttcacctagttaccagtgcaggaaattcgttcgaaggcagaaatggaaaatgaataagaaacaatttggatgtgttccaaaaatggagagttgtcaggcactatatcatacaacctgaaatatcaatggtgaagtagacagttcacctccacagggggcaggaggttggacccagggcaatggatgttttatatggatggttaaccggtctgtggccatgaggtggaaagctgtgtacacctgtgaagccatcatcacaatcaagttagggaacatatccatcacccaaaaaagtgttctcatgccctttggtaattcctccctcctaaatgtccccaccctaccccacatcccagtttctatgcaaaaaccgctgaccaactttctatcactatagatttgtttgtattttctagacttttatataaaaagaattatactgtatgtacacttttttgtctgtttttttcacttaacatatttattttcagaatcatctatcttgttgcaggtgtattcctttttattgctcagtagtattccactgtatggatataacacaatttgtttatcattcacctgttgagggacattatacttgcttctaaatttttactatcacaaataaagctgctgtaggcattcatgtgtgtgtccatcgtgtggacattgtgtgcacacgtgcttccatttctcttggggaaatatctaggagcagagtgtctggatcccatagtaggtatttgtttaactttttaaactgtttttcaaagtggttatactgtttttcattttcaccatcaatgcatgagggtcccagttgctccacatccccacccatactttctgtggtcactttaaaaatttttagccgccccgtccgggagggaggtgggggggtcagccccccgcccggccagccgccccgtccgggaggtgaggggcacctctgcccggccgcccctactgggaagtgaggaggccctctgcccgaccaccaccccgtctgggaggtgtacccaacagctcattgagaacgggccatgatgacaatggcggttttggggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgcttgttaagagtcatcaccactccctaatctcaagtatccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaaaataaaaaaagaaaccctacactccactgaaaaaaaaaattttactcactctaatatgtatataatggtatttcattgtagtttaaatttgcatttttcaaataactagtgatgttgaacaaattttattgtacttattgccatccagatatcttctttggtgaaatgtctgtttcagttttactttctttcttttcctttacttggtgatatggtttggctgtgtccccaccgaaatctcatcttgacttcccacatgttatgggaaggacctggtgagaggtaattgaatcatgggggcaagtctttcccatgctgttgtcatgatagtgaataagtcttacaagatctgatggttttaaaaagaggaattcccctgcacaagctctctgtctttgctttctgccatctgtgtaagacgtgacttgctcctccttaccttctgccatgattgtgaggcttccccagccacgtggaactgtgagtccagttaaacctctttcctttgtaaactgcccagtctcaggtatgtctttatcggcagcgtgaaaattgactaatacacttgggatgtttggttttccaattgttgagctgtttgttgagttttaagagttctataactattctagaagcaagtccattatcagatgtgtggtttgcaaatatttatttccagtctgcggcttgtcttttcattctattaaatgtgtctttagccaggcatggtagtgggtgcctgtagcttcagctacttgagaggctgaggcaggaggatttcttgagcccaggagtttaagcctggtctgcacaatagagcaagactctgtctccaagataaaaagaaattaaagtgtctttcaaagatcagaattcttaattttgaagtgcagcttattttctttaatggattctgcttttggtgtcacatttgcctaactcaaggtcacaaagattttattacagaagttctgtagatttcagttttacatttaagatggtgatccattttgaatgagtttttataaatgctgaagtatgaaacaaagtgtgtatctgtacgtatgtgcctagggaaatgcaatcatcccagcactgttaaaaagactattctttctccactgacttgcctttgcacctttgtcaataaccaattgataatatatgtgcaaatctatttgtagactctgttctgtcccatttatttgtttgtctctttttaaagttaataccacactgtcttgactatagtagattcataacaagaattgaagtcaggtaatgtaaatactcaggtagtgtaaatactcaaacgttcttctttctcaaagtgtgcagttgtttggttattctgttttctttgcatctacatatgaatattagaatcagctggtcattctttacaaaaagcctgccaagattttaattgagattgcattaaatctataggtcaatttttaggcaatgaacagtttgacagtattgaggcttctgatatgtgaacgcggtatatctttcatttatttaagtcttcttaaattatctccacagtctttcatagtattcaatgtacaggcctgatatatatgttattagatttgtttctaaatatttcactttctttgtcctattgtaaatggcattatttatttatttatttattgagacaagatctcactctgtcactgaggctgcagtgcagtgacgcaatctcagcccactgcaacctctgccccccagactcaagtgatcctgccacgtagctgggactacaggcatgcgccaccatgcctggctaattttttgtattttttgtagagatgggcttttgccgtgttgttcaggctggtcttgaattcctggcctcaagcaacccaccccccttagcttcccaaactgctgggatgacaagtgtgagccactacatctggcctttggcattgtttttcatttcaatctctaattgtttaaacatttgatttttgtgtatttatcttgtatcacacaactttgcttaattcaattattctgatttttttgtagcttcagtagaatttttcttacatagataatcatgctgtttgtaaatatagacacttttacttcctcctttcaaatctgggtgctatttaattcttttctgtctgattgcactgcctaataacctcccatgcaatgttgactagaaatggagacagtgtgtacccttgtgttgttcctgatcctatgtgaaaataatccagtctttcaccattaaatataatgttagctgtaggcttttcatagattctctttatcaggttgaggaagttctcttctatttctagcttcctgcaaattatgttttaaaaattaggaatgtgtattaaatattatcaaagttttcttctgcatctattctattgagatgatcatatgggtttttttattcattaatatgtgaattatcttgattgatttttgaatgttaaatcaatcttgtgtccctgaaataatcctaaccccacttggtcatgatatatcatagttttaaattattgatgaattcaatttgcaaaaacatgttaagaatatttacattgatgtttatgagggtactgatctgttgttttctttctttgtctggtttgatatctaagaaatgttggcctcatagaattgttaagtgtttcttccgctttaattttatggaagtgtttgtgtagaattggtcttatttcttccttagatgattggcaaaaatcacaatgatgccatcaggacctatagttttctttgtggggaggtttttacctataaatgtaatttctttaatatatattctttaaggctgggtacggtggctcacgcctgtaatcc

SEQ ID NO: 304 - DNA, 2420 bp, Homo sapiens
tacttctgctttccttgggtttgtttgtctttcatttcaagtgatttcttaatttcctttaacagtttttaaactgtggaattattttctcagtatagtccaagctacatctaataagctctagcatgtaactttttcttttttgttcttttctaaatattgtgtcactgctgatttggtttttctcttttatccatgagatgactgttttaagttcccaggaagcgagtcttcttgttccaatttattcctgaatttttattttgactgtcattacactgtagttaggagatgtgacctctactgtctccagcatttagaatgtattgcggatccagggacacagcaagtcaggtgggctctgtcgcaaggatggttacaacatagactacttccatgtcagtcttccattatttgcatactcgagaccctgatgtgttggctaatttgccaagaaacccccgcagcagactgcgtccgcagggcagggctgagtagcaggggcagcacctctcacaggggcagggccgcttgcccagccttgaggaagggggacccagacattgcctttctcaatactgagcccctaaacaggatttctggtctggggtctgggactaggctatctggacagtcaaactcttcccactgcgccatcagccccactaggaaagaaagaggagaaattagggctttgctttaaagagttcaacggtcagaatatgtcccccgcaaacggacatgctggaatcctcatccccaagtgagggcggggcctcacattaggaggtgatgaggtcacagaggcagaaacctcacgaacgggatcaggctcatcaaagaggcctgagagacgacacctaccagctggaaggcggttccgcaccagacaccgaagctgctgggccttcgacctcggacctccgtcttccagaactgtgagccacacattcctgatgctcctaagccacgccgtgtacggtattttgttacggtagcccaaatggaccaagataggagctaaaggtgcttgtgagattccacgcatcatactagaggtgtgagcactgcacctaagggtgcctcggatcatccctgagatgcaggcactgcaccaggaggtgtcttggatcattcctgaggtgtgagcacatcatcagaagacccttttgtccatggggtcccattctcaccttctggatacacatcactctcggggccgccattctacctgcctcatctgtgcgcggcagtctggacctagaagctctgtcccctctgctgcccagtggagtcgagtgcctggcacccaacacccagacagggtggccaccaacctggttgaggggactgtccccaagatgatcacagaacatcaggcagggctcctgagccagcgccccccccaagcctgcctcgctcccagtacggccggaagagtagctgaggccaacccctgaagcagccaaggcgtcctctatgcccagaagtgccagggatcgggggctgcccagttccagacagggtcatcacactccgaccttcagaggggccccccgcctgccagctccagacagggccatcacactcccgatccacagagggcccccccacgcctcccagctcctgacggaagcgcctgtccagcttcaccgacctccatgccgctgcctggggtcttgctcgaacgcaagagaacacgggtctcgttgagggctcctctgccccgcatctcctgctcctggacacccaggcctgccctcaccactgctgctggacaccgggcaggggtcctggccactcttctggaaggccagtctgacgttgcaggcgcagccacttcactgtttgtccttcacggtatgccagactccctcctccctgcaagagcctctcccagggcccagtcctcccccgagaggtgctgatgagagtggagtatggaaccatctgccagccaaccccaggtggcctctcgggggtgccctgccccacagggccatgcacggtgtggccctccccggtgctgtcacgtctgaatgtggccctgcagacttgcccccactgggctggagcacatcccctggaatctgatcccaggagctccgggagcagctcgcacacagctccatggatgcccctcacagtgggagagacaggaaaggccagctccgagtctcacacctcactcttcaagctgggaaaatgatgctgttaccttgggaggtgagaccctccagatgggaacctcgacgctgggagctggtgtgttcccggaattcgggggaatatttcattccctgcgtatggtgtctggactttcagatccctcctcccaggcacccaggcatcatttcacaaccccatgctcagcaagccccagagaaaactcctcaataaactacgagtgttaatacccg

SEQ ID NO: 305 - DNA, 2029 bp, Homo sapiens
aggtgggattgaacagcagcctcttttagtgggctttctttacaaaacccaacgactctacctctctgcttgctaagcatgtgaacttatcatctaatggggaatgcaagactcactctccagtaaacctagaaaacttagataaccttgcttctcatctaatgagacagatatattcttctctccagaagacaggtgtaacatggattccatgccactgggcaactgttcaactgccctgaagaaacggtgtacgtatcacaagtatcacaaagggctgctgggtccactgagtgattgttttgcattaggtgagactgtttcgaagccatgatgtttcacaagtctctgattctatatgtgctgtttgctttggagtgaaattacttcctcatgcttagcaccaccattgcctgattcctgtctgcctggaatgattatctccatcttcaatttgcaagtgaagaaactgagctatagggccatggcactaacaggttctctggaaagcagtggctaagatggagtcagaaatagaaaagcttattgtggattaattcctggggtgtgatggctcatacttgtagtcccagcactttgggaggctggggctggggctttgcttgagcccaagagtttgagaacagcctgggcaacactgggagaccctatctttacaaaatatacaaaaatttagctggttgtgatagcacacacctgtagtcccagctacttgggaggctgagaagaaggatcgtttgagcctgggagctcaaggctgcagtgagccatgatcatgccactgcactccagcctgagtgacagaatatcaggagccatcagaccaccatgcagacttgacaaggtctctgcacagtcccagaagaaacaaagcaaagactgcccactagaggagtccccttttgaaggaaatgcctggacccttttttctctaccatgcttagtcattggcaagggctgccctaagagcagcatgacttcagcttataagtgtggatgaactgtacgcctaatagctagaggccatcagctatccacactcttctcaactgagtagcaactccattcttgaaagggaacctgagaaacctatctctatgtctgccacaggtggtaaacttttccactgtcatgaatagtagcaagtggcaggaacaggatttgaatccaggtgatatgattccagctccagtgttctcatccactgcttactccagttgtgtctagcatagagatgccggagagaaattacaggggtgttgtctccatgtcttctgtgaagagcactctcttagcctaatgcctcctcagggacctcgaactttgatctctgaactgcgtcctcccagggcccagagggaagatcaatcactcaggcatctcccaggacaccaggtcaagtggcagaagttcatcctctgggattctttgtcctctgtaacatcgattgtcaacttggcaaagccagcttgacaataccagagtctttgtgtacaatccatagacagcactgggaagagcaaaccatgagaggccagcactaaaccctcagggtagctaaagaggaagcatggtaagacctcattctgcagcagaaaaaaacaaacaatctgctctacatgtacccagcatcatgtgaacatgaaccagttgagtatcgcctgggcctctgtttgctcatctgtaaatgggctggttgccccttcttgcaatggacaagcctgcatccgcagagttcgagtcctgtgtcttgtgtccttgccacatcctcctctgggagcactccgcaaaagctgttattgttagcccccttctctcaacctccccaatcattgcacactcatagacaaaggacaatctgatctttatgtgaccaagataaaatttgatgggagatcagcaagacataaaggaaggttcttaaatgacatatttatcccaacattgttctgggaagaaaagtatccattgtaaaaactaaacatgtctgattaaatgataaatgcag

SEQ ID NO: 306 - DNA, 4113 bp, Homo sapiens
gaaggctatagccggagccacgaaaaagttcggaaacaaattgcttggtctttgaggaatcgccacactgccttccacatggaaaggacacaaatggttgaactgatttacactcccaccaactgtgtataagtgtgcctttttctccacaaccagcgtgaagactagaagaaaaagaatggaagaaagaagtgaaagagaaacaaatagggaaggggatccctcggatgactgggaaggaaaggaaaaccagaaaaagcagtcaggatgaatgcctgacaaaaaactctgctgcagtgacactttgacatgaagcagattcaaactttctatgactgaacaggacattttccatttattgctcctttgatacccaagctcctcaatgggggtattcttcaatgagacacttttaccagtgaccatattcttgcttgttggtttcttttttttttaaagtatgttgctgctgtacttttaagaaagttgtgttttatcttagtactttgatattcataaatggtataaagcataattttaccacatagctttaatggaatactttttacaaacaaaataaaacttgaccttcttccaccctatctccacatcggaactaattttactacattttatttttcaaaaactattaattcagtcaatgaatattgactttggactacattgggtcattttcaatggattgctctggtacagctttactttgtcatgtcctttgttcttgctctttcttgtctacctaccagttaaaatatgaaactcatgaagcatttagctccctggatagtgattcctgtatcagggtgaatcatgcaaactttcatattgtctaaactataattcagaaatataatgtggcttaaatgggaacttggggctaatgtttaacaagtgtgcaccatactttatcagttctctaagatttattttctacaaacaaaattttttatgtaacgggctacctttaagtggtaatcctaaaggccctttctgacttgttcattaactttttcaagtcttcaggccactgagttatctggtgcacagagtaataccaaatcatgtctgagaaaggttccatgattcccaaagtgcctgattttccacgtcttcctgtaagaagtagtaatagatatgctaaatgactggggaaataagaattaagcctacggctactttaaactttcctatggaaagattttaatgagtttccaagtagactgttcagctgagacaattttatataatgtggtatatatgatttaaaaatctacatccaaaaaacacataaaagacataccctactttagctatgtgtcactatactcagctatgtatgcataatataatatacatatatacatacacacatgtagtttagacacaccctactttagttatgtgatagtatatatgtttatgacttagaaaccctactttagctaggtgttagtttttttctctgactctaaaattatgtgttttgtttgtttgtttgtttttggagacagagtctcactctgacctctgtcgcccaggctggagtgaagtggtgtgatctcagctcactgcaacctctgctcccggggttcaagcaattcttctgcctccgacttctgagtagctgggattataggggtgtaccacaatgtctggctaattttagtatttttagtagagatggggtttcaccatgttggccaggttggtctcgtactcctgacctcaagtgatccacctgcctcggcctcccaaattgctaggattacaggcgtgagccactgcgcccagccaattctgttttgactatgaagtaatacgacttaaaatatgaattacggaagccatgcttctgagtcatgcagtgaccttcctccacccatccccacgccagtgcctcccactgttatttttgtgcatttggcataaccagttttctttaatgaaagagatttcctttccaagataggagtgcaagctccagactaaaattatgaaaatgcaaatgagtagtgcttcctttatccaagttgctttcttcaggtatatgttgtatgtgtgctgttgtttgctggtagctaaaagtccattctttcagcaggattgtcttctgtctctaagggaacaagaatgaccattaagtaaaaaacatgtatgaaattatgcgggtgagaatctttaccccactttttgttctttttgatggtagaaaaacctttgtcttgcaaaggcaaaactagtaaaaactttctgccttcggcttaaacattaaatgaaaatatatctatttaaacaatgttttaggctgggtgcggtggctcacgcctgtaatcccaacactttgggaggccaaggcaggcggatcacaaagtgaggagttcaagaccagcctggcttatatggtgaaaccccgcatctcctaaaaatacaaaaattagctgagcatagtagtcggcgcctgtaatcctagctactcaggaggctgaggcaggaaaattgagccgagatcatgccactgcactccaacctgagtgacagagtgaggctccatctcaaaaaaaaaaaaaattgttttgccctgaatgggtagaccggtgggtttgagttcagctttgggaaaaggtaggatggttttcctctaagcatgaagtaggcagaatgtgcctgttttgtcctttcatgagagcaatttgatctagaggaagtacgaggctttaaactccgggtctacagaattaaaggagggtaaaagaaggacagcaggacctgacactgggcttcttattgttcctgtcacaatttaaatcatttgttcacagttggtcacaagacctcagtctattccgtgctgcaagtgtattctttcaaaaaacaggaagcaacacttaagtaattgcagatttacagtgactaccaggctgatcccagctctttgtcatggctttcctgtttgggtctgaaggaagtggcggagaaaggagagagagggtgggggaagaaactgttagaaggacgggttagcctgagcctggctttgccttagtgaaagagtgatgaaaacactttaaacagttgccgacaggccggtagaaaatatttgacatctcacctacatcaacaagcaagagttaaaggttaaatcacacacaactcaagtgctgggaaaaaaggataggtttaggtcatcaactttctttgttctaggaccgccctatgtcaacaaggagacatattcccactccctggttggagacaccaggacaatagagactgatccacatttgctctgggtggtaaatccccttttaagcatttgtagcttgcctctagtctagccttcttcatcgttttttacctgcttccaaatacctatgtatttagggcaatgtggttggtggcctttcttctttcttcaaccagtttcttgagatcccaagcatgaagcttagtgtaggaggagaactaggaagtgaaaagtgtttgcatccatttcctgtgttggttccaaattcagtgagcatccaacctaaatcctttggatggtggtagggccagggaaaggtgctttacattgctggttctcacacactctaggtttaatgatagaaggacctttctggagaggcatttagtgcttttcacaaggactataacaaaaggtggggcagatttcttcactggttcaaggaagatttgaattgaaatttgggaagaaaggaaaatatgcccaggggagcaatgcaacactgttgtggtggatgccaacaggtgtgttatagaatgaaaaagaaacagcatagaaaagtacattttatcatttggtgggccaaggtccattttgagaatctggtgagagccatgattatctgcctacaccaaagtttgtatccatgcttaggaggatcagaaattttgatgatttttttttttttttaagaattcctagaagttcagctgggctcagtgtttcacgcctgtaatcccagcacttttggaaggccgaggagggtggatcacctgaggtcaggagtctgagaccagcgtggccaacatggaatacctgcatccacaaaatattaattgaagtcccac

SEQ ID NO: 307 - DNA, 8461 bp, Homo sapiens
acacctctcttccggctggagcagcctgaccaagtcccacttgctgttctgccagggagcctgattttggcactggtgtatttccagaaccaaggctcaggaccctatgggattgcacaggtcgcagcccaagcgcagtacttgcgcacaggtcccagccccttccctctctgggacttgtcttctggcccctcactcctgcgatgagcttttctttcagctggtgaaaggccgcagacttcgaacctctgggcctttgtccaggacgttccctcagcgctcagtgcccttcctggtggcctcctacatcttcagatcccggctgagctctgcttaaatccgggaccgggtagtcactggggcagccacttggctggggcgaggccacctcgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaagcttctctggaagacctggtgctggtccgctctcccgggacctcattttccttatgtggacaacgggggcggggtcacagcagcccctcgggcttatagccgggttgttctttccttaaatctcctccctctgccaaaataaaaaaccccacagggcaaggcgcggtggctcacgcctgtaatcccagcactttgggaggccgaggcaggtggatcacctgaggtcaggagttcgagaccagccttaccaatttggtgaaaccccgtctctactaaaaatacaaaaattagctggacgtggtggccggcgcctgtaatcccagctactcggtaggctgagataggagaattgcttggacccgggaggctaaggtcagtgagccgagatcgtgccactgcactccagcctgggcgacagagggagactccgtctcaaaaaaaagaaaaaaaaaaaaaaacccacagcgtcccggaggggcctgaggagttgtgaggggccgcctccgcctccagcatctggcatctggaggaggaggctgaggctgaggtgagggtgagggtgggtgacccgcacctgtccaggcccaggttgcctgctcccagcttgggctgggcagtggggcagggccatgatcccgccagtgctgtggttagccctacacctggcctggctgaggacagcgaacctggcaggtccaacctgggccctcccagcctaggatctccaaggcctcgtctcagtcaccatcagctgctctagggtgcagtggggcccaaggaggattgggcctgatctctgccccccagagcccatggacccaggactgggcccaccaggcgtgtcgcaggcatagggtcagtggcttctcaacagctgctggccccggcgcccctcaccaccccacctccactggtcagaaccaccacactgccagagactgggtttccctgcagttctgaccagtggggatggggtgaggtggaagggacattgcttggccgggcacggtggctcacacctgtaatcccagcactttgggaggccaaggcaggtggatcacttgaggtcaggggctcaagatcagcctggccaacatggtaaaaccccatctctactaaaaatgcaaaaattagccaggcatggtggtttgcacctgtaatcccagctactcgggaggctgaggcaggagaattgctcaaacccaggaggcggaggttgcaatgagccaagattatgccattgcactctagcctgggtgacagagcgagactgtctccaaaacaacaacaaaaaaggcagaggagtggggagtctggatggctccgctggtccagcccacccctcaggggacagactggttgacttgacgggttcactgagagtgctaggaccggccccaggtgtagtgccctccctgcggtgtcctgaggtaaagcctgccactctgagcctgctttctcttgccaggagacaggaccttgtccgctgcagctgggacatggtgtggataaaacctgtcagacagtgggcgtcctcctgccctgaagcctcccctctccctggtagccttcaggccccccagattctggtctctcggcctgctgtctcctttttccttggtaccttggcacctgaactcgcttggagtgtctaaggagctgcctgtgacaccatggggacctctattggtcccagcatcccctgcccagccgtggggggcatcggtgtcagccctgccaaggatcagtcagccaatcaacaaaccgcagggatcacccagctcatggatgtgggtgccgggaggcagggagggccacacaatgaagagatgtgtgtggtcctccatgctcagagatcctcatgcccctctcccagggatgggagttcccctccccatcaggggtagccctagggcccccagccccactctcactagggccagcctctctgtgaacccctggactcacatcacgtgtgcggggcccagctttgaggtggaagaccaaaccttggcattgcttctgtggaagctcaggaaatgcccacgatatggcctgaccaccccattcacacgaggatggagggagcaccctggtcacctgggggttgtggttagagtgccctccagccgagcctgcagcccagaccgagctagactggaaggggtagaagggcattcaggtagggacacagcctgggcaaaggggccctgacctttggcagctgcgggaagatgagcccacctgaaagggaggctgcattgagtgcagtcaggacctgggctgtagggctcagcctctagacagcaggagcacagaagggcgtggcggggtctcctgcccggccataataaacaggcccaagacttgttcacacaggtcccaggaatatgctgggtttgccttacgtataatttgtgattcatacctctcagtcttccagaaagatgcagtctacagaaattcagaaacaatcaatttgtaagaatagacatagataattttgaacaaccaagattagtgggagataggcatttacccaattctaggacattaatgattagtaatcaggcatcagacatagctgtggtcagccatggtggctcacacctgaaataccagcactttgggaggccaagacagaaggctcccttgagttcaggagttctagaccagcctgggcaacagagtgaaaccctgtgtctacaaaaaataaaaataaaataaaataaacaaattagcctgtggtcccagctacctaccagggagcctgaggtggaaggatcgcttacgcccgaggtcgaggctgcagtgagcagtgattgcaccactgcactccagcctgagtgacagagtgaggccccgtattaaaaaaaaaccccaaaaacttagctatgagtttcctggcagtcgaggcatgaagggaatgagaatggactatggaacttcactgtgtgatcacagcggagtatatcaggcagccaggaggccctcacttatatacccaagcctcaggcagcaggcatgttctgtggcggcctctggaaacaggccatcagggccgggaggacagagatggctgtgagctgggcctgcaccctcagggccctgcctgttgagtggctccagggtgtcttgccctctctgggcctctgggccaaggctaacccaactctctgggtcacaggggctcaagacctcagtggcaggtcatgaggaaggctgccctgccagcctcaccctggctccccacccactgcctgcttctttttttttttttttttttttgagatggagtctcgctctgtcacccagtctggagtgcagtggcgcgatctcggctcactgcaagctccgcctcctgggttcacgccattctcctgcctcagcctcctgagtagctgggactacaggcgcccgccaccacgctgggctagtttttttttttttgtatttttagtagagacggggtttcagcatgttagccaggatagtctcgatctcctgacctcgtgatccgcccgcctcggcctcccaaagtgctgggattacaggcgtgagccaccgtacccagccctgcctgcttcttaagtggcccaggaggacagggagtgagcttgtctctccccactgcagggtcctgagggctggggactgtgctgacactggtctctcccctgcctaggcatatcctgttcctagtgcttggaacacccttcccaccctcacatgcctggcaaattgttcttcacctctaggttcacatgtcgcctccttcagctttaaattcctacacgaggccaggcgcagtggctcacgcctgtaatcccagcactttgggaggctgagacgagcagatcacgaggtcaagagatcgagaccatcctggccaacatggtgaaaccccctctctactaaaaacacaaaaagttagctgagcatggtgtcatgtgcctgtaatccagctactcaggaggctgaggcaggagaatcgcttgaacccgggaggtggaggttgcagtgagccaagattgagccactgcacttcagcctgagagacagagtgagactccgtctcaaaaataaaataaaataaattcctacacgaaggctggggctggctccgagtgagcgggcctggggtatttgtgggataatgtaacttgggagtgtctaagtaggaaaaaactttaggttcttcagtcccattgtgcatggggaaacagaggccctgtgctggtaagtaatggggcagaagccagggtggctgcctcagttggagggaaagcggcaccaagattcacaggacagctctggggtcctggtcgcagtccctgccgtgccgccttctcactcagtgaccctgagcaagctgcttgccacgagatgtcggctccgtggcagtggatagcttcagccgtgggaagtccttggcaatcccctggctcgcggctggtgctcagctgggttcgctctgactagcactgcaccttggtcaccacctcgactgccacacaccctcccccagtggagacagagccaggggtctctcagcttccccaaccctggctccccattgtccagcctcagggatttggagactgggacaaactagccatgcgggggaaaggtgttccagaggagggaacacagtgagccaacaagaggatgggatggggcagggcctgttccaggaacaggctggggtcactctcccttctccagagtccaaggcacatgggtggtgggagaagagataggagaggctggcgaaaaccagcccgcaaggccctaaatgcctgactaagaagcttcagtctttcactgaagttttggagctaggttgggtgcagtcagatagcttgggggctgggccggagcatctggtggagagtgagacaccggtgtgagctgcagccctcgctgtgggtcccagcacccaggactgcacccagcccaggactgcagcaagcaggcacaggatgcgtggctgactgaggcctgtactccgactggagtcacctaggagattggctgagatgacctccagaagggccttgccccaggccggaccccaaggggaagctggctctatgtctttggacgagttaggaactcattgggggtggctgcggttttatttggggattcagctgtgccctgcacaccagctgctgagcaatgtctccaggaagccacagctgccctctgggaggcagggggccaggtgcagtagaggagatgccccagcggctcatgcaggagctcactcagacgccagaaccccagccaaggaggcaccccagacccaggcccaccagggccagtgtccccactccacgacaggggcactgcagccggggtggacacccagccttgctgctcactagtcacgtggtctgggcaagtctcttcctcttccctgagtgaggtgaggcaggatgggctaggatatgtggtggtaacaaacaactccagtctctttttttataatttcctacagacttttttttgttcttgttgaggcagagtatcgctcaattgctaaggctggagcacagtggtgctatctcagctcactgcaacccccactccccaggttcaagttattctcttgcctcagcctcccaagtagctgggattacaggcgtgcaccaccaaacctggctaatttttgtacttttagtagagatggggtttcatcatattggccaggctggtctcgaactcctgacctcaagtgatccacccgcctcggcctcccaaagtgttgggattacaggcatgagccaccgcacccggccaacctgtagattttttgagataaaacagctttattgagatctaattcacatatcacacaattcattttaaagcgtgcagctctctgtggtggatggtatattcgcagagttgtgcaaccatcaccacaatcaattttagaacattttcgaggccgggcgcggtggctcacgcctgtaatcctagcactttgggaggccaaggcgggcagatcacctgaagtcaggagtttgagaccagcctgggcaacatggtgaaacccccctctactaaaaatacaaaaattagctgggcatggtggagggcgcctgtaatcccagctactctggaggctgaggcaggagaatcgcttgaacccaggaggcagaggttgcagtgagccgagattgcaccacggcactccagcctgggcgacagagtgagactctgtctcagaaaaaaaaaaaaaaaaaaaagaacattttaatcaccctccaaacacaccatgtacccattagtaaccactctccatttacctgctctgcccagcccctggcaaccactcacacactttccatctctatgggtttgcgtgttctggacatttcatataaatgaaaccatatgacgtcgccttttgtgactgacttctttcacttagcaaaactttttaaaaatagcttttattggctgggtgcagttgtttgtgcctgtaatcccagcactttgggaggccgaggcgggccgatcacgaggtcaggagatccagaacatcctggccaacatgatgaaaccccgtctctactaaaagtacaaaaattatccgggcgtggtggtgcatgcctgtaatcccagctactcaggaggctgaggaaggagaattgcttgaaccagggagttggaggttgcagtgagccaagagcccaccactgcactccagcctagagacagagcgagactccgtctcaaagaaaaagaaagctggctgggcgcggtggttcacgcctgtaatcccagcactttggtaggccgaggcgggtggatcacaaggtcaggagatcaagaccatcctggctaacatggtgaaaccccgtctctaccaaaatacaaaaaattatccaggcgtggtggcgggtgcctgtagtcccagctatttgggaggctgaggcgggagaatagtgtgaacccgggaggcggagtttgtagtgagcccagattgcaccagcctggggacagagtgagactccgtctcaaaaaaaaaagaaagctttttttttcagagctgcctgaggttcacggccaaattaagcagaaggtacagagagttcccatgtacctctgcccccacacatgcacagcctccctcacaatcaacatcccccgctggagccgcacatttgttacaactgaggaacctacagggccacatcatcaccggaagtccagggtttccatgagggttccctcttcctgccggatgcttcacgcgttcgggcgaatgtataatgacttgtctccaccattagggttttatgcagaatagtttttgttttgttttgttttgtttttgagacggagtctcgctctgtcgcccaggctggagtgcagtggcacaatcatggctcactgcaacctccgcctcctgggttcaagcgatcctcctgcctcagcctcctgagtagctgggactacaggggtgcgcccccacatctggctaatttttgtatttttagcagagatggggtttcgccatgttggccaggctggtctcaaactcctgagctcaagtgatccacccgcctcggcctcccaaagtgctgggattacaggcataagccaccgcacctggcctagagttatttctctatttgactactaaaggacatc

SEQ ID NO: 308 - DNA, 4132 bp, Homo sapiens
atgctccccagctgggccggctgcggacgcgggaagggaggtggtggcgactgacggaactgggtgaagcttctgcagatggcctcccctctctgcgactggttccttatcgaggcaatggagatgtggactgcggtgactgatcaagcctcacatatctactgaatcaggaagcccgaaggcctgaggcctcccgagtggccccatgggagcgtcgtgcatttttctgggcccgatgacgatgctggcctggcgggggacttggctgacccggcctccgcacaggtggactagttcacagagcttggccactggggggctgctggcaggcgagacaaacatcgctggctggtcggcaaagagggttccgcggtacggccctgcagacaagtggcactcgcttcggcacagctgtggggcagacagagatagaattacagagcataataaataccgagcctcagcagctttcatgtgccttgcaggagacagtggcagcaggggcaaatgattcttcctggatggtgactttaacaaagacttcttctggggggcaccgatctccacctggccatgtcttcaagcccaaggagaagtcccaggatgggtctgagctaatcacggtgatcgcaatacaaatgactgcgctaagcatggcacagctggcctcaatcctggccaatgcaacgtgagaatcaattgctggtgggattctgggggagtttttctcactgttataaacagatgcaaagcagaaatacttctctttgctggacactgtcatgtctaatgtgacgcctggatcactgaagcccccagaggccacgggacacgctgaaaatggcccagtgggaaggcggaaagccttgggtcctgaaaaacacttctaagtcactgacggaccaaactgaaatcatcctttattttgttcttttcatgtcagaaaaaaagacccctaaattctttaagtgacttttttgttaagtttttgtttctagaagcccaaaatatcctaataataataattttaaataatccacctatttttggaaatagcttgttcatcattgagattatgaataatagatcagttctcacccctgccttccccaccatttaccagagttaacaactgtgaaaaattctctgtgtatttttaaaaatcctgtaaaatgcacacacaacacacacacacatttatgataatgcttgttcttaaccaaaaactgagatctaatctctatctcactatatggataagcagtaaataaacctttttgtaatgcagtagaaaaggaaatcaacctctcgaatgtttaggatgtgacttcagtagctagtttctttgtgctgtgacactgccttcagaattctgatcttggccaattttcctatccagcaaataaagcaccatttcccccacactggtacattttaaaaagttagctgtgaattctaagctgcaaatattagatgcagcaggcggtgttctcattgtatcaccactggctctcgccaaggagcctgtgtgttacctggagatcaaggcgaaaagcctcaaacgcacaaattctgaagtcaacttgctgtttattattttcatggatttttcaatacccttggtaatcgcaatttacagcaatgtgctctaaactctaacttcagctgggcaaagtggctaacacctgtaatcccagcactttgggaggctgaggtagttggattgcttaagcccaggagtttgagaccagcctgggcaacataggcagaccccatctagatagatagaaagatagatagatagatagatagatagatagatagatagatagattagatagatagatagatagatggatgatagacagacagacagacagacatagataagcaagcccggcatggtgtcacatgcctatagtttccgctacttgggaggctgaggtgggaggatcacttgagcccaggaagttgaggctgcagtgaactgtgattgtgacccttcactccagcgtgggtgacagagcgagaccctgtctcaaaacaatacaactccccacccccaacaaaaaccaatgattctaatttcattgcaaacctttacacacacacacacatgcacacaccccagaaacaggagtgcgtgcaggacatgtggaggggacagacgtaagttggggaacgatggctcggtggcatcgtgttgttttatttttgttgttacctcagtgaaaacctcagatataaccaggctcatctatttatatattgacccagaagtttctagctaaaaaatgttaaaagataattttttaaaaatcataacttttgggaagctgaggcagaagaatggtgtgaacctgggaggaggagcttgcagtgagccgagattgcgccactgtactccagcctgggcgacagaacgagattccacctcaaaaaaaacaaaaaaaaaaacaaaaaaaacaccccccccccaccaaaaaacccataactttcatacaggtataaaataaacaacagtgtattcattttacttaactcaaatgctataactggttcaaaggacaatccgaagaacacatttaatgattaggaatactgatataaacttgctaatggacaaaaaatattggctttcctacaaggtaggaagcattccctctaccagacagaattcatttcctgcccacagacaagcgcgtttgcattgccagcagctatttacaacttatgaagctgtaaaacagctcccaagcaatgaaggctgcaagcagataaggtggcaggccgtgagcaggcctcaaatggagttttacagtgaagcacaaatgttcccctacagaacccaagatgtctctttaaaagaaatcatgaaagaagaggggattaagtggagcttatggactgctccagggttaagtggcctccaaaataaacaacaggactgctcagtagtcagagtgaattttgggtggggtttgaaagagttccagctttcctctgctaatggtgacataaaatgttcatttcatacccatgcatatacactgatgtatacatgtagttgaggaggcagtggcagaagccagaaggctttctctgccatgagctcctcctaggagccctgggttgcagagggtgaggactgctaggaaagtccgtcagttaaggccgaagggacattagctttgccttaaaccacattggctgtgcttgcctttgtgtcttcacctgatttaatgggttttagctcacactctccgaatctatttacctccaagtcagttaaggcagactgtactgttgacaaagctaagcagaacagaatttccccatggcttctagcttcaaggaatcccagctatttatccatcaccaagaaatgaagccccatgggtggctgacggttcatttactccagcccagggtgttggatttcaattagtgcattcgcttttccctctaggcagagctcaccctttaaagtcgctccttggcctgctaactgtcttaagatgcactttcccatctcaacaatgatacaggacgtgtcttacagggctgtagttctcattcacagcattcttcctctgagtggtccaggaaatactcgcaggccttacagtcaagtcaccttagatttaaagtacggaatacgcgaaaccttcctaactggtaaagcgctcagtaatgcaagctctgggtgcaactcagtggttcttagtatagtcagagttatgcgatcatcagcacaatctactcacaccctcctcgaggtattaaataaatatttcagaatccacaatgcagccaatctcatcaataactttactgaatcctgtagcccagcactcaggggttctctaaaaccctgccccgccttcccctccaattgcggtgcccactgtctcttttaaatagactctgtcctcatcaagcctgttctctgtcccccaaatatgccgtatcattccttaatgcatgcattttttccccagttccctacaatcttataattagtggttacgctaatctatatgtgtgtttaaactcatagaattgtatacaaaaaagtcaactgtactgtgtacacacatttaaaagataaaatgtgttcttttaacgctta

SEQ ID NO: 309 - DNA, 3185 bp, Homo sapiens
gagaccccatttcaaaaaaaaaaagtgccaaatgtgtcccttcaattccagtcagcacttttggaaacacgcgtaaaattgttgccaatgtgcattctgtgtgtttgggagtcattgtgcaaaatgcgtgggcagcaagcactcttttgtgaaccaagttctatgaaccaccaagtattctttctctaggctgaattccaaggctctgttcagagagtacaggtttctgaaggaagggatttgatctatgtatgcggctttcttcttaaaatgccaggaagaaggttgcttaacaaatgcttttgacattcctgacaagtaatctccaggcttgacttcaggggtgagttacacctctccctccccacgcctttttgagagtattgccaacaagcagcagcaaaactgatgttcttcaactccaccctttggtgcatcactgaaatggcaaaaaggtaggaggtgcagaggagaacttcaggccacggaggcaagaagtcagtcattgattcctggcatgattgtgatagtcgtgtttggaaatccaacccataaaatgagccaccggtttcacagcgcacaccttagagatctcagaaacatgccctaggcttgcttgagtcacaatagctgggttcaaatctccactcctgttgtctaaagaacgaactgtctaggctagtctcagccttggtttacaggtatctctccgcagggtttttttgggagaactatatttgaaataatgtgtgtgaaagtttctgagatatagtaagtaataatacttgtggggattctaaggcttacttgcagtgatttaagtgtatatggggaatatttttattgtattgcattggcatgaataaagacatttgagatttggatgtttacgtcttaaaaagccagtggtatttaatatttgcaggaagaaaatgttgtatttaccctataatataggaaacttggcccatttttctaatgatatagaaaaagctcaattaggcttaaatatgacctagcaccaccccaagcctacagcacttgtattctctttaataaaaattgcgtaaattatagctttctcttgatttgcacagtacgggctcaattctaccccctttcccctaagtagagttgtttcttactatttttcaggttaaccaactaatgtcagacatatgtttcttcaccaaacactgcattaggggacgtttattttacatttgttcccttttgcaaatatttgcagttagttgcagaactgagctattttatgaagtacagaaaatatgtccagggaaaacataaggtttcaaaagtagcttttgagaaggagaaaggaagaaaagtctaattacagtgaagataggtactgatttgtgctaagagaatgtataaatcacgtccactacactcgtggttttaatgcattctgtgcatctgaattaaacaggagctagtgtttgaaattatgtctaaagctttcttcagtgatttgagaatataaaaagtagtgtttcttttctttcaaaagacatccctctcgcagtgtgccttctattcttgacttgtcttgctataaaagaaaaagctctcacagtcttttcaaatctaaatagtctgtacattaaaacagtttcttttttcatttaggaaactgaatcatagctatacagttacaaacataatatgaaaacctaaacaccttttatctaaaatgaaccctcagcaaattagcaagaggtaaggtttaggtatgagggacatttttttttttttttttttttttttttgagatggagtcttgctttgttgcccaggctggagggcagtggagtgatctcggctcactgcaacctccgcctcccaagttcaagcgattctcctgtctcagcccccctagtagctgggattacaggcacccgccaccatgcccggctaatttttatatttttagtagagacgggatttcaccatgttggccaggctggtcttgaactcctgacctcaggtgatccacctgccttggcctcccaaagtgctgggattacaggcatgagccactgcgcccggcctaaaggacatttcggtatacatttaaagtgaatgttttatacaatgagtcaaaagatgccctgacctacaataaatttaattcttttgttgataattccaggcaacttaaacatattcaaagcaaacatgggatggttaggacccaaaacagcatttgtttagaaagatgaggtcctatctgggattccttttgccaagggaagatgccactggaaatgagactactaatgccccaagaagtgactgatcctataatggaaaagggaaaaaagaaaaagagaactgcttccttcttcaagggacaaccacatcaaagcacaaatgcactcctgcgtaggtgtgtgagatgaaggtaccatctcagccactgtagaaactgctggcctcccttgaaagaacacaggccacattccagggcaaccatttctgtttaaactagtttttaaatgttaaaatgttatatgcatatgatgacaatataaatggtagcaaaatataggtgttaagaataaaagcttctgtcctcattagtcttctagtccctctctctgatttattggacatcattccagaaatttttttcctttaagacggagcctcactctgttgtccaggctggagggcagtggcgcaatctcagctcactgcaagctccacctcccgggttcatgccattctcctgcctcagcctcctgagtagctgggactacaggcgcccgccacaacaccctgctaattttgtttttgtatttttagtagagacggggtttcaccgtgttagccaggatggtttcgatctcctaacctcatgatctgcctccccttggcctcccaaagtgctgggattacaagcgtgagccaccacgcccagcctggaaattaatgtgtagacaagtacacagaaaatgcacatggctttttatacaaataggatccaccctttttaaaacaaatggtgggctgagtgcagtagctcatgcctataatcccaacacttggggaggcagaggcgagaggattgcttgagaccaggaggagttcgagaccagcctgggcaaaacacagtgagaccccgcctctaaaaagaaatttaaaaaactaaaatgaaa

SEQ ID NO: 310 - DNA, 9479 bp, Homo sapiens
gtaaacagggtatactgttgcagattccgtggagtgcagctttaaatagatttggtttggaaatgggacagagaacacaccgcagtcagtggatcaacgttgagagcagagaaaaacaatgattacactcattaagtgggtacctgttgacacatttactgtcaagtctaattatttattgaaactgttattctttcttcattactgccactgataccaattattgccacaggattattttaaatttctacagcatgctcccagactatttacttctccacctcccaaaggttacttgagaggtttctatcattccctctctaccattccccacctccaaaatataacgaaaagagaaagagagaaaattcctctttcttgagagtaatttttgtaacctttcagggcttgcttaaaactcctcttgatagtttcaagatgggtttctgtggggacaggggatacagttaattacttttcaaagcttattctattaatatttaacaattggcatcggagggaaggttagtgtgataactgcagtttctaaatgaacaagttagatctctgcctcacagagctgtcaaaaactatgatagtaggtatctacagtacattcttttctgatatatttatccgtaaaaataaaacattagaaataagtttttgcagggttattttgtggactagaaaagaaataaaaggtggacaggagccattcttacattttttgctactaccttttttaaaaacaatgttctctttttctgtgttagtttgctgagaatgatggcttccaaacaccgcatgttctcactcagaagtgggagttgaacgagaacacatggacacagggaggggaacatcacacatcggggcccgttgatgggtggagggcaaggcaaggacaaatacctaatgcatgcggtgcttaaaacctggatgatgggtggatagggtgcagcaaccaccatggcacatgtatacctacgtaaaaatcctgcatgttctgcacatgtatccaagaacttaaagtaaaataataagtaaataaataaataaaaaacttcctgggtaaactagcttatattccacttgaaaaataaataaataataataaaaataaaaacaatgttctttttttgtaggaatgagaagaaaatctaaataacttaagtggctgttatgtctggtttaattacagaaatttcatagtccatacataacctaccttgtctgcacgtgttcttattatatatatatgatattagctttgaaaatcatgtaaacctgacaccttaatttcctctcaattctaaattttctaagtcctacaaatttggggcaataccaaccaattttattcttctcaaaggtctgtgcaactgaagtcatggttgcagttcgaggtcatagatataacataccaaaggaattaacaaaatattcagcagaatacatgtgtatagtactctaaataatgatatcaaatcttctacaaagttactattctacatattgactacttcacctctttttggttaagttacattacataaaacacagtagagctcattagaaggtacagattcagcaggttgactttaggagaaaaatcgcatctggtaaattttacaactatgatgcttcctttaaatgttttttctccattggcctccattttcttggcaaactcaagacaaatgtattcttctgccaaggattggtgtcattcccaacagtcccccaggagagtggcattcagatacaatggatgcaaggtttcaaaagactaactcaattttctgtgttcttaggatttttctgttgtggctttggattctagctttttgagatgattttgtttggcagctaagagagagtgactgacccagccataaatatttggccccttcagagccaggtaacactggcagtatagtgtagtcaaaaatgcgctcaatcaagggttaggaaaccaggtaaaaagccctcctgccacatactagttgaggatacaataaaataatggttaagcacattctactccattgcattttatggacacttaaatacatacacattaaatctgaatcgtctgtgtggcccagatttttggttttggtattaaaccttaagggctatgaattaaaagggaaaaaaataaatcaaaaaaacaaaaataaaaagagaggtcagctcactgtcttggccatttttcagttcttttcctcataaagtactttgtatttcttctattctttgtatttcttctaaaatcaacattactggctcagatgcctattagtatttcataaacaagaagacacgcctcctctcttacctcagatagctggctcctggaatggatggttgacacaaggttcagccaactgcaatgctagtgtttacaaatgaaataagtaaaaattacttccagacaccaaacccatatttattcattaatagtcataacctcttatatctacataatggtttcttgttttacaaaacattttcacattcattgcaccccacaggaacccgatgaagaagcaggaagagatgattctactggcttcataggtgaggaaacagaagctcaaagagggacagaaaggatgagaaaggaactaacaccatcctcatgattaactttacagaaaccatataaaatgaatattattgtccacattttacagaagtagaaactgaagttcacaaaaggaaagtaatttgcccaagattacacagtttagtatctggcagggcatgaatttggagccaaagtttgtgcctgctagtccagtaatccttcctttctacttcagtttttcctaggttattaggctagggaaagacaaagacaaacagcaactcattgtcttaattcacaaggcttggtggagagagaaaataaaataaaaccagctatttgattgaaatgaggaaatgggaaaagtacataggatttcgagccagtcagatttcctttaatcaatggccttaggcaagttatttaaactccatgagtgtcaatttcttcatatgtatgtgaagattatgatatatactccatagccaaagttgcccttagttaaactttttaaataagatttctctccattattccatatatatggttatagagagcagtgataacatttcttcccataaatccacatttatatgatcaaaagataacattataagcacattaggcaagagaatatctctttgacttatgtttcctagttttaaaacaccgaaatattaatctatgtcactctcacatgacctcatctaacaagagacagcccaaaaacttttaagattttaaaatcaaaagtttccttgacccctaaaaagcaaaacagatactgctttagttgaaagacctgctgatgaatcgcacatcattttcaactttgtgcccataatcatgccctaggttcagagagttggagtttccaccagactctaagaacaaagcaaatttgttttaatagaatggatggatttattgagaaatataagacttctaggaagttttgataaaatgtcccgtttacataaaggactcaaaacaggttaagaaaagaacatggatcctgcaactatacccctgaacttaaaataaaagtttcaaaaaaaaaaaaaaaaaaaagagcatgattgatcagatgccctgcaagaaacttgtcatctaccaccaaatgaaaacattaatcatcttttaacatcatgctttattttatagcttgaaaaatcacaatgaccattatgtctcaaaccattccctttataactccaatgagaccttattacccaaattttacaaatacaaaaaccaaacttcaaagatcacatggttaacatggagcagataaaaatgtaacactgtatcttgataccaaaatcagtaagcaccctcctactacatgacgtagcctcccaattgctatttgaagagggtaactaaacaacttcaggaaagggaaaccgagtgtatagcacagaaaattcaattgtcgaagcactaacacacacttagttctaagttctgctttattagcaagtgaaaggagaaagagtagacttcacatctgtggtctaaccagaaggtgacacattactaagctaaggcaaaaggagtgtttgatgcagtgttaccataaacactttctcagatctcaccaggaaagtttcaagatgcaacatccctgggcaaagtgtcgaagcacaagccatatacgcaagtctgtaccagtgaagttttgtgaagagtgtgatacagtttgactgtgtccacaccgaaaatgtcatcttgaattgtaaaccccatgagtcaagggtgataccaggtagaagtaatccgatcatgggggcaatttcccccatgctgttctcatgatagtgagtgagtctcacgagatctgatagttttataagcatctggcatttctcctgctggcagtcactctttcctgccgccctgtgaagaaggtgcctgttcctcctttgcctttcaccatgattataagtttcctgaggcctccccagcaatgtggaactgtgagtcaattaaacctctttctttataaattacgtggtctctggcagttctttatagcagcgtgagaatggactaatacaaatccttcaccaatcagtctcattttaagcaataggaaagctgaagtctttctagctaagaagttcaccagccctcttcacgtggattgagtggcatgtgtcctgagtagctcctgagtgtttcataatgcaatggagttttccataattccatacagacatctgggacaactgacaaatcccactctagccttttggtaatgaagccagttatccttggctgcctctgtgtattttataactaactgctgacccagaacctgacatgtctgcatcctttgtcaaaccatccatcctctctcccctcaaaaatatgctcaccctcagaagcaattttacagaagcaactatattttggagaaaaacaggatggagtaaatgaaggtaagataataaagagagagaagcaagaaaataacagggggtaaagaaaaagcagaagaaaatggaatgacatggaaatgaaaagtgcagagatcagctgcaatgggtttttcacaaaccatggtgtcctttgaattttccaccacacctcacaacaaaatgtaaccatccctaagatgattatcttagtattatgaacaaaaattctaagtgttattgaaccagtgtaaagctaactcaaaatacttgatattttgtaagtgctttagtacctcaataagcaatataagagtatcttataaaaactcccactaagtcaataaactggtacctctttcaccctggtgtccaagatattcattccgaatagggggaatcatattgaaaagaataatgaaatggggatggaggaactgggttctggttttagtgctgtaattatcaaatcttttgattagaagttgcataaaatacacattctgtgtttctcttttcacagttatcccaaaaccactgcgaaaaggccaataataatttggtcattttcataagtttcatgtggcaacagaggtagtagtaaaaggattacttaacctaacatttattaaaataaaacaatgttttaaacatagaagtctgtccccagaagcaactgaaatgttaaatcaggccaaaggaattagatgacaaatatggactgccctgcattccagtcatcaaataccacatacaatttaaagtgcactctcatgccaccctaagatacttatcaagaatacaaggtattccatagcttatgatttggttgtctcattaaagtaatgtttgccaggatttaattgcttccctctctgattttaatttccacacctgtcagcatctatcagaggcactgaaatcttctgacatctggttgattgtgttgaaattaatcagattttttaaaagtaaattgctttggcctaaaggtaatgctcaacttcttaatgttatatttataagggctctatcaatggaatgtataatctagaaataaaatgagagactttaggaattctgagcagaaatataagtagcttacaaatctccagcactggacttttaaagataagtactttaagagtgacatcagtagcatggccaaccagaggcccctagctctcgtctctttcacaaagacagccacaacaacaatcaacaactaaactttaacaaaaataactgggccaggcacgatggttcgtgcctgtagtcccggcactctgggaggccaaggtgagtggatctgttgagctctggagtttgagagcagcctgggcaacatagggaaaccccattgctatatagaaaaaaacaaaaagatgaactaaaaacagaagaagaaaaaataataactaaggcagtgtaccagactgcatcagagaagtaacagaaaccctggatagcaagaaactcagaatgaccacatagagaatagaaacaaaacacctggtctttaccacccatcacccacttgggatctgctggaaacagggaggaacttctctctagggtagaatggtacacaaaaggatcccagcaagccccatcaacaccttgaacagctacagacctcacccatggagtctcatgtagtcctcacaggagccaagtcccagctgagggacctgcctgaagtccacatagccgtgcttccccaagaaaaagagcaaccagtgtgacctgccctctgtggcctgcgcagctactgcgctatgccgtcttggaaatggagctttggctggagtgtctcttgctctgggagtgcatagctatgacactccatcactaaggctaagctaccgttgaaccacccgaacccagtggcccgacatccccaagccgagctgccagcaactgttccactcttccccatgggcccaggtgaaggtagagtcacttaatctacctttcaccctccccttcaggccagtgctgaagcagtaccctgcctcctgggaaaacagtacattggccactcagagcggtcacgcaccccagtacttaatctgaagtagcacccttcatcccagggaaatggtacctgggctgcctagaaaagtcatgtcccccaggcctgagctgaagtggcatattgtcccttggtgaattggtgccatcgctcagctgagcagctgtaaatcccaaagctgagctgatgtgataacccacatccttggaaaactgagcagtggctgggctgatctgagacactccagcctaaagggaaaacaactctaatacgctgtttccctggagctggtctacctgcttagtgtcagagctgctaagatacccctctccctgtggcatacagccaccactgtgctgtactctgcccccactcagggcacaagtaacagctgtatgttgccattctggggtactgctaccgcatgtggtcttacagagtctaaggtactgctgagtcccaacatccaggggtcaagaatcactactacatggtgcctcatcccctgagatccaagttgccactgaaccctactggctcatgttgccaaatcagggcatatcctgctctctgggtccaaacttccctgcactccttctttcctggagttgagccactcacagctgggactgagtttgtagagtaatgtctcagagtcacaaatcctggctctgtgggaagcctacatccaaccctagcacagagagtgaacctgtaacccaagacccaggtgtcacaataggttggcaagatcctgggcataagactctagtcccacagccacttcaagcacctgcacctagaactcagcaccactgcacttgcttgtaggtcatgtgatatctgacatgaagagcagtccccttggctaaatctccccattatgaaaaaaataagaataggaggacctcaaaagcccttgacactgaggacattaataatctatgccaccaccaccactgccacaaatttctacaacttaagctactgaggtgcccacagttattgctgacattgaacgtagctttagaagctgcatggagaccctatcactgcatctattcagaaacaaagtcatcacacccctcccaactgtaacaccaaccctaattgcaagcggaagtctttttttatgaaaaccactccagaaagtttgtatagaagaggtaattgttccaccggatgcaaagacatcaactcactgacacaagaaatatgaaaaagcaataaaatatgacaccaccaaaggaatgtagctctttagtttcagactccagtaaaaaagaaatcaataaaatgccagaaaaggaattcaaaataatgatcttaaggaacctcagtgagatacaagaaaatacagatagacaattttactaaatcaagaaaataattcacaatatgaagaagaaattcaacaaagatagacataataaaaaagaataaatctcaaaaataaagaatttcatgaatgcattcttaccctcataccaaaaccagacaaggacaaacatgtaaaaagaaaattataggccaggatctctgatgaacatagatgcaaaaatcctcaacaaaatactagcaaactgaatccaccaatacatttaaaggagcatttactatgatcaagtggtatttatccgagggatacaaggatagtttaacacaggtaaaccaataaacgtgatacattacctcaacaaaacaaagtacaaaaaccatgattatctcattagatgcagaaaaagcacttcataaagttcaacattccttcatgatataatatctcaagtcaggtataaaagaaacataccttacctcagcataataaacacttcacatgataaacccacagtcatcaacatactggacacgttcaaattgaaaggtttcttttaagctctggaacaagacaaagatgctcacttttaccacttttattcaagatagttcttgaacaggcgtatacaccaatgggacagaacagagaacccaaaaataaatccacgtatttacagccaactgattttcaacaaaggaaacaagaagaatctctttaataaatggtgctgggaaaactggacatccatatacagaaaatggagccaccatgagatatcatctaacccaagttagaatagctattatcagagacaaaaaaaataagaaacgctggcaaagatgcaaagaaaagggaattcatacactgttggtgggaatgtaagttagtacagccattatagaaaatagtatagaggttcttcaaaacactaaaattagaaatattggctgggcatggtggctcaggcctataatcccagcactttgggaggccaaggtgggcggatcacgaggtcaagagaaggagaccatcctggccaatatgatgaaaccccgtctgtactaaaaacacaaaaattagccgggcgtg

SEQ ID NO: 311 - DNA, 2003 bp, Homo sapiens
atccgcgagagaggcgcgcgcccgccaccgctgggggctccagccgcccgccgacccgggcctggcagaggggacgcggcgcccaagccgctcctccggatggcgacagagacggcctgacgcgcccgcagcctgggccccccacggggaggacggccgggccaggtacaacttgagctctcatctacataactgaaggctgcacccagggctgtaaagagtgaaaatgcattgccgaagcatgagcacctcctgcagttctcagtagacatttgggaagcgagtgaaccgccctgtatggagtgtttggaggaggtcggagggtgtcgggcctgagccaggggctgccctgggcctgtgtcgggtggcgcatgccagaggaatgagatgggaagggcatgcacgcggggtcttggcagccctggagctggcctagatgcagcagctttctgataaagcgaaattgttccatcggcttgccatgctttgcttagccatccgcacttcactgttgggcgaaagaagattttaaagaacacccttagcagatgtcagagtttgggatttggggtccatgatacccaaataagattccacttgaagaaagtaacacgaattgctttcaacacatcaatcaacaaagagcattgatggatgaagaggacattgataaatgggatgtctttttgctgaaactctaacttacagtaaaggggggaaactcacagaagcccagtggaagcttctggagccaggagctacactgactctctccgcagagggtgtggaggggtaggcggcagtcagcccccagcccagagtggagggcacctgggcacatgtgtgatcagagcccacatggagggaggccagggtccagcttcccttcactctgggaacatgggaggccctgtccccaggccatggcacacagagggaggagcaggagctctggcagcctcagaggtgtgtgccaggccgcagcctattggaaattcctcaggagtgcatggcctggggtcccccagcctgcgggaggcagagggggcgaggccaggtcccccggcctgtgggaggcagagggggcgaggccacgtccaccagtccgaagcctgtcctgcccagcttgctgtgtgactctggcctcggggggaacattatctgaaatgtacatagtggaatccaggcagtgttcaccccttccctctgtgccctccgtggtcttctgtgacctgggatttgttggtcattggcagaaacagaagatgcattattattactgtaaaaggtaaagttgtcccctaactggctcaactgtccgaagacccccctgctttttctgcttttccttgtgactcagcctggtctttcttcttccagggtggcatcccactgactcctacgcagccccaccctggttccctcactcccaggttcctggtccctcagggtcctagggctgagtcctccatagcccccacacacagcccagagctgggactgacccacggcataggacaaactcctccaggcctctgagagaactcctgggctttcatctacatgattcagaaagaatcttttttctctttcaaatgttaatgtttttaatttccttttttttttcatttttcattataactgctaagatttttctaattggcatgccaactgcttgcagacttgacctgtttcttgcaaaaaaagaaaatcgcttaatcattaaatacaattattacttcattcttctatctcttcagtctaccaaactattatatactcttgatgattgtcattttcgtcaaaagaaaactgtatccagaatcccataacacttacaaattaagtgtcttaatttttcaagttcttttggggcttgccatatgagtgtattattcttgcatattgcacattcattttctattatttttaatacataattctacaaaataagcattcttcatgatatatatttgtttgagaatttcttaataaaagatggg

SEQ ID NO: 312 - DNA, 6403 bp, Homo sapiens
ggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgtaagtcactcaacagttaataataaaagtcagttttgaatattgcaggttttagacacagaacaaatgtaatgtgacactgtaggaagaatgaattctccttagtcccaaattccttttttttttcttagattcgggaataagtaaagatacaagatcctcttaaccagtatcagtataattgttccctttagatttattgctgtcaccccaatgctcttctttctttctagaggaaaggaaaagaaggaggtaataggaaaagtaatgggttgtcctgatgttactgtgtctaggatgtcattgccactggtctcctcagatcaatcattctgcctaataaacagaaaaataacatgggcagcctcacatgcaagcctttacacacactgctaaagagacctcgcttcctctgagaagtgaggatgtgagaatgaaggattgattttacagaactggatgacaggttaaattgggcatctggaggtttatattcccatctccactcaccaagtttcatcctccatttatgaccaaggataggtataacatctgatcttgatggttactgtttcaaaaaacaatctgatcttttttataaagttaaacatttacttaatcatgcagcatactaattcccactcctgggtatttatccgagtgacataaaaacaagttcacacaaaacctgtaaacacatatatgtctttattcatataatagaaaaaacacaaaccctaaaatggaaaaaacataatgtccttcacctggtgatatggtttggttctgtgtccccacccaaatctcatctcaaattgtaatacccacgtgttgaaggaaggacctataaccttcacgtgtcaagggagggaagtgattggatgatgggggcggtttcccccatgctgttcttgtgatggtgcatgaattctcaccagagatgatggttttaaaagtgtttggcagttcttccttcattcacacacactcactgtctctcccctgtgccacataagatgagcttgcttcccttctaccataactgtaagtttctgaagtcctccccagccatgcagaactataagtaaattaaacctcttttctttataaattacctagtctcaggtatgtctttatagcagtgtgaaaataggctaatacatctggtgaatcaataattaaaatgtagcatagctataaatggaatactactcagtaataaaagaataactcgatacatacaataatattgatgaatctcaaatgcattatgggaagtaaaagaagccaggctccacttatgtgacattctggaaaaaggaagactatacggtcagaaaacagatcagtgtttgccaggacttgggggtggggggtggggagtgattgactacaaaagggcatgaagaaattttgaaggggaggtatggaacaggtctgtatcttgactgcagtggagttattgatacttaccaaactgtacaataaaaagtaaatttttattgtatgaaaattatgcctaaattaaaaactattaataaaatcagcattagcaaaatatatgagtttatacacaagagactactcaaccattgggtaaactaattatttttaaacaaataccattgattttaatctttttatagtttttatacaggcagagaaataatagtgattctgctcacctaaaggaagatagacccaattcaaaggtacagaattttccccaaatagtatcataatttttcctttcagattccaaaggatttgcatgtaaattctatcatgtgatcctcagaaccaccctatgagggtaagcagaacagatgatccatgatattccattttataaatgaggtgcaggttaaatatttagccagtatttcttgataagtatagtccatttatttcaacaaaccttgattgagggccccaatacttgttgagcttttgctgagccacccctgctctagaggagcacatgctctggaaatctctaaggaaactactacaactctaaatagatatggtgtatagtgatactgtgactaaatattcactgcaaatttcctctaaaattatagatatacattactggaataattagtatctcaacatcttcattaactatgaatctactatgtatatatcatcaccatgtgagtattaatttggtacaaataggctgccaactctaaaattatttgatgtagggcaagtacttttatctttttagccataaattttctcatctgtaaaatgagaggagtaggcatgtgatcattaaatcctgggttacggtaggaggcatcaatatgaaatgtttagcttaatatagatacagatgggtaaatatagaaatacttaaaaatgcatgtggattcatgtttaatacattagtatacacacatatatttccaagttctgtcctccgaaggcctagaagcaatgacaagcagaagcaaggagcacacccagcatccagttttttgtttctaatactgttctccaacaaagggaaccagagcccttgagaaaaatgcctaattctaggactggggcaggggatatacaagatgagtctgaaacatcttatagtgccagaaaataaacaagtgctttaaaaagacacaaaaaactgatggtatatcaaagtgacataggagccaactaaaagagctcccaatagctaaagctagaataattcaaaaaataagtaattcagcattggatttaacccaaattataaaataagatccatgagttcatactgatacaagtaaatgattgaagaaacaaataattgggagataattctcatattgaaaaattccaaaaaatttatgtactctaccctcgagaagatggaacataattctccaccccataagcatgagtcaagcctagtaaatgtttttcaaagagcgcagtatggaaaggaggaagaacactacctcaaccagctgatcaaggctaacatctctagtatgtcattagtggcatgtaaccttgatatgatatgatgagaatagcatttgatctttgatctgtttcctccccgaaactcattgccccagcctaatcatgaagaaatatcagacaatctcaaattaagtacaaaataaccagtactcttcagaactatcaaggccaccaaaaacaaggaaagtataagaaactgtcacagtctagaagagcctggtgatgactaaatgtaatgtgatatcctggatgggatcccaggacagaaaaagaacattaggttaaactaaatcaaacttgagtatgaaacttctttttttttaagtgcctaagtcctgaatgacaacaaaagactgaagaactgacaacgattagaggacactaaggagacttaacaactaaatgcaaaatgggaccctgaatctgatcctggaacacaaaaactaaattagtagaaaagtggtaaaataggtggtcgcgcgcccgaccgccgcagtcccagtcgagccgcgacccttccggctgcccccaccccacctcgccgccatgtgcctccgccgcccagcgctgttcccgggcgtggcgctgcttctcgccgcggcccgcctcgcggctgcctccgacgtgctaggactcagggacgacaacttggagagtcgcatctccgacacgggctctgcgggcctcatgctcgtcgagttcttcgccccctggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattattggtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactatttttgtaacttttgtggaggactgcaatcatttctaaataaatagtcttaaaaataactaaagtaataaaaataataaagtacatgaggaagtccagtgtcatgttgtatagtcagaagattcttcaaatgagagaatttgcacccagggaaatag

SEQ ID NO: 313 - DNA, 1137 bp, Homo sapiens
atgattaatatacataaaatacacccactaattaaaattataaattattcatttattgatctccccacaccatccaacatctctacatgatgaaattttggctcacttcttggtgcctgcttaattctccagaccatcacaggattatttctggccatacactacacaccggacaccttaactgctttctcttcagttgcccatatcaaccgagttgtaaactacggcagaatagtccactattttcacgctaacggtgcttcaatattcttcatctgcctcttcctgcacgttggccaaggtttatattatgggtcacttatgtccctagaaacctgaaatactggtattatcctcctactcaacaactatagcaacagcgtttataggctacatactcccatgaggccaaatatcattctgaggcgctacagtaattacaaatctattatcagccattccatatattggaacggatcttgttcaatgaatctgaggtgggttctcagttgataaagccactattgcatgacttttcaccttccattttatcctacccttcatcattatagccgtagcaattctccaccttttattcttgcatgaaacaggatccagtaacccttcaggaatttcatcagattccaacaaaatcaccttccacccttactatacaaccaaagatatcctaggtctaatatttctcctcctccttctaataactctagtattattttgacctgacttcccgagcaatccagacaattacactttagccaaccccctcagtatcctaccccacattaagccagaatgatattttttgtttgcatacacaatcttacgatccatccctaataaactagaaggtgtactggcccttctattctctattctattctagcagttattcttgtactacatacgttcaaacaacaaagcataatattctgcccattaagtcaatgcctgttctgaattttagtggcggacttgcttacagtcacatgaatcagatgatagccagttgaacatccttttgttaccatcggacagccagcatctattatgtaattctccattttccttgcccttataccactcactgccctaattgaaaataagctacttaaatga

SEQ ID NO: 314 - DNA, 3105 bp, Homo sapiens
cagacggttaccagggcggctttgggtgaggacattgaaaaaggtcagactccctgggagcagcgccctggactccattctcatcacagaccagtggttcccaattgaagtcagttttgctcctcagggcacacttaacaacatctggagacatttttaattgtcctgaccgagaggacaatgctactggcatctagtggacagaggccagggatactgctgaacatcccgcagtgcacaggacgcctgcaacacagattatccagccccaaacgtcaatagtgccggagttatggaaccctaatgaagacaattcttgaaggcatagactgaatcttatttatctttgtttccctcatgtctcacaagcagagtatgagttcagcaaataggagttgaacagaaatcaggaggaggtgctgattgacaggaaaaaagaaagatttagtttagagctgagaattcagctggacagccataggggctctggcatggagactggaagtcagaagagaatttgcagcaagacatttagagccatttatccagccatcataattttattgagtaactattttgtgtgaggcactgtactggatgctttggcaacagagataagcaaggcaacccctgtgaataaggcactcctggtctacacacagtgggagaaacatagaaattcatctcttctgagcggagcctgtgggaacccagaggatggacacccagcgtggtctgaggaatcatgggccaaaacaggaggcatcaggagagatctcttgggtaaagaagagtgagggctggaaggatattccaggcagtgggaacaacttacataaagtgagaatattgcaaatgcctagcgggtctgtagtgagagggtcatgaggcggaggagtgaggtgcgtagcaaggaatagcaggtggggccagagcagtaaaattaaccattgttctatttgaagaagggtaggacgcatttttaggttttttggctatttctccttttggtaatagcatctattttcttttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcaggtttttagtccaaattttttttcttcaactctaggtaattgctttacttgccagaataggttaccatagcaatattttctgagcaataggtgaactgaattgtactattgaggaagcccaggagaaaaatactaataacaacctgagaaagtctaatcactttatggagcctcagggctgtgaagagggggataagacggactccctgggtgattaggaagtgctgctgccagctcacacaggacgcaatgtgagaagccacccatggtccccaaattcccccatctcctgatatccaagtcccccatccaagctgcttaaatgacaaaagacaaatgtaaactggggaaacatttgaaatgcatatcaaaaaggggtatttcacaaagctctccaacaggaggcctaggaagatggtaacagcgataccagaataatgtttggatcttccagagtgcccatgtgaaaacagagcaaccaaactgaaaagccatggacaacaaaagtcggtgacaaagtgtcaccttgaatcctgaaatacaaatgagttcaactgtcaaatggctcaggaaacagcgaaatctccaatggaccgtacaggcaaacacaagaaacttgaaaaagaaaaacagagaaaacaagaaaatcctccatgacaagatcatctgggagctgaaaagcaatttggatgtagtgcttcataacacaaaacataagctcctttaaagcagtgcaagtcccattaagtctttgtgatatttttgcatttcttcacacatgatttaaaattcacctatttccaaaaagatgtacaatgaaaaaagaagacaataaacaataaaaatagagataatttataaaagtacaacaaaggaagggaaagatatatgcaattaataattaaatatgagccacagtgagatacaaggaacactgactgagatggctataatttaaaaagaaaagaaaaaatggaaaataacaaatgttgcaagaatgtgaagaaattgtaacccttatacactgctgggggagtgtaacatggcacagccacagtggaaaacagttcaccagttcatcaataagttaaacatagaattatcatatgacgcaacaattccactccaaaggaaatgaaaacagggactccaccagatacttgtatgtctatgtctttgcagccttatttacaataaccaaaagatgtaaacagcccaaatgtccatcaacagatgaatccagaaataaaatgaggtttatatattccaacggaagatgaaaagggatgaaattctgacacatgctacaagatggatgaaccttgaaaacactttgctaagtgaaaatagccagacacaagaagacaaatactatacaattttacttaaagtatctagaataggcaaaactaatagaaaaataaagttaattagaggttaccaggggttgggagaagggaaaatgaggagttatggcttcatggttagacagtttttgtttgaggtgataaaaaaaagtttgggaatagtagtggtggttgcatatgttgtgaaggtaattaatgctgctgaattgtacactttaaaatgtttaaaatgataaattttatgtttataaaatgtaatatgtatatatgtgtgtatatatatacatatatatatatgtaaa

SEQ ID NO: 315 - DNA, 14733 bp, Homo sapiens
agagctacagcggtctccgggtggcgaagtgcggagacggggttttggagacggtggatggaggagggggagggaaagctgccaactttggataccaaccccgtacacccaccgaaggggatgtcccactttttccagcgctgggagcaaaaagataacagtgagcgaggttgaaaaaaacagggtcttgcttcgttgcccagcctggtctcaaactcttggcttcaagcaatcctcctgcctcagcctcccaaagtgctgtgattataggcgtgagccaccgtgcccccccccttcttctgtgtttaggcttatatgctgttctctaatttctaccactgatgtttatttttattcatatttcttatttattactatatgtatttatataaattttcccctaagctctcccttaaccaatgtactatatagtgcttttatagttgtcatttttacagtctgattttcttagcattgatatcctttttttttttacatttttatttttatttcaacagttttgagggaacaggtgatgtttggttgcatggaaaagttctttagtggtgatctctgaggttttggtgcacccatcacctgagcagtgtatactgtatccaatgtgtatgtagtcttttatccctcactccctcgcccacccttccccgccgccagtccccaaagtccattatataattcttaggagtttgcatcctcatagcttagctcctgcttaatagtgagaacatgccatgttttgttttccattcctgagttgcttcacttagaatgatggtctccagctccatccaggttgctgcaaatgccattattttgttcctttttgtggttgagttagtagtattcccatatatattcccatatatatatatatatatatatatatatatatatatatatatatatatgtagtattcccatatgtatatatatgtatatacaccacattttctttatccactcgttggtcgatgggcatttaggctggttctgtattttggcaactgtgagctgtgctgctataaacgtgtgtgcaagtgtctttttcatataatgacttcttttcctttgagtagatacccagtagtgggattattggatcaaatggtagttctactattagttctttaaggaatctacatactgttttccatagtggttgtactggtttacattcccaccagcagtgtaaaagtgttcccctttcaccacatccatgccaacatctgtttttttttattttttaattatggccattcttgcaggagtaaggtggtatctcattgtggttttgattggcatttccctgataattaatgatgttgagcattttttcatttctttattggcaatttatatatatatatatatatatttgttgttgttgttttgttttggtttttgagacggagtcttgctctgttgcgcaggctggagtgcaatgactcgatcttggctgactgcaccctctgcctccctggttgaagcaattttcctgcctcagcctcctgagtagctgggactgcaggcgtgcaccaccacccccagctaatttttgtatttttagtagagatggggtttcaccatgttagccaggctagtcttgaactcctggcctcagacaatgctcgcctcggcctcccaaagtgctgggattataggcgtgagccactgtgtccggtgaatttgtatattttcttttaagaattgtctattcatgtcctttgcccactttttgatgggataatttatttttttcttgctgatttgtttgagttatttgtagattctggatattagccctttgttggatacgtagtttgtgaagatttttctcccactcaatggattgtctgtttactctgctgattatttcttttgctgtgcagaagctttttaatttaattaggtcccatctatttacctttgtttttgttgtatttgcttttggattattggtcatgaactctttgcctaagccagtgtgtacaagaatttttcctatgttatcgtctagaatttttagtttcaggtctcagatttaagtctttgatccattgtgagttgatttttgtatcaggcacagatggggatccagtttccttcttctacatgtggcttgcgaatcatcccagcaccatttgttgaatagggtgtcctttccccactttatgtttttgtatgctttgtcaaagatcagttggctgtaaatatttggctttatttctgggttctctattatgttgcactgatctacatgcctacttttataccagtaccatgctgttttggtaactatagccttgtggtatagtttgaattcagagggtgtgttgcctccagatttgttctttttgcttagtcttgctttggctatctggggtctttttttgtttcatatgaattttaggatttttttttcaagttctttgaagaatgatgatggtatttgaatgcaaattgcattgaatttatagattgcttttgtcagtattgtcattttcacaatattgattctgaagcagcatcattgtctggggtaatacccaaggcttgttgtctcacaccaagggaatcgaggatgtggacacacacatgaagtgaggtttaatagcacaagaaagagaaaggagaacagctccctctcttgaagggggggagggagagagagggagagagacagacagacagacagacatgggggcagctccctaatgggaattctagcccacgggggagtgcaccagattttatagacaggcttgaggaggcagtgtctgatttacatagggcccacagattggttggaccgggtgtgatgtttacatagtgtgcgaggaagctggctgccctaccctaatcttattatgcaaataggctttccacttggtcagtaccatgttgtctgctccctactgcacacacggttggaaaagaaaagggaagatggagccaccattttgaacatgcctagtcccaggtggccttttcctattggcacaactgctggcattcacccatgcaagcttccagcttgcttgtacatgtgtgcagctccattttacaggctgctctttgttagaaacaagatgatttgggggctgcttttcattaaaaggaaaaccttactgagaacttcctcaccctcactatctgcctaaataatttctctttaactcctatatcaaaattccggcccgggcgctgtggcatatgcctgtaatcccagcactttggaaggctgaggcgagcagatcacttgaggtcaggagttcaagactagcctggccaacatggcaaaaccctagctctactaaaaatacaaaaattagccaggtgtagtggcatgtgcctgtagtcccagctacttgagaggctgaggcaggaaaattgcttgaacccaggaagcagaggttgcagtgagctgagattgtgccattgcactccagcctgggtgacggagtaagacgcctcaaaaaattaattaattaattaaataaataaaataaaattcttcccatccatgagtgtgggatgtgtttccatttgtttgtgtcatctattatttctttcagcagtgttttgtagttttccttgtagagatctttcacctccttggttaggtgtatttctaagtattttattttattttttttgcagatgctgtaaaagaggttgagttcttgatttgattctcagcttggtcattgttgatgtaaagcagtgctactgatttgtgtacattgattgtgtatcctgtcagatctaggagctttttggatgagtctttagggttttctaggtatactgtcatatcatcagcgaacagcaacagtttgactttctctttactgatttaaatgccctttatttctttctcgtctgattgctctggctaggacttccagtactatgttgcatagaagcggtgaaagtgggcatccttatcttgttccactttgctgtgggaatgctttcaacttttccccattcagtgtaatgttggctgtgggtttgtcatagatggcttttattaccttgaggtatgtcccatctataatgattttgctgagggttctaatcataaatggaggctggattttgtcaggtgctttttctgcatctattgagataataatgatttttgtttttaatactgtttgtatgatgtatcacattttattgacttgcatatggtaaactatccctgcatccctgatatgaaacccaacttgattgtggtggattatctttctgatatgctgttggatttggttagctagtattttgttgaggatttttgcatctgtgttcaccagggatattggtctgtagttttctttttttgttatatcctttccaggttttggtataagggtgatactagcttcatagaatgattcagggaggattccctctttctctattttttggaatagtttcaataggattggtaccagctcttctttgaatgtctgatagaattcagctgtgaatccacatggtcctggactttttttccattggcaatttttaaattactgttttaatctcactacttgttactggtctgttcagaatttctgtttcttttttatttaatccaggagggctgtatatgcaggaatgtatccacctcttctagattttctagtttgtgtgtgtaaagatgttcatagtagccttgaatgatcttttgtatttctgtggtattagttgtaatacttcctgtttcatttctaattgaacttatgtggatcttctgtcttcttggttaatctcactaactgtctatctcttttgaaagaaccagctttttgtttcatttatcttttatatttatttgtttcaatcttatttaatttggctctgatctttgttatttcttttcttctgctgggtttgagtttggtttgttcttgtttctgtagttatttgaggtgtgaccttagatttctatttgtactctttcacactttttgatgtaggcattcaatgctatgaactttctcctcttagcacgacttttgctgtgtcccagagtttttgataagttgcatcactattatcattcaaataattttttaatttccatcttgatttcactgttgacccacagaccattcaggagcagattatttaatttccacgtatttgtatagttttaagggttccttttggagttaatttccaattttatttcactgtggtctgtgagggtactaatataatttcaattttcttaaatttattgaaacttgtcctgtggcctatcatatggtctctcttggacaatgttctatgtaccgatgaaaagaatatatattctgaagttgttggatagaatgttctgtaaatatctgttaaatcttatttgttctagggtatagtttaagtccattgtttctttgttgactttctgtcttcatgacctgtctagtgttatcagtggagtattgaagtcccccactattattgtgttgctgtctgtctcatttcttaggtctagtcgtaattgttttatgaatttgggagctccaatgttaggtgcatatatatttaggattatgatattttcctgttggactaatcattttatcattacataatgtccctctttgtcttctttttaactgttgttgctttaaaatcttgtttgtctgatatgagaatagctactcctgcttgtttttggtttccatttgcatggaatgtctttttccacccctttaccttaagtttatgtgattccttatgtgttggatgagtctcttgaagatagcagatacttggttggtgaatttttatccattctaccattctgtatcttttaagtggggcatttaggctatttacattcaacattagtactgagaggtgaggtactgtttattcatcatgctagatgaatagaatagggccaatggggttatgttccagaggggattatggctgtctctgttgccagggaagtgggagaaaaccagtagtgataggcctcacccagctcccacgcagttgacggggccagtctcatttctactgtggccctgctaacagcaccaactttatctccaggcaaccttcaggcaagagtcagacctagccccaggctgtaagtttccccactgagaaagcaaatatggctttcaagccatgcctcaccccacctgcccacactctccaccataactcctgctctcctatctgcagcagttttcgtttgcccctggattctgctcaagagagttcatgcccagtcaaaattattacagagttcatttagaagtttctttcaccctgtgacccctcccgaattctaccagctactttccctgagggcccctatgagatatagtcggggttgtcttccctgggcttgaactggagaatggcagtgcctacttggctcttcccactgctgcttctacttttatatttcacgctaaatctgtttcagctctaggtacggttaaatccctcttccataatctggatttttggattccccagtggggatgtgtgtccagatgcaggttttctacctctcacactttgggaactcacagtttttcaccagtcttgaagaattggcagcggcctgccacttctttcaaaggatctgtgatttcttttggtcttcctggttcacttctgcagtggttcctggagcaagtgtccatggtgtgagtcttcacacgctgttctgtccatccaagggggagctgcacatcagccctgtctcctatctgccatcttccttggtcttcctgatatcctttgtgacccaaaagtagtgtgagttagctatttaaaattaatagactaagtttagagcagttttgttaccagaaagtggtcccgatctagaccccaagagagggttcttggatctcttgcaagaaataattcaggatgagtccatagatagaagtgaaagcaagtttattaagaaagtagagaaataaaagaatgactactccatagacagatcagccgcaagggctgctggttgcccattttaatgtttatttcttgattatacactaaacaaggggtggattattcttgcctcccctttttacaccatatagggcaacttcctgacgttgccatgacatttataaactgtcatggtgctggtgggagtatagcagtgaggacaaccagaagtcactcttgtcaccatcttggtattggtgggttttagccggcttctttactgcaacccgttttatcagcaaggtctttatgatctgtatcttgtgctgacctcctatcttatcctgtgacttagaatccctaaccgtctgggaatgcagcccagtgggtctcagcctcgtttcacccagcctatatacaagatggaatctctttggtttaaacacttctgacagttttactgtataaaaaattgagcagatagtacagagagttcccatatactctctctttccccatttaaagattcctctattattgtcttgcagtagcttggtacttttactacaattgatgaaccagtagtgatacattattattaaatgaagtccatagtttacattaggatttacttttagtgttgtatagtttcgacaaatatataatgccatttatctgcccttacggtctaatacagaatagtttcactgtcctaaaaattccttgtgctccacctttttatctctccctctgtcctcacaaccactgatcttttttactgtttatatagtttgcctttttcagaatgtaatataattagaatcatacagtatggacccatttcagaccagcttttttccctaagtaatatgcatctgagtttcctccatgtattttcatggcttgatagctcatttgtttttattgctgaataaaactgtctagatataacatagtttatccatccaagcaagaccttgtctctaagaaaaagaaactgctctaaaaagtaaaacctattaatttttaaaaaggtaagaaccatcaggaatggtggctcatgtctgtaatcccagcactttggaggaccgaggcaagaggattgcttgagcccaggagtgcaagaccagccttggcaacatagcaagaccttttctctacaaataatataaataattagcctgatgtggtggtgtgcacctttggtcctggctacctaggaggctgaggctggagaatcacttgaatccagaaggcggaggttgcagtgagccaagatcatgccactgcactccagcctggctgacagaatgagaccccatctccaaaaaaaatacaaaaataaaaataaggcccaactatatgctatctacaggaaatgcactttaaatataaagacacaaatgagttaatgagttaaaaataaaatattggaaaaatgtataccatgccaacactaatcaaaagaaagctgagtgactacattaatatcaaaatagatttcagagcaaagaatattaccaaggataattaacattatgtcataatgatacaggggtcaattcatcaggaatttgtgacaagcctaaatctttatatatctaatagcagaacttcaaaaaacttgaagcaaaaactgataaaactgaagggagaattagaccaaaaaaagagttaagaataacgtgcatagcatgctattttttatgcaaaaatactaatgtatgcttgaatttataggctacctatgaaagcattatgtaagaaactgataatacttgttgcctccaggaaggggagtttgatggctagtgtacagagagagaagggaatctattcccatgtatgtatattacctattaaaaataaccatcctggccaacatggtgaaatctcgtctctactaaaagtacaaaaattagctgggtgtggtggcaggtgcctgtaatcccagctactcaggaggctgaggcaggagaatcgcttgaacctgggagacaaagattgcagtgagccgagatcacaccattgcactccagcctgggcgacacagcaagactctgtctcaaaaaaaaaaaaaaaaaaaatagaatgtttgccaggcacagtggcttatgcctgtaatcccagctctttgggaggccaagacaggagtatcacttgtatccaggagcttgagaccagcctgggcaacatagcaagaccccatctctacaaaaaataaaaaattagttgcccacagtggcatgtgcctgaagccccagctactcagtaggctaagatgggaggatcacatgaacctaaatcgaggctgcagtgagtcatgatcatgccactgcactcagtctgcgtaacagagtgagatcctatctcaaaaaataataataataataggccaggtgtggtggctcacacctgtaatctcaatgctttgggatgccaaggcagaaggattgcttgagctggacaacatggtgaaaccctcatctccacaaaaaatacaaaaattagccaggcttggtggtgcatacttgtggttccagctactcaggaggctgaggtgggaggattgcttgcacccaggaggtcaaggctgcagtgtgccaagaacataccactgcactccagcctgggtttcagagcaagaccctgtctccaaaagcataaataaaaatagaatttttttttttttgagacaaagtctcgctctgttgcccaggttggagtgcagtgacacgatctcagctcactgcaagctctgcctcctgggttcacaccattctcttgcctcagcctcccgaatagctgggattacaggcacccgccaccatgcccagctaattttttgtgtttttaatggagacgaggtttcaccgtgttagccaggatggtctcaatctcctgacctcgtgatccacccacctcggcctcccaaagtcctgggattacaggcgtgagccgccgtgcctggcaaaaaatagaatttttacagataaataagaaccgaggagtagagaaaagttgtataaataactctttcaaaaaacttttgttggcttcctttccaatttgggcctggcaggatggctcctgcaaagaagggtggcaaaaagaaaaagggcagttctgccatcaatgaggtggtgacccgagaatacaccatcagcattcacaaacacatccatggagtggacttcaagaagtgtgcccctcggccgagcgtggtggcttatgcctgtaatcccaacactttgggaggccaaggcaggcggatcacaaggtcaggatttcaagaccagcctggccaacatggtgaaaacccatctctactaaaaatacaaaaattagccgggcgtggtgctgggcgcctgtcatcccagctactcgggaggctgaagcaggagaatcgcttgaaccccggaggtggaggttgcagtgagctgagatagtgccactgcactccagcctaggtgacagaccaagactccatctcagaaaaaaagaagcatgcccctcaagcactcaaagagatccagaaatttgccgtgaaggagatgggaactccagatgtgcgcgttgataccaggctcaacaaagctgtctgggccaaaggaataagtataagtaatgtcccataccgtatccatgtgcagtttccaggaacgtaatgaagatgaagattcaccaaatgagctctatactttggttacctatgtacacattaccactttcaaaaatctacagtcagtatggatgagaactaactgctgatcatcaaacacatcaaataaagttataaaattgcaaaaaataccacaaacttttgttgcatagaacaaagaaatgtgatggttgttggaggagcctgtcaggtcaagaaatagtgtttttaagatgagggataacagaatgtgtagaattatgggaataaagtaatgaggagagtaaccatgatgatgaagagacagaggggacatctgagacagcaaagtatttaataggtagaggtggtacctggtgaccaaatagtgacctttgctaaaaggaacacctactctctggtaaccaggggaagaaagagtccatgggtacaaatgcagatgaggatatactatgtggaaaatgagggagttcctttctgatggcttctgtctcaacgaggtcattagcttgtcaaaaaatagatgaggtaaggccgggcacggtggctcacacctgtaatcccagcactttgggaggctgaggcgggcggatcacgaggtcagaagattgagaccatcctggctaacacatggtgaaaccctgtctctactaaaaatacaaaaaaattagccgggcttggtggccttccaccacatgatgatgcggaaagaaggccctcaccagatgttagtgccttgatcttggacttctgagctctgaaactgtgagccaataaatttctgtttgttataaatgaatcattcttagatattctgttatagcagcacaaacaaactaagacaacaacctacagaatgaaagtatttacaaattatatatctgattaggatctactccgtagaatatagaaagaactcttacaactcaacaacaaaaagacaaaccccccaattttaaaatgggcaaaggacttgaacagacattttccaaagagggtgtacaaatgaccaagaagcacatgaaaagatgttcagtatctttagtcattagggaaaggcaaatcaaaaccacaatgagcctgggtgaggtggctcatacctgtaattccagcacttagggaggctgaggcaggtggatcacttgaggtcaggagttcgagaacagcctggccaacatggtgaaaccctatctctactaaaaatacaaaaattagcggggtttgatggtgcatgcctgtattcccagctactcaggaggctgaggcaggagaatcacttcaacctgagaaatggaggttgcagtgagccgagatcacacctctgtactccagccttggcaacagagcgagcctctgtctcaaaaaaagaaaaacaaaacaaaacaaaaaaaccacagtgagataccacttcatatccattaggatggctagaattttttttatataacaagtgttagcaaggacatggagaaattgaaactcttgtacattgctggtgggaatgtaaaatggtgcagccactgtggaaagcagtgtgatggttcctcaaaaagttaagcatagaattaccatataaccccaagtcccactgctaggtatatactaaaatatttgaaaatgggtatttatttatttatttattaaatgaggcaggatcttgctctgttgcccaggctggggttcagtgttatgatcatagttcactgcagccttgaacttctgggctcaggccgtcctcccgcctaagcctcttgagtagctgggactacaggcacatgccactatgtcttgctaattttttaaattgtttagagtgggtgtttgtgtggcgggggtctcactatgttgctcaagcttgtctctaactcctaatctcaagcagtcctcctgacatggacttccaaagtgctgggattacaggtttgagccactgtgccggcctgaaaataggtatttaaacaaatacttatatgtgcatgttcatagcagcactatttacaatggccaaaaatgtacaaacaactcaaatatccatcagcaaataaatgcataaaccaaatatggcatatacatacctacttccccccaatggctcctcctatccctcagtagatttgatgttctctcatttgtgacttcagagtatattccacagcttaagctttagtacccaacttgtttgtggccagaagaggtcagtgtccctcttctaacctctgagctgcttcccatgtagtgattgtatctcgttcattaatacatccctagtacatggcacatactaaacactaaaaatacttattgaacaaattaatttattttgtcctatttcagatcccatatagaattatatattgcacatcatttatatgtcaaatgcttatattgtacttttctgtttttgttctttcatttttgcctctcttgctcatcagattataaagtatcccaggacagtgctctgtaaccagcccatagtagctactgctattttaccagctactgtatctttccttctttgatttccagcacctgacagtgaaaagagcaatttgaagaaaaacaaaatttatcttcaatgtgaaaagcaatttataaaaatccgaatacttgccaggagcaacttgacaaaaaagacaaaggtggtagaagaaatgtaaccagcccacaattccaatgttgataacagatgagctccctttcaaggtgactgacatttacacaagtacacagagcaagaagaaggtctgagtgaactgccaagcattttaacttctcctgagaccaagtacatcaacagttctcttggaaaagaacaactgatttgggagtctagcagactgccagctgcaagacattcatccagcatcaggaacacaatgggccttcatttgcctgcctttctgagggcaccaatcaaaagtaacagctgccacctttttctatgagacttgattataattttctatggccaagggtttgctgtgacacttccacatcattcttcagtatgtagtccagagattagctacagattcaagaaacacagactgtaaactattatatacagacatatctcaaaataagcatacccattagtgccagctgccctgaaagactgaatgaccccagctattttccaaatgttttttcagaaagccatgaacacacctttctgggatcctatctatttcaaagacaggcaaagctctgtggttcagttccaccacccagtaccaagcccacagtatgcagaccatacgccttacacatggccttttctctttatgtaattgctgtaccatattcagcagatctagactgactcaaagcatgttccctcaagaagctccacagaaaaaaaggtttctgtgatcaaaaatcatttgggaaatgctgcaaaccctatctgcctcttagagcttaaccatgcatgtcggggcataatataaaccttttccagtctgggccacagagtgagaccccacctctaaaataataaatcaataaactcttgagaagtacacagaaaagaaacttctgtaactttttaggtcttaattacaagcaattgtagcttaatctaaacttgctcttcactttatttctatgctcttgaaaactagtgacataagccttatgaattttttgtttgtttgtttcttctttttttaagagagagacagggtctcattctgttgctcaggttggagtgcagaggcacaatcatagctcaccgtaaccttgaattcctagtctcaagtaatcctcccatctcagcctccctaataactaggactacaggcacataccaccacatctggctagtgtgtgtgtgtgtgtgtgtgtgtgtgtgtacaggggtctcattatgttccccaggctggtcttgaactcctgggcttaagcgatcctcccaccgcagcctcccaaaactttgggattacaggcatgagccactacacctggctggattattctttctttaaaaaaatttttttggccgggcgccgtgactgtaatcccggcactttgaggggccgaggcgggcgaatcacgaggtcaggagatagagaccatcctggctaacacggtgaaaccccgtctct

SEQ ID NO: 316 - DNA, 1984 bp, Homo sapiens
gcctcgagacacaacaacaagttgtttgtcccacatcatgctggggtggctgggaggggatagggtgagacagggagcagccactccactgaagaccaggccatgcagaggggatgagaagggcagcgttacctcccgagaggctactccaaggagagcggctcggggtcactgtttcccccttttcaggctggcccgcttcactatctgcgcccccttcctgccctctatcaggtccggctgtaggccactccctctcagctccacctgcagacagcagcagagacagaaagcaggacagatcgcaaagacgggcagaacacaggcagaagatcgaaaggaggccacacggaggtggcagacacactgcccaccagggagaagagagactggagagagagctcataaagagcactttgcagtatagaaaagcccttcgacaggcagcatcacccagaatgtgacttgcttgaaaccccagagccagttggtgacagaaacaggacgatccgggtgcaatcccatggtggctcacgcctgctatcccagcactttgggaggccaaggccggaggaccacttgagcccaggagttcaagaccaatttgggcaacatagcgagcccccatctctacaaaaatttttttaaaatagccaggcatggtggtgtgtgcctgtagtaccagctactcagaaggctgaggcaggaggatcacttgagcccaggaatttacagtaagcccaggttacagtgagccatgagcatgccactgcactccagcctggactaaacagcaagacttcatctctaaaaacaaaagaaaaaagagaagagaagagagagaaagaagaaagaaacaaagaaagaaacaggatgagcgcagcctcccgagacccaaagctgagtgtttaatgtcactgtcacaatgcactgggcaccagagggcaggttctggtgggcgcacacacactctggctcccagggtggaacatgatccctgggggcctcctggtccttttcctccggcgtctcccaactctgggtccggagctccccacagcagcgtcccctcagccccggcctccggcgcccacaccaccagccctgccggcctcctgccaggcggttaccttcaggaagacccgccgccggaccaccctggtggagatggtctcctcgtcgtcactgaggccctcgctctcccccagctccttgtccagctcctggtggatgtgctttagcacaaagcacagggaccccctgacaatgtgcatcacgttctgacagctgaccaggaagaagctcagcagcaccagcgtgaccaacagctgggtgacgaaagtccacatcctcgcctcctcaccagcccggtcctctggcagccagggccccggccaccacggggggcctgcctctcattctccactgggactcctgagtcccccagggaccccttgcattccccctccctatctctctggtttgctctcttggtctctcactgtttctctctctgtgggcaggacaccgaatggccctctcggctgaagcagcccggcccaagtgcccttctgcccagcagccaggctctgccctgagtggcccgggtgacatcacgctcctataattttacctccccaaaccagctgccggagctgtccaaccgggctagaaggaagccggcaggtgcccatgtcctgagcactgaaagcacaagtgaaagtcactgtgtgagtgacacccgctgctgcctaaccccgccctgcccagagacctggaagtgggggctcggcctctcacctatcctgcccatccccatgggaactagaaagagttctgcccagggaaagtttcttactttcagaaaataatacagtccgagaaagcagctacttgtgtgtctccttgggctgctactgcggtgatccaaatgctgttccccggcatggtagggatgagaccagctaataccctgggtacttag

SEQ ID NO: 317 - DNA, 3931 bp, Homo sapiens
atgtcaaactgatgagcatccatcgtatttgtagacacccctcaaaggagagttgtacagcctattccactgacatcctgaccaaggcatctccatcatgcctaggtggagttggcctttttccttacattctgtcttcactggagaccaggcaggtgaaatcagctgggtgtgaagtggccttcagccatgtcctctcctggggaatccatccccctccttccactctttccttgtaattggaattggaccacctggtgcccacggctctctggggtgaagctccctcttggtgtgtcctgttcttcagtgacatttatttttgctttcctcatgtcccctcttgcagtgctcatcctgttgttacagtagctatttgtagcctatgcaccagcctgtgtgttcttggggccaaggactgtgtcctatgctccttcctgtcccctgtattgcatattgtaccatgaacctagtagtgagtgtcccatgcatgtttgctgaatgagggagtgaatgtctgacagacgtttcatggcttgcatccagcctgcccctaaatgtttccctaatttctaatgctgacactagacaccccactgaaggactagggtgtctaactattccatgctaagtatgggcaaaagaggacagtttgaccaagatgctcttttacccttgtgtatccaagttccctctgatcattaaatgagcagagacttcacacagaaggtgttgctactgctgcagatggaggtcagaattaaggtactgctactgttgatctcagacctttgaaagccagacccaagcttggggtcttggggatggggatgctaggggatgggatggccagatacaccagagtggctgggaatgaaagagtgtcccggaaaacctgcttcctcggagccgatcctgtgtgagcagaagaaatctatccacagaggggtgagatcgcagagcaagtgggttacctaaaaatagcagtgctggtttcccacagttagagatgggtcctctgccattcatctcaattgctttgtgcaagtttgcttatttattgagagcgagagaaaaggatcaaaccattcatccaaagatggaaatctgcaacctcttctacaatgatcagccagacagatgagctgagtgagaagtccctgaaatctcagaggcctagggctggccaggagagtgggatgggcatgcttaggagagtggggtgggcatggttaggagctgcccccagcttgccctgccttcgtagcagagttgatggtgggctgaaccttacccccaacatggggacttttgcaggggaggcagacctgtgtgtacatgtgagggtacatagacatacatgaacgtctagctctctgagggaagagatgagatgcataaatcacctaacccagcacaaagtacacacaataggtgcttagtaaatgttaattagggagtcaagtaggtagaagttgaggtcagggcaggaggaggcagggatagaggaacataatgtgaagtagccagagtatttttgacaaaaaggtgtggattttggagtcaggaaagcctaggttcaaatcccagttccaccacttgttaacatggtaacctcaggccagttacttaacctctcagagtatcagagtcttcacctatacattttgagaatggcatgacatctcatggtgttactaggattattaagtaaaataatatatttagagtacctgtaccagcccggggttcgataaattacagctgtttttctttttattatcatttattgtgaatatcatggacaatgaggttcctcagtttattaacagttagaatcttactttaaaaaaagaacccaaattaggctgggcatggtggctcatgcctgtaatcccagcagtttgggaggccaaggcgggtggattgcttgaggccaggagttcgagaccagcctgggcaacatagcaagatcccatctctaaaaaaaaaaaacaaaagaacccaagttggaaatacttgcaagtcatgtatctaatctgataaggggttaatatccagaatatatagagaactcataaaactcaacaataacaaaacaagccattcaattaaaaaatgggcaaaagacttgaataggcatttctccaaaggagatataaatggccaataaacacatgaaaaggtgttcaacaacactaatcattagggaaatgcaaatcaaaactacaatgagataccacctcatacctatcggtattaggatggctactatcactgtcaatggggatgtaaatgatacagtcactctggaaaacagtatggcaattcctcaaaaaattaaaaatataattaccatatgatccacaattctacttctgggtatgtacccaaaataattgaaagcagggtctcaaagagatctttgtacacccatgttcattcttcacaatagccaaaatggggaagcaactcacccattgtccattgtacattgatagatgaatggatatgcaaaatatagtgtatacatatatatacatatacacacacacaatggaatattattcagcctttaaaaatgaaattctaacatacattacaatatggataaacctcaaggatgttatttttggtgaaataagcaagtcacaaaaagacaaatattgtatgattccatttatatgaagtacttagagtagtcaaactcattgagcagaaaagagaatgatgatccagggaatgtggggagaggaaaatggggcgtttttgtttagtgagtacagagtttcagttttgcaaaatgaaaagcattatgaagatggatggtggtgatgtttgtacaatattgtgaatgtacttaataccactgatgtgtaatttaaaaaggattaagatggtaaactttgcatgcattttatcacaacaaaaaaaattggaaaagcactaaaatcaaagataccaattttcccccaatcgatccatagatttaatgcaatcccaatgaaaacatcagtaggcttttaaaaaactgaaattgacaaatgtattctaaaatttatattgaaatgcaaagacctcataatagccaaaacaattttgaaaaaatgcaaagttggaagatttatactaccagacttcaagagatactataaagctacagcaataaagtattggcataaggataggcatattaatgaatggaacagaatggagagtttaaatgtagatccatagacatgtatggtcaattgattttcgaccaagctactgaggttttccacgaggaaaggttagtcttttcaacaaatgatgctgaaaaagttggatatccatttggaagaaaccccaaaaacccaaaaaaacaaaaagccttaattcttcttacttatcacaacacacagaattcaactcaaaatggatcataggccttgggacaagtaatattatgtgtcaacttgactgggtcacaggtgcccatacatttggtgaaacatcattctgggtgtttctgtgagggtgtttttggatggaattaacatttaacttggtaggctggataaagctgagtgctctccctaatgtgggtgggcctcgtctaatcagttgaaggcctgactagaacgaaaaggctgacattcctttgagtaagagaggattcctcctgcctgatggcatttgagctgggctgtcaactttttcctgcccttggacttgaactaaaacactggctcttcctgagtcttgagcctgccagctttgcactggaactataccatcagctttcctgattctcaggcctttagagttgtccagaactatactgtcagctctcccggctctccagcttgccgactcactctgcagatcttgtgacttgtcagcctccatcatcatgtgagccaattcattataataaatatcttttcat

SEQ ID NO: 318 - DNA, 3616 bp, Homo sapiens
agtagtaggcgcatgcgtggttgcgatcatggctggcggtaacttcgcgtttctgttacccatttttaaaacgcatcttcaggtgttccttccttctcatggaaggaacattaattaaattcagagggactgggttttagtcctaactcttattcctactggctgtgtaaccgtggacaaattatttaacttctcagaatcaggttgttcaaacctgaggttgaactgcaaaaaggttacgaagtgacactcagtagggcccgaatccatgttttctttgatcccaatcttttttaaaaaaatttcttttaattacttgccaacattttagaatttggaaatctcacatgaaattctggacttttgaagctgaggaattccattgcaacaatcaaggagactaaataggaaatgacacttctgtttggccatcttgccctcattggtttagaatggcagtggttctcaaccctggctgcacattagaatcactttaggagaggtaaaaccatactcacgctggagacctactcctagaaattctaaagagtttggggctgggaactggccattgatctgcctttgaagtttcccaagtgattcccaacctctgatgtaataaatttctggctgctgtcgtatttgagatttgacccccccaggtctaagacttaattgatttttaaggctgtaagacatttctaagactttgacttttaagactttcctgcctcattctgaagagaaaaggccacatgaggacaccatgagaaggcagctgtctacaagccaggaagagagtcctcaccagaaaccagctctgctggcaccttgaacttggacttcacgcctccagaacagtgagaaaataaatttctgctgtttcagccgcccagcctgtggtattctgttatggcagcccaagctgactaatacactacctaatagtgaatgagaagaattaaatcagaaaatataaatgcattaataaacataccatgtattgggcacctccctgtgccaggcacttcaccatcatctctagtcctccaaaacacatgctgtttgcaccacatcatgctgccaggcacatagttggcttgttgatttgtgtgtgtgtgtgtgacaagatctcattctgtcgcccaggctgaagtgcattggcatgatcatactcattgaaacctccaactcctgggctcaacagatcctccttcctcagcctcttgagcagctatgacaatgggcatgcaccaccacatctggctaattttttttaaatgtttttgtagagacagggtctcactgtgttacccaggctagtctcaaactcctgaccttaagcaatcccccgacctcagcctcccaaagtgctgggattataggagtgagccaccacacccggccggcttgttgaatttgggatatgaatatcatagtcttattaacaccatgtttataagccataattgtctttatgaatgtattcattttggaaaagtaagtactaaggatgttcagctttctgtgctatggattattatgtgtggagaaacaagaaaatgagtcacagtcctcacttaaatattttaccatctagttagagatgaagacaagtatattaatgttactggcccatatgactatctttggaaaaacaatcatataaagtcaagattcagcacagggacccagggtccaaaagatttgcatttgactcccagctctataacttagccgtgtgatcacagtcaaattgcttaacctctcccttttctcatctgcaaaacagggaaataatagcacccacctccatcatttattatacacaaagagataatatgcctgaaatatatctagctaaataaagacctaatcaaatgtaagctgtgactattaccgtttgttgtttgcttcctgctttttactattgcaatttctaagatcagcctttttcaaaagatttttctttcatcttaaggctacctgggaactgactgtacctactacatacaccgtaacatgtatgtactatatacagccataatggggcaaggaaagaaaatggaatgtgtaatataagaataatggcatatagtcctcaaagactgtgttttatattttgtctccattagatattaacacagtgctatgtaatggaggaaacccaagaaatattttttgccttgaagaaaagaacacaaactcagaagtcacatggatctaagataagacttgcaaagatttaaattcaattctgccatttacttcatatgaggaccttgagaaccagttgatagcatatcagaaaagctaattaatttgccatggttaccaggaaaacagggcctagtctccaaagtacagccaaatagaggagccaaataaaaaagagggaaatttttgtcatgcatcttgtttttctgaaatgttatgttttaaaatatatcaatattcaaaacaccatgtgctttattgagttttaactcttaattttgtcctcttttttctgctagggtgtttttgagcagacaaacaatttcttattgccaggatacagcctggaactcttaagcacaccaggcaagcatatgtatgaaataaaatttctacaaagaagagattcgtcaaaaagcatcactgggacaccaaccaagtgtaaggctctgtgaggaaaagggaatttcagaaaactgtcatacccagccactgccagtgaggatatggtaatcttctttggggacagagtgcacattcccctgataagtctagaaagcataggattagggcccagtgtcgggcagacaatacatattacaggaatttaggagagaggcaagtcacaaaaggctgaagagttcagggaaaacctcacagaggtgagccagggatgatttctgatggctggagaagaggaaaagaagaaatgtcacaaagtgcaccattatcagaaaaaagacagagagtcaaacactttaggtggaacagaaagctccagtcaggaaataatgagatcgaattataaaaagaaccaaaatgtcaagctaagaaatttggaactgatccagagagtagctggaaagctgctgaatattttaaagggaaaaaaattacaaagtgaaagcagttttggatttgattttttcagttttctttattttgctgaaaggaaataagttcacatagtctaaattgaaaaagtacaataaatagtgaaaggtctccctcccacttcggtcccctgctgcctatttttctccctggaggcaaaccaatgttagcagcttcttatatattcttccagagataactatgcccatggaaataaagacgcacataaatttttccctcctcctttgtaaatgagatgcgtagacacttatttaccttgcatttttcactccaaaatctaacttacagattattttgcatgaatacataaaaaaggtcctcgttcacttttttaaattatgctatgaaaattcaacattcactcttttttaaatagatgcattggtacaaaagaatatacaggcgaaattgtctctaactcttctgcaacttgctgcgctgttctccctggaggcggtgtctagtttcttatatatccctccag

SEQ ID NO: 319 - DNA, 1111 bp, Homo sapiens
tttgttactctttcttattctaattgtgtattcttatttactgacgtgtctccagctttcaaggcagagtctcacccattaggtcttctatatacaattaaatttacctagaaagtatttccttcttatttaaaactttttaaaagtaaattcatgtatacatatgtaaccaacctgcatgtcgtgcacatgtaccctaaaacttaaagtataataataataaaatttttaaaaaagaaagataacaaccaaaaaacaacaaaaaagtaaattccaaaatttctatatcacattacaaattcacatgccacccacgaagaatacatttgcaaaataaatgatgtcttgagacgaaatgagttttcaatgaagattttagagactctttatttttatttttattttttagacagagtctcactctgtcaccctggctgtagtgcagtggcgtgatctcggctcaccacaacctctgccttttatttattttttatgtatgtatttatttatttttttgagacaaagtctcactctgttgcccaggctggagtgcagtggcatgatctcggctcactgcaacctctgcctcccaggttcaagctagtctcctgcctcagcctcctgagtagctgggactacaggcgcccaccaccacgcctggctaatttttgtatttttagtagagacgggtttcaccacattggtcaggctggtcttgaacttctgacctctggtgatgtgcccgcctcagcctcccaaaatgctgggatgacaggtgtgagtcaccgcacctggcctctttgcttttcttaagtgactccatgggggacccatgcagccagcagcatctcggctttttctccctggaaggtgtctgcaggaaaccagcatcccagttaacttcagacgcgagagtgttgattatacactcaaggccccacattagggaagtttgtgagtcacagccccacactgggtctcccagggatcaacaagatccacaaaccagcatggttaggacaagtggttttacagtccttttttttttttttttttgtgagatggagtcttgctctgtcgcccaggctggagtgcagtggcgcgatctcgg

SEQ ID NO: 320 - DNA, 2309 bp, Homo sapiens
ataaaataaaataaaataaaaaagaatatgaagagggggccaggcacagtggctcacgcctgtaatcccaacactttgggagcccaagtgggcagataacgagatcaggggttcaagaccagcctgaccaacatggtgaaaccctgtctctactaaaaatacaaaaattagccgggagtggtggcacgtgcctattgtcccagctactcaggaggctgaggcaagagaatcgcttgaaccctggaggcggaggttgcagtgagctgagattgcgccactgcactccagcctgggtgacagagcaagactccacctcaaaaaaaaaaaaaaaaaaaaatatgaagagggtggaagatttcgtatgttaacactctggaaagtcatcactcccagattctttccatggaggctctctcgaaagcagaatgacccccattctagaagcagaaggtgaatatggcaaaggcctgtggaggagctagtgtgaaaggaactgacatgaggacagctaccaactggagtgagaaagtcaggtctcagctacaagagcactagctgggcaagcgagaccggtagggccttcatcagaaatgccacctattttgacattttgagtccaaaaatgttcctatgtactacactgaagtgtgtccctgaaggtggccccagaaatggcccagatgaagtcctgggaaggccgtggaggtcatcctcttttgtttccttcttcaacttggtccaattaccttgctctccattgaatttcaaattagaccttgtgtcttcacacctcaagcctttaccctaagccttctctttgcctggaatgacctctttcctctcacatcattcaatttccatcccacctttgaaataaagcctacctttcttgctattgtgattactttagcttgcagtgacttctcctggctctaatatctgaatcttgtattcaataatcattctttagtaggttttccttagaaagcccactggacaaaagtcagattcatattaaactacagactaaagagcaggaagagcccctagagatcccctagccctactatttctgtttaggtgagcaggcaaaaatgtagaaggaagtagtgatttccttaaagttacaagagagtcaaaagcagagaatgcataaatccatgtctactgactctcaatctggaatgtcttccatgcatttttttaaatttcttttatgcctaagtagtttaacttgagatgaaaatgcaataagaatcacatttccacagaagtgataagaaattgatcagggctcctttctgatgtttcagcatgctatgagtctcacggaaggtccctgtttttgcacctcagggtgaatcatggatttctgaatgggcaggaggaaactgaggctaagtgaggctacctctggaatcactggaagtcctcccaggagggaagagaaagagacctatgacatcaaccttgagctttccttctttgttccttttatggccttcctcactttatgtgagttctgggatatgaaagtgctcaggggtagggaaagctgtaaatccccagggccttgcactataaacttcatttcctccctttattgcagttaactgcccatgaactctattaatattttgcaaattgagatccctaaaacacatgttactgttaattttaacctcatgctaactaggatgtggtcaaattttcacaacaaattccaaggatattttgatatgccttggaaaaatgcatttaaaggtgcctcgggggtatatactttttctaagtctacacattttctttcaattcttgctgtttaggaacaggcagaagtaaactgtcttatgtgaggaggagcaataatacaaagtgattcagttatgatacgggagtgacagaagcctctaacagaccaagagggacagtcaaggaacatcaactttctgaacttaccatagtaaaaatctgatgtcaacaaaactgttacacacttttgcgtacaggatcaatttacttagaaacacttcaccgttctataaacacaattcttcccttaggcaaaagccatgggttttataaatttaatgagacaaaaatgaatttttcccacctccaggataccaaatacattatcacagaatagtatcacaagtgtgacctctaaatctgatgagccagaagtaagaaactccttccttccttctttacttccttcctccctccctcctttccttccttcctcccctccttccttcctccctccctgtctccctccctccctcctttcctttcgttccttcctt

SEQ ID NO: 321 - DNA, 2426 bp, Homo sapiens
atgcctttggagatggggcccaaaatgagcaaatttgcctttaggtatcagagaagttccatatcagataatgattctggctgtgcactggaggagtactccgaggtcccctgggccttagaccagagcaaatctagctctcttttgcttgcttatcagaggaaaatgtccttatattaacatccctggaaagaaacatctgattaaagggcttgtataccagttgctacaacatgataatgacatatagtattgtcagtctttgaaagaagatgagaataaagaattccaagtgttcagtgcttagcagcagaaagaagcacttggaagaggcatgattaaacttttgtctagagcaggaatgcacgctatgtgtgagcaatgtgggttgaagatcaactgaggtaaaattgcagtgtttgcctctcgagtgggccctggagtgtactggtactcattctgttttgtctgtttcacgtgtaaagagctgctggtcaacctcgtctatttttatcaggatgaaaaaattcactgtggcaggcaccatgctgaattgctcaaaccctgatgctcagcatgtgctgagataattttgttgatgtttgcacagaaactgagagtcaccattggcacatgaaacacttctgctgccttgagcgcaaaatggtccccagaggacaaggtatgttatgaaggatagccacccattctgctgtggtggttttgagcctgtctatgcagagtgctgtgaaatctgtgggaacatattagtgtcgaccatgtgcagatgacctatgatgggaagttctggcgtgctgcagaagcatgcttttctcgtgtctagcataaatcctttttgttggatgtctcttctttaccaaagtcagatttattactcaaaaatatgccacctcgggccaggcaatacatccatgcttctaattcttccaattatccatttcagtgagcttgatcaagaaacaccagaaaaagtatctgaatgagcaaaagcagttggtcagcagatcagtgtagacagtctctcctcttgttccctgctctgaactacaagttttctggccttttgggcgatgctgatgacactctttctcagaaattgtatattctgagtctctccaggcaaggaacatttttatcaatgcggaattttggaaagacagagtacagcattaaaccccagaagaccctgaaggactgggtgggcatgaagattatatgacatagctcctcctcaaatttggtgataaaagcctcttcagcagcagcccaatgagatggatatttgagccaatcagcactggatatctgatagcataaaataagaactagctaaagcaaaacaaccagaaccttgcaaataaaaattactgacctgatatggactgggcacaagatgaacagtgtttctgctcatggcaaccacacaggccctgtaagcagtagaaggctctagaaattgaatctggaccatggggcttcagggtaggctaatgatcaaacacaggggtatgaaaatcccctggggtttttgtcagacttgaaaccagagaaacgtgctcaggattctatggattctttggctttgtccaacatcacagtagcttcagcggatggatgaagcaagctgaggtcatccttatattctctgcaaactctgaaaaaaacggaggcagaagattatgagaaaatcagcagtatggaaactttgaactctgctgcatggaagtgcagaggccttaaagagtctaagttcagatttttgtctagaaaaaaaacatcatgcctcatgaaaaactagtacatctgccagtactcagacaatccaagtctcaatctagaccacagaaggtcagaggatgtcactgacaatggaaactgcaacatcaagatcaggcagcgtccaatgagtgacaagacctgggtgtaccattttgaagagaagggatccagatctcatcaccatttccacagaagtagaaagccccactctgacaatatcctgaatattgttatagaaagagaatattctcccaaggacaggctgcagctttacatccccaataactacagtaatttatgtggaataaaagggctcaggacatccaagcgtacatccagaatgccgatctctatagagagcatgcccgttcacttccctccattcctatgtccccgggagtgaagaagtttctgggattcctggtgtttctccttctcgtcctcctcttccgactcagaacaaaaggattattttcttgaacaatcaatccctcagccccacgccacagagatacgcctactatacagatgacctttctagtccaactccctgcccgtcagtttggttagaggaccactaaattcaagaagaaaagtggacacacatgcaaaaactattatttctt

SEQ ID NO: 322 - DNA, 2572 bp, Homo sapiens
gatttatagtcctttgggtatatacccagtaatgggatggctgggtcaaatggtatttccagttctagatccctgaggaatcgccacactgacttccacaatggttgaactagtttgcagtcccaccaacagtgtaaaagtgttcctatttctccacaccctctccagcacctgttgtttcctgactttttaatgattgccattctaactggtgtgagatggtatctcattgtggttttgatttgcatttctctgatggccagtgatgatgagccttttttcatgtgttttttggctgcataaatgtcttcttttgagaagtgtctgttcatgttcttcgcccactttttgatggggtttttttcttgtaaatttgtttgagttcattgtagattctggatattagccctttgtcagatgagtaggttgcaaaaattttctcccattctgtaggttgcctgttcactctgatggcggtttcttttgctgtgcagaagctctttagtttaattagatcccattggtcaattttgtcttctgttgccattgcttttggcgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttgtagatatgaggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggccagggcaattaggcaggagaaggaaataaagggtattcaattaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatatacaaaaatcacaagcattctgaaaagttttttcttattttggatgccttgttaaaaggcaagtaccccagcaggtgtcagtggagactgtgaccgctgaatagcaatggtgatggggtgaggctggatctggccagaagagggctgaggggcatggagaagactcggggagcacagggaagatgtgggaggtggggaggatgggagggaggacagggagaggacaggaaggactggctctgctcattctccttcgcacttctgtggagcagctgctctgggcccagataatgatctctcgagggcaggacttgtggttttatttgcgtcatgagcctttaggaagtttggggtcgtgcatgtagagctgaacgtggggacaccgagaacgtgcaccctgcatcccgactgctgagttcacttctctgcaaagcacaaatcgctgtcccatcctgggtcacactcctgggagccaaacctgggtgggattctgtctctaccccacatcagctgtaagatttggggcagggcgcagaaccccctgagcacgtgggaaactgatcaccacgtgggggatgtttgttagagagattcagtgggtgatgtgggggcagaaggaggcccctagagcagagtatggcatctgttctgaatgccgatatggcgttggggggacagcaccctggcggcctgcagcaccctctgtgaacagggaaggctggaaggaaggggtgggtccccctgacaggtaggggctgctggatggtcccactttgcccgcccggtctcttcctacactatggttctcactgatgttccctgggcagacaactcaggatgagcctctgtgagtgctggacttgtgttccatccagctcctccccaagagaggggcaggggctggtgccccaaagcaccagcaccccacatggactggcacattttgaaagatataacacaaagaacttccattataatcgctgcccaggcgaccattctcaacgcgtacattatttgttaaagtaatttttaaagcctcaaagtcatgagtcc

SEQ ID NO: 323 - DNA, 2740 bp, Homo sapiens
atagtacttggatgttttagaaggttttccaagtattacataattcctagatgttcacccttattacactccaactattaaaaaggtcaaaattcagcctattttttttcattattttagattcctgtggttgggatattttaacattgatgagaaaaataattgaggttgatatttttacaaaatcatgcggtaataagtcttgatttcatgattcaaaagaatcaataaagcctaaaaataatagattactttaagctgctatgtaagatatatatggaataaattaaaaacctttgtgaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctcaaaaaaaaaaaggaggggggctaaatatccagtgagatgcactgaggaaaggaagcattttgctgaagacagcagcagcaacaaacaatggtctgtttgttgcaaacaagatgtagcttgatttctggtctgacatatgccatatacagatattagaaacgactgtttgaaggccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgtttttgaatgtggagctgctgaactcattcagaagccatttgctgcctatcaggactttctgaagaagttcttttgcctctgcctaccctctggcaccctcccatggaggcacaggggacccagagctaaagcattaccaggccatctccaaaacaccccgtgtgtgtgtgtgtgtgtgtgtgtgtgtgtgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaacgcaggctcccaaatattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctc

SEQ ID NO: 324 - DNA, 12261 bp, Homo sapiens
acaggcatttttttcttgtcattattccccacataataccatggaaaacttattatccagtatttacattgtattaggtattataaataatctagagacaatttaaaatacacaggaggatgtaactaggctatgtgcaaatactatgccattttatataagggacttgagcatccatagagtttgctatttgcaggggtttcttgatatcagtccaccatggataccaagggatggctgtacttttgttttaaaacattccatgctatccactgtattctgtattttctaaagaaaagctctaattctcagaacaacagaacaactctcaaaagaggttctcttaccctgtgttaccaacttggaagtttagttttaggatttttttttaaattattagccaaaaggccaataagacaaaaatgtgtgtgatccaagatatttatataattcaaagcctgtacttgatccaacaaaccctattgacagtatcattctgcttcattcagtctctgacagtaactgttgcttgaaactgatgtgatgaaatggaggaatagggtaaggatgtcttatcgcatgttctgaatcatctcaaaatttattcacaaatatgctataataaaaactctgatataaaacttgactaaaactttttatttttatatatgtgctatcctataccaatgaccctccctctcagtatacacatacacatatcactaacaccgataaatgaaaacataacagatatcaaaaatttactgaatgttactatagggttagaccttagcttctttatgtatggaaaagcagattcttgtctgtaaatgaaaaaaatccaacgttaattaatatcataaccccaaaatttctgcctgccataaaaagatagttaagtaaacatatctgttcaaaagttatggtaggacttaccaagtcacaatatttggttttcctctcctttcaggtatctggagaattacttttctctgttcctttgagtgtaagagtaaaagtatgggcatatgactaatcctggtccctaaaatctgggtagaagttgtatgtggcatttttcaggaaatacttttagttaccagtaccagtttagttcaattctccatttttttcttctgcctctgcaaaccctaaagcctcatagtaggatggtaatatcacaagatggcgactactctcttcctttagaagtctgagcatctataatgagcagagttcttctggtgacatgtggaatgagccagaaatacgagttcatatatgaaatttttatgtgcaatatgtaatataatttcaaagagatatatagcttgcaacagtccagtgtgggctgtgaacatatacctttggtactgtatatttatactcctctgcctgagtaatcctgcattacaacaaaatggttatagctttatactgtccaattctgctcctcattcaaccacgttcaagtctacagaatacactaaaaaaatctctaggggatttttctgttcaaacaatatttttactcctaaatggaaccagatggaataagatgtctcgaatactgacccatatcaatctaaaaaattaaaatacaaaaaaaaaacaaaaggcagagttgatccagcatgtatttattgatccagagataacttcagattactagaacatgaaagggagacctgaagagagcacattttgtctgtgtgaatttattcccatttgtgttcaatttctactctagtatttttccatgataacgtactgtgagtcatctttttataaccaagaaaatatttcttgcttttagcagcttaaggaaaaaaagcagtttagaaattattccaaactccacatctttgaagaaacaacttttttgttgccttagacattattttatcattgggaactccacaaaaactcatagctctggatattggacagatgtttggtgggagaattaagtttagagtacaaaagatgatttgtgcataaaattagtttttattgtttataaaatacatgcatatttatgtaatcatttatacctttcatcagttacttttccaatgtcacatatttacaactttaagcaacattatttaattgtgatgatataagacaactttcactttccttatcaaattaagcatgatgacagtgtatttctctcaaaatgtcataacaaattactgcattatttgtaatatgtaagtactgcatatttgtaagttcttacaaatctaatatatttaattgctttcatacatatgtgaactttttgtcattaaaatggttaaaactccagagaagtaaaaatattacccaaaaatgatagtaaagtaacatgagctgtggtcgagacatttaaagggagttaagtgaacatgcacaaatcaaagatgggatataataactatctctaaagtacagataatcaaaccattaaaataattctttgtacattttatgtttactcttacaatggtcagagctgtttcacattcaaccttttaaatgatttcttaaagctagatgactgtgttgaagaaaaaaatctagattcaaatccagttgcagtctactgtattcacttctttaaatgatgtcaacacaagtaatataacctcattattatgcagaagaaagtcatcccaagatcaaagaatgagagctgatacaaattatgattaacatgcgatagctgtttaagtgttcagtgacttcagttcattttatgtgatcattcatttaattatcctctgttgtctgcttccataggtgacgaattccagttatgaaatgcagtctctatggagttgccaattcttctgttttgttactgtcttttgggctcaagtcattaaaattgtgtaattctatgcctttaaaagtatgaagatatttttatttatataaattaagttatacaaaaactggacaagttgataattatttactatctctttgtcaagtttaattttatttttctcatgtctcaagctatttctctttttcttttctaaggctttgttaaaattagaagctgggaaaaataattttcagttggcctttggaagtatataatgtgaaaaatttatcttcttaattgaattgcacacttatgatatgtgtgcttttctgtttctacatttcattttaaaagttaaaagaaatgtaaccttaatagagtagtttcaagtatatctacatataaggattatctgtgctttttcaaaattcgagacagagtcttgctctattgcccaggctggagtgcagtggcactattataacacactgcaggcttgaactcctgggcccaggtgatcctctggccccagctttccaaagtgctgggattacaggcgtgagccaccatgcctcattctagttgtacatttttgctttattttatttttatacaatttcctcgaccatagtctgggaaactgattcagaaggtctagggtagagtcagattatttgaaattatttttaagaagatctccaggtgattttgatcacctcccagatttgaaacaactctaacacacagagatgaaacagagggaaaaacttacatacccacaaaccagaagggttcagtaattaatatggatcatttacattgcagtttattgatttgattattgcatttctcaataaataaaaagtcatgccaatgaggtaactatgagcagaacaaatgaattgtggggtgcatgtataatggaatacactattccatcaatattgaatgaactagatggaaactgaatggatctcaccaatatatttagcaaacagaaaaaaaattgcagaaacatatatatagtgtgatacgtgtaaacagaagttgaagggcaaaatataccatatattacttaagtatatatcaatgaacacacaggaattttaaaaataccaaattcaatatagtctttacctctggtggagagaagaggagagatactcaagatcaaccttggtaatgttgatttctttttttagtggtgagggtaaaatttttttgttttaataggagccttactaccatttgtatctgaaatatttcataagaaataaagtttgttggttatggaaatagcctgattttcattttcatacatgcagaggagagtaaagggagcaggcgttttatgtatcttcaatacaataagtttaaaatgtcagaaatctgttgactcgtttttgaaagaattgagaaaataaaaggtagaaagtagtgaagaaagtttctctaagattgccttaaatgccttgaattgtctctcatctcatggatgccatgagggaggtttactcatttaaaatagtaagtgaggcatgcaaaataaaggaaaaagttctgtatctatgttctttattagtttccaatgtcatcatttactttgttaaattaattcacgttactttagtctaaaaaccactaatgaaaaaatccatttggattcatagattaggcatgtgacaggtaagatttgaacttacatgtaccatgcttcccttccatcctcaatattttttttaaaaagcacacaaatgcatgagagtggttgcagattactttctgaaaggaaggaagcttttgttcttcattttgattttagaggagttatttaaaagcccagttatactctttacttgcaaacatttttggctatttgtgaaagttcacctccaaggaaatctaatcagccagacaagttattgtttcattttagcctgaaaaaaaaaatcacacatatataaaattacacacacacacacacttttattttaaagataggaggtctaaagaatataaaatatggcaatgtgtttctaatgtgtttgaaatgatcatagcaaatagtgaattgccactaaattatcaacaaattatttgcatttgacttttgcgtcagtttctaattatcatataacttgaaacataaacattggttaatactcttttgcagacatatatgatcttttaatggaatttaatcatttaattatactactcatgtaatatttttaattcattaaaaatattgctataaaaatactatgttttataaatgaatggtaagatttgaagaaacaagtttgaatgttatcacttttttcatggttaaaaaaggagactgtttttttcttttataatatacccagaagcccaattgccaaggtagttttatgtacttttccacagatgaagacacttacacattaatctacactctaaaacatggtaggtgcctcaaatgctaaagaaacatccagtttaactgtgaggctgacgcctcagatgtaccagaggattttgtcatttaaatacgaaaattcatagatctttttatatttatagcagcattgtcagagcttatcaaaaatgagctgacttacaaactatcaatggatttaacagtatgatctaatattcataacatcagagacagtataagttgagagacagattttatctttttattgttaaagatgtgttttttaacttttcctagtagattttgtcttttcatctcataactgctctaacgaaaggatcatgccaccaattttagtatattccattattcatgtaaaatcacagccagttcaatatccagagaagaaactagttaggaaagtttaatattacccatgttcttctctatgagattcatattaaagttttaattttgattttgatctttgcccaaaacattgtttattgtacataacagtctgcttgtgtataattaaaaagttgttaaaggtgttaaataaagataattgagatgagaatgtaaatcccttgcgaaaaatattcctctattccaaaaacactgtaagaaatatatattttagcataattcattgactatattcctatactaaattactagggtcagaatttctagaacaaagagttatccaatttaaattgttaccaaatttaaacatagaagattaaaattagtggagccagctacacagttgggtgtgttccaggatccttatattcgtgtgtattttttgtttttatagaaagaaatattttaagttacttttcatttttattgaaaaatatacacacaactaaatttaaatgttataattgcacatctggctatatttttggaaacttaacatcatgtaaccagcaccacccacatatcaaggttaacaccatcctgatttctaacagtgaaagttagtttctctggttttgttctaatgtaaatagcgacatagagtttacgttgtgtctggcctcttttactcactgttatatttgtaatatttatgcatgtgtaaattgtttattctcattaccatgtgatactcaattgagtgattctggcacattttttctatattggaatattggatggaaatttgggtagttatcagtttaggctattttgaagagtgctactatgaatattctactcatctttgggtgaaatatgctttcatttccattcagcatttacatgggaaaggtattgatggattacagagtctgtatgtgttcagctttagtgcatgctggcaaaaggttttctaaaggcgttttagtgatttacagcgtcatctacaatgtataagtgtttcaattgctccatatcctagttctgtttctgttttattttgttttcaggttagacattttgctaaatatgtagtggtacccgattgtgatttcaatttacattttcttgatgaccaataaagctgagcatctcttcaaatgtgcattggtcatttggttatcacctagtttaaagaatttgttcgtattctatggagttgtccttttcttagcggttcatagaagtcctcaatatattcaaaatatgagtcacacattgggaagttatatcacaaatattttctcccacttgtattatattttcagactcctaatgatatcttatttagataggtcacaaaaacatgaaacataaaagtaaaaatcagtaaactggagttaatttaaattaactacttttcaaaaacagtcttaatatcacagaaaagcaagccacagattgggagggggaaaatatttgctgtacatatatccaataaaagaattgtttttggaatatgtaaagtactacaaactcaaaaataagcaaatgactgaaaaacaatgacaagagtttggtgaagacactttacaaaagacatcttaatatggggcatataatgaataacaagatgctcaacatcattagttttcaaagaagtgaaaactaaaccaaaatgagataccaacatacaccaataagaatgactaaaattagaaagactgataatacgaagtgatggcaaaaaatgcacagcaactttgcattcatatattgttactatgaatgcgaagtactataggcacattagaaaacagtgtggaatttcttataaatttagacgtacatttactacctgagccaccagtctcactcctagatatttacacaaaggaaatgaaaaattatacccacacaaaaacttgcccataaatattcatggaaattacattcacaattgccaaagactgcaaaaaacccaaggtttctctttttctcttttaaaaagtttgagtaaacatctgggaataaaagtatgattttggttctcctccatatctcaggcattttcttcccgttcttttgagaacagcctatctcaaactgtttagacacaatacttatgagaggtttaatctttcctacagaggttttgaacttttctctatggctcccacattgtgttaaagattggcaaatattttgaaaaggtgactagccatgtgtttggggaaagtaccattcccccggcggagcttggttttctaaataatgagagactgtgagaaatttcaagttcacttattagaagccctctacattctgtgtgactcaggtttcagaaaatgtattgtcttagctcatttgtgttactatcaaggaataccagagactgggcatttgcaaagaaaacaggttgatttggctcacagttctacaggatgtacaagaagaatggtgccagcatctgcttctggtgggcaattaagctacctccactcaaggcagaaggcaaagtggagctagaatgtgctaaaatcacatggttagagagaaagtaagagagtaagaggggagatgtcaggcttttttccacaaccagcttgccagggaactcttgcaggaactaatagaatgagaattcattcagttccctccccacagggaagttattaatctatttatgagggatctgctcccatgaccctgtcacctcccattagccaccacttccaacactgaggatcacatttcaacatgaggttttgcagggacaaacatccaaagcacgcatgttgtgaaaaaatcagccttgtttggagatctaattttttttacattgtgcccaatagaccacagaatcgctagtttctcttcctcaagccacattcttcttcaagggaaaacctgatttttattcccaagattggaaatctgcaaacgatcctagggagggaaatgactggaatttccattatttaattctctctgttttcacagatctcttatgctttaaacaacgtaaattttacaattaatctgtcttgtatatcgtcgtgatgggaatattgtttgcagcaacctactattgcttttttagcattagaagtttcttctatatatttttatgtcaatgtttagatttctaagaaaaactttgatatattctccaagttaaaatacacatatttttaaagtttcaacaaacttttaagtttataatctgagaaacagtcctaaatttcaaaaataaatatctgaattatttaacataaaaattaatctgatttttaatattgatttgtccttttgaaatttgtcattggatttatatttttaaatacttacacaaatggtcactgtgttattttcttagctacaagttgaatcacagcattcccctttgggaaacctttgtttctttcttttaaagaatagaatttcaattccttttatggtggtcaataatttccataaacttgtcttaactacttttatagtagctacatctcctactgcatctatccattaatctgagtcactgattattcaaacatattctctaggtatccctatatactctcaaatctatgcgattttaccactgtaatcttctaagtagaacacaacaatcaacctttctgcccatctaaatcttactatttttccaagggctaactcacatagcccctcctccattgaggattactctaatgagaagtatactcatcttcctttaaatcctaatcattgttcatttctcttatcacttagtttttcctaccccctttttttatactcgctggtctctagatctttcccatatagtaggaaactccttgaggaggagccataccttaatcatgtgtatatttcttatatacctgcatgaaaggtactaaaatatttgttgaatatatgtgactattgtttttattacataaatatggttcattggtagaaaacagcactaatattttatagttaggatccattaccttaaaatagacattttatctagttgacgtcctagcaaattacctaatctttaagtacttaaaatgtatattttaaattactaaatcttgctttattttccctttaagagcaaactactagctacaatcttttctgaaagcttttcctactgtatcttttggaatagagtaaccttttgcacaaatcccagctcagcacttggataatttgaatgacgatttctctatttcaatatatgaaatcagaggagtttaaggtgaaaattcactaagtatatataggcattcctcaacttgcaaaatattttcatgaacaccttaattttataaatgatgtgttgcaagcttttattcagactacttaaatataaaacacttattgctcagactgggcgtcaatattgttctctaaggggggaaatagcagcagtttttgattgcaagaaaattatagtctttcctgtactgtaaatatcaaagacatcataaggcaggtagaaagttgtaaaatttctctttcagtagttggacaataaagagaaaaataaatatcatcatggactttaatgtgcacagaaaataaaatgttcaataaaaaatattaattatttctagtttcatgctttcttgtttacacaggtaatatatttcaaaatattttatttacctttaaaatgaaaatactaaaaaatgtatgagaaaagaatagagtaaagtcaagatgctttagcttggtggttcacagtagggagattaaagtaatcccaatattttcttgatttcttaaggtttaacaagtcatattctttgacagtaaatgttactagaaataagtaatcccaactggctgagggatatgagaaaaaagtatcagctctatttgagatataaaatgagaatgctagtaataataaatctctctctttatttctctctctctctctttcttagaaaaggtgtctccttattgactagaatggtaaatttatgttcctaaaaatggccttggtggcagcctaataccaacttgcatttgaagaatgttagaattgaggtacataaagtgaagtgatttgtccatggttataaaacatattatcagaataaggattagaagctgcttctaaacaagattgggacccaaatcttctgttaacagttctatataccaactcactttctttgatttttcatctgattagatcaattggaacttctttgtgtgtaaaacattttcaaacttaacagaagtcaaaaaacatggttttgatttagtttaaactttccaattaattttaattattctttttcatactcaaaatttctagagcctgcaaagctgactacctccatgcataaaccaaaaattgaggtttcttacatttttagtaaatatcttcattttatggagcatgctaattgacaaaaaatttggtcatttggaagtagtacaaggttgctcttggctgctctcatttgtaggaattcctgatctgagtgctgtattctataaatgatttctggaatttggcttagatgcttagttcagtctgcatgttcagctacattttctcctctctactcatctgctgctcatgcctccctacaactaactacctatagaaacaaagcctatgtctccagccttctgtgacaccaatagctaccactaggtcctcctatttcaggcatattccaggatgatcctgcctcttctctcatttcagatatcctgccttgtctatcttcatgcctatcaagctgacagaaatggaccgttcctttcttgtctacagagagggaaaagaatttcagtatacaccactctcaccagtctccaacaacacagctctttgtggcatttggggctgccctcaataggaagcatgtcattctacatacagagaatggttggtttacacaagacttcctgctgctgccatcaccaacagagattcctaatgtagacatctaacacattctgatcttgcagtaagcttagcaaagatatttctggtaaaaatgtattcagcagcagaatgacttcagcagttcatttatcacttgatatgcctgttttgcagttgtgtggtcccaggaatgcttgcttactatgatattttataatagtttcccaagattttttttcctggactctgaaaaattgctatgaaaaccaatagtgtatcttttttccttgggggataaggtttggaagaagtagtagaaatggggtagaagcaattcaggttgggcatatttaaccactcataagaaacttagtcaatattaatggaggcataattgccagatcaattgaaataattatccctccatattctgcactgggaagactacatttatagacagtttagaaacactggagtcagatttatcacaattacaatcccaactctgtggcttagacctaacctcataatgacacatggttgttaacctctactttatgactatctaacatttaattacagtatatttatatatatatactgtatatatacacacaaatatatagaacacacatatatagaaatatatactgtatgtatatatatttttacatatactgtgtgtatatgtgatatattataatcatatatatgattatgatatatatatcatatattata

SEQ ID NO: 325 - DNA, 5374 bp, Homo sapiens
gagtgttccggagagcacgtgttagggaaggaggaggctgcgggctaacctgccgggagggagggataaactggtaaacacctcttgggttccaagagaaggaagaggacacatactgctcttcagatccgtatactgatccccactacaaccagtgaaccggaacattgaatctggatagggggccctggtgactaagatggcacgctctaaagatctagggcactctcttggccctgttttgcatcctatgcaggctgtgtgtacacagcaaggatatttcctggagggaattcatgaaacagcactacctaagtccaagccaagaattcagaaaatacaaatgcaacgtcctcatgagggaaaaagaagctctgaaagacaagagctcttgggtgttcatctatacctcatggtacaaatggagcatatatgcgtcaatgacaactgaaatgaccgctacagaaatgtatgtatataggcccagaatgccctgaaagaactcagttgtcaccaggagaattcaaaaaaaagcaacacattgtctgggtgcagtggccataactatattcccaacacttgaggccaggagtcaagaccagcctgggcaacatagccagaccccatctatacaaaaaaataaaataaaattacctgacataatgatgcacatgtgtagtcctaactagtggggaggccgaggcaggggaattgcttgaaccctggagattgaggttgctgtgagccatgatcacaccactacactccatcccaggaagcagagcaagaccctgtctctttttttttttttttttttttttgagacggaatttcgctcttgtcgcccaggctggagtgcaatggcacaatctgggctcactgcaacctccacctcctgggttcaagcgattctcctgtctcagcctcccgagtagctgggattacagacacccaccaccacgcctgggtaatttttgtatttttagtagagacggggtttcaccatgttggccaagctgatcttgagctcctgatctcaggtgacaccttggctttccaaagtgctgggattataggtgtgagccactgcacccagccaaccctgtctctttaaaaaaaaaaaaaaaaaaaaaactacccagagagcagaagtttcaactacattgaattccactaacgcggatgagtaggttgatagcacagaggacctgaagatgatgagcctgtcaactactagaaggtctacccacatccccaaattttgctacagtattctgtgcttgccaagcagtggccccgtctacatcattcgcccctgccactctctcctttgcatttatgtatcaatgttttcaaactacttagagttatgtatcacatggtctcttgataccatacctttgcctgtgttgtttctctgcctggaatacacttctgtcctatttacctaatttactcctactttttttccccaagattcagcttatatgccatctcttcttgactaacccaagactttttctgataacaattctccttatatctacccaagctgaatgatcttcccttcctttaaataaattatattatatcaaaaagaatttttctttagagaaatcaaagatgatctaaatacatggagggatcaggcatgatggctcacacctataatcccagcactttgggaggaggaggcaggaggatcgcttgagcccacgagttcaaggccagcctaggcaacataatgacacccatctttatttaaaaaaaaattttttaaataaaaaataggccgggtgcagtggctcatacctgtaactcccgcactttgggaagccaagacaggcaaatcacctgaggtcaggagttcaagaccagcgtggccaacatggtgaaaccccatctctactaaaaatacaaaaattagcttggtgtggtggtgcacacctgtaatcccagctacatgagaagctgaggcaggagaaatgcttgaacagaaaagacacagaaaaagatgttcatagcagcattctttgtaaaagccccaaactgtaaataatccaaataaccatcaaaaatagaatattatggcatgttcatgcagtgtaataccatgcagtaatacatacgaatgaaccaaagctctttgcaaaacctgaatgaatctcacaaaaataatgttgaataaaataaatcagaaatgttacaatttcattgatataagcttcaaaaaccagcaaagtgacactctgttgttacggatgcatgtttagggagcaaaactaagaaaagcaaatgaggttaccttaaggggtagcagttactttatgggggaggaaggagtatccattagaaagtagcacaaggggaatctctggagtgctgacagtgatctattttttgacctgggtgttggttacagggtgttcatttattatcatttacttggctgtacattttttttttttttagacagagtctcgctctgtcacacaggctggagtacagtggtgtgatctcggctcactgcaacctccacctcctgggttcaagtgattctcctgcctcagcctcctgagtagctgggattacagatgcccgccaccacgcccagctaattttttgtattttagtagggatggggtttcgccatgttggccaggctggtctcgaactgctgaccttgagtgattgacccaccttggcctccaaaagtgctgggattacaggcgtgagccactgctcccagccttagctgtacatttttgttttgcataattttctatatgtgtgctaaatttcactatgagaaacgatttttggctgggcacagtggctcacatctgtaatcccagcactttagaaggcgaggtgggtagatcacctgaggtcaggagttcgagaccagcctgaccaacatggtaaaaccccatctctactaaaaatacaaaaattagctgggcgtggtggcaggcacctgtaatcctagctactggggaggctgaggcaggagaatcgcttgaacccaggaggcggaggttgcagtgagctgagatcgcaccactgcactccaacctgggcaacagagcgagactctggctaaaaaaaaaaaaaaaaaaatctttttacggtggctcatgcttgtaaatttagcactttgggagtctgaggcggctggattgcttgatttcaggagttggagaccagcctgggcaacatggcgaaaccccgtctctaccaaaaacaccgaaaattagcccggcatggtggtgaacgcctgtagacccagctactggggatgctgacatgggaggatcacttgagcctgggaggtgaactgaggttgtgtcactgtactccatcctgggtaacagagtgagactgtctcaaaaaaaaaaaaaaagataaaaataatgttttgtatgaaaggagagaacgtcagcactcctcttgacaaggatggaagaggctctcagacctgacaacatgcatgaagttaaggcattgccacctacttcatggcatctaaacatgttgttgtggtggttgttttttaaagacagagcctacttgatacctatatacatatagaaacattaactcaaggtgagttgtaaacctaaatgcaagaactaaagctctaaaattcagaagaaaacatatgagtgccaggtgcggtggctcacgcctgtaatcccagcactgtgggaggccgaggccggcggatcaccagcgcaagagatcgagaccatcctggctaacatggtgaaaccccgtctctactaaaaatacaaaaaattagccgggcgtggtggcgggcgcctgtagtcccagctactcgggaggctgaggcaggagaatggcgtcaacccgggaggcggagcttgcagtgagccgagattgcgccactgcattccagcctgggaaacagagcaagactccgtctcaaaaaaaaaaaaaaaaaaaaaaaaaggagtgaatctttgtgaccttggattaagcagtggtttcttagatataaaagcacaaacagtgaagaaaaaaagataaattgaatttaactcattttattttaattcaatggataaattggacttaaaccaatttaacacttttgtgtttcaaaggacgccatcaagaaaggcaacccatggaattggagaagatatttgcaaattatatatttgataagggactagtgtctggaatatatataaaactcttacaactcaacaataaaaggacaattaaccccatttttaaaagggcaaaggggaaacaaggggctgaaaatgagctcaaatttatttttttcagacagggtatttctctgtcatccaaggctggagtacagtagcacgatcatggctcaccacagcctcaacctcccaggctgaagtgatcctcccacctcagcctcccaagtagctggaactacaggcgtgcgccactatatctggaactcctgggctcaagcaatcctcctgcttcagcctcccaaagtgctgaaggattacaggtgtgagccactgcgcctggttttaaacgtatgaaagaagatgagtaaataacagtaaagccctgggttgtgaagatgtaataatacaaaaagcagagagaaggcaggatgtttgactcctgactgttccatcaaggactgtagtctggaaaataaatattttgaaggtgaaaaattaaagctcatattaggataaaagactatcagagagcactgagttgtcttaaattaagtcaagcctcctaaccccaataaaacacatcatagtgccaaataaagttaaaaatccagccaggcgtggtggctcacgcctgtaatcctagtactttgggaggcccaggtgggtggatctctttcagctcaggagttcaagaccagcctgggcaacacggtgaaattccatctctacaaaaaataccaaaatgagctgggtgtggtggctcatgcctgtggttccagctgctcaggaggctgaggctggagggttgcttgaaatgggtggcagaggttgcagtgagctgagatcacgtcactgcaccccagcctgggcaacagagtgagaccttgtctgaaaaacaaataaataaatatataaatatataaataaaataaagttaaaaatctgaaaaaataaaacgggtaaattatttcaatcaatatttctctaaggaatatatacaaatggccaatatgcacataaaaatattctcaacatcatcagtcatcaaagaaatgcaaatcaaaccagtgatgtgatactacttctcagccactaagatggctaatattaaaaagacagataggccgggcacagcggctcatgcctgtaatcccagcactttgggaggccgaggc

SEQ ID NO: 326 - DNA, 931 bp, Homo sapiens
atggatgacgaaaatgcaacattgctgacagagtttgttctcacaggacttacatatcaatcagagtggaaaatacccctgttcctggcattcttggtaatatatctcatcaccatcatggcaaatcttggtctgattgctgtcatctggaaagactcacaccttcacattccaatgtacttattccttgggagtttagcctttgtggatgcttggttatcatcctcagtgacccctaagatgctgatcagctttttagctaagagtatgattatttctgtctctgaatgcaagatacaatttttttcctttggaatcagtggaaccacagaatgttttctcttggcaacaatggcatatgatcgctatgtagccatatgcaaacctttactttatccagtcattatgaccaatggactgtgtatctggctattagtcttgtcatttataggtggctttcttcatgccttaattcatgaaggtattttattcagattaaccttctgtaattccaacataatacatcacttttactgtgacattatcccattgttaaagatttcctgtactgacccttctattaattttttaatgctttttattttgtctggttcaatacaggtattcactattttgactgttcttgtctcttatacatttgtcctctttacaatcttaaaaaaaaaagtctgccaaagacataaggaaagccttttccacctgtggagcccatctcttatctgtttctttatactatggcccccttctcttcatgtatgtgcaccctgcatctccacaagcagatgatcaagatatggtggagtctctattttacactgtcataattcctttcttaaatcccattatctacagcctgagaaataagcaagtcatagattcactgacaaaaacattaaaaggaaatgtttag

SEQ ID NO: 327 - DNA, 4063 bp, Homo sapiens
gaggagcccagggacatatttcacagctaagtcaactgcttttcttcaaattcagatttaatccttgagtgaaatgagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgagattagtgccaccatcaaggacttgaaagatgcaggggtgatgattcccaacccattcctgttcaactctcccatttggcctgtgcggaagacagatggatcttggagaacgacagtgaattatcataagcttaaccaagtggtgactccaattgcagctgctgtagcagatatggtttcattgcttgagaaatgtgtacctggtatgcagccattgacttggcaaatgcctttttctccatacctgtccataaggcccaccagaagcaatttgccttcagctggcaaggccagcaatatacctttacagtcctacctcagaggtatagcaactctccagctctgtgtcataatcttattcggagagaccttgactgctttttgcttctgcaaagtatcacactggtccattacattgatgacattatgctgattggatccagtgagcaagaagtagcaagtacactggacttgttggtgagacatttgtatgccagaggatgggaaataaatccgactaaaattaaggaaacttccacctcagtaaaatttttaggggtacagtggtgtggggcctgtcaagatattccttctaaggtgaaggataagttgctgcatttggccactcctacaaccaagaaagaggcacaatgcctactgggccgatttggattttggaggcaacatggtccttatttgggtgcattactgtggcccatttatcaagtgacctctaaggctgccagttttgagtggggtccagaacaggagaaggctctgcaacaggtccaggctgctgtgcaagctgctctgctacttgggccacatgacccagcagatccaatggtgcttgaggtgtcagtagcagatagggatgctgtttggagcctttggcaggcccccataggtgaatcatggcagaggccgctaggattttagagcaaggccctgtcatcttctgcagataactattcttcttttgagagacagctcttagactgttactgaactttggtggaaactgagcatttgactatgggtcatcaagtcaccatgtgacctgaactgcctatcaggaactgggtgctttctgacccacctagccataaggtgggtcatgcacagcagaattccatcatcaaatggaagtgatatatacgtgattgggctcgagcaggtcctgaaggcataagtaagttacatgaagaagtggctcaaatgcccatggtgtctacttctgccaccctgcctgctccccccacagggtgcactgatggcctcatggggagttccctataattggttgacagaggaaaagaagacctggttcagagatgattctgcatgatattcaggaaccatgcaaaagtggacagctatagcactacagcccttttctaggacatccctgaagggcagcagtgaagggaaatcttcccagttggcagaactttgagcagtgaacctggttgtgcacttagcatggaaggagaaatggccaggtgtgcgattatatactgattcatgggctgtagccaatggtttggctggatggtcagggacttggaagaagcatgattggaaaattggtgacaaatttggggaagaggtatgtggatggacctctgagtggccaaaaactgtgaagatatttgtatcccacgtgagtgctcaccaacggatgacctcagcacaggagattttaataatctggtggatagaatggcctgttatgtggacaccactcagcctctttccccacccacccctgtcgtcgcccagtgggcccattaacaaagtggccatggtggtagggatggaggttatgcatgggctcagcaacatgtacttccactcaccaaggctgatctggctacggccactgctgagcgcccaatttgccggcagcagagactaacaccgaacccttgatatagcaccattactcatggtgattagttacctggtggcaggttgaatatattcaacctcttccatcatggaaagggaagaggtttgtcctcactggaatagacaattactctggatatagatttgcctatcctgcacacaatgcttctgccaagactaccatctgtggactcacggaatgctttatccactgtcgtggtattccacacagcattgcctgaccaaggcactcactttatggctaaagaagtgtagcagtagacttatgcttatggagttcactggccttatgttccccatcatcctgaagcagctggattgataagagtggtggaatggccttttgaagtcacaattacaacaccagtgaggtgacaatactttgcagggctgggacaaagttatccagaaggccgtgtatgctctaaatcagcatccaatatatggtactgtttctcccatagccaggattcgtgggtccaggattcaagggatggaagtggaagtggaaatggcaccactcaccatcacccctagtgatccactagaaaatttttgctcctgttcccacgacattatgttctgctggcctaaaggtcttagttccagaggaaggaaggctgccaccaggagacacaacaacgattccattaaactggaagttaagattgccaccaggatactttgggcttctcctcctgtctttaagtcaacaggctaagaagggagttacagtgttggctgggatgattgacccagactatcaagatgaagtcagtctactactccataactgcggcaaggaagagtatgcaggtaatacaggaaattcattagggcatctcttagtattaccatgccctgtgattaaggtcaatgggaaactacaacaggcaggactacaaatggcccagacccctcagaaatgaaggtttggatcactccaccaggaaaaaaaaccacaacctgctgagctgcttgctgaaggcaaagggaatacagaatgggtagaagaaggtagtcatcaatatcagctacgaccacgtgaccagctgcagaaatggggactgtaattgtcatgagaatttcctccttcttttgctaaaatcatgtttgtgcatgtatacacttgtactaagaaaatatcttcattttatttcctttttctctatgatgtgacataagatttattgacttcatagcagcatttaagtattgttaactttatataatagtatttgggttggggattggtgcctttctggttgtatgaaggatagttgtattatgttaggtgtaattatgacattattgtctttaagattatgtatgacctcaggaggtgtgtatgggttcaagttgacaggggttggagttgtgattgttaatgctctgtgtcaacttgattggattgaaggatacaaagtactgatcttgggtgtgttggtgagggtgttgccaagagatattaacatttgagtcagtgggctggggaaggcagatccacccttaatctggtgggcacaatctaatcagctgccagcgaatataaagcaggcagaaaaatgtgaaaaggagagatgggcctagcttccagcctacctctttctcccatgctggatacttcctgcccttgaatattggactctaaggtcttcgctttcaggacttggattggctctccttgctcctcagcttacagatggcctattgtggtaccttgtgatcatatacgtttatacttaataaattcccctttatatatatatatctatgtatatcctattagttctttccctctagagaacgctaatacaccatccttgattaaatcccttcaccctctctccatctttgtaaaaattctcctcattaaattattgttcagtg

SEQ ID NO: 328 - DNA, 3988 bp, Homo sapiens
gagtcactggctcatccagttaagatcatcacccactttcctaacaaaacttctcttcaaagaaggactcgctcatccatcaggtggacctccacaggaacaaatcatatccatgtcaggcggcaccaaacctaaatctgcttctgcctcagcagacaggacatgagattagtgccaccatcaaggacttgaaagatgcaggggtgatgattcccaacccattcctgttcaactctcccatttggcctgtgcggaagacagatggatcttggagaacgacagtgaattatcataagcttaaccaagtggtgactccaattgcagctgctgtagcagatatggtttcattgcttgagaaatgtgtacctggtatgcagccattgacttggcaaatgcctttttctccatacctgtccataaggcccaccagaagcaatttgccttcagctggcaaggccagcaatatacctttacagtcctacctcagaggtatagcaactctccagctctgtgtcataatcttattcggagagaccttgactgctttttgcttctgcaaagtatcacactggtccattacattgatgacattatgctgattggatccagtgagcaagaagtagcaagtacactggacttgttggtgagacatttgtatgccagaggatgggaaataaatccgactaaaattaaggaaacttccacctcagtaaaatttttaggggtacagtggtgtggggcctgtcaagatattccttctaaggtgaaggataagttgctgcatttggccactcctacaaccaagaaagaggcacaatgcctactgggccgatttggattttggaggcaacatggtccttatttgggtgcattactgtggcccatttatcaagtgacctctaaggctgccagttttgagtggggtccagaacaggagaaggctctgcaacaggtccaggctgctgtgcaagctgctctgctacttgggccacatgacccagcagatccaatggtgcttgaggtgtcagtagcagatagggatgctgtttggagcctttggcaggcccccataggtgaatcatggcagaggccgctaggattttagagcaaggccctgtcatcttctgcagataactattcttcttttgagagacagctcttagactgttactgaactttggtggaaactgagcatttgactatgggtcatcaagtcaccatgtgacctgaactgcctatcaggaactgggtgctttctgacccacctagccataaggtgggtcatgcacagcagaattccatcatcaaatggaagtgatatatacgtgattgggctcgagcaggtcctgaaggcataagtaagttacatgaagaagtggctcaaatgcccatggtgtctacttctgccaccctgcctgctccccccacagggtgcactgatggcctcatggggagttccctataattggttgacagaggaaaagaagacctggttcagagatgattctgcatgatattcaggaaccatgcaaaagtggacagctatagcactacagcccttttctaggacatccctgaagggcagcagtgaagggaaatcttcccagttggcagaactttgagcagtgaacctggttgtgcacttagcatggaaggagaaatggccaggtgtgcgattatatactgattcatgggctgtagccaatggtttggctggatggtcagggacttggaagaagcatgattggaaaattggtgacaaatttggggaagaggtatgtggatggacctctgagtggccaaaaactgtgaagatatttgtatcccacgtgagtgctcaccaacggatgacctcagcacaggagattttaataatctggtggatagaatggcctgttatgtggacaccactcagcctctttccccacccacccctgtcgtcgcccagtgggcccattaacaaagtggccatggtggtagggatggaggttatgcatgggctcagcaacatgtacttccactcaccaaggctgatctggctacggccactgctgagcgcccaatttgccggcagcagagactaacaccgaacccttgatatagcaccattactcatggtgattagttacctggtggcaggttgaatatattcaacctcttccatcatggaaagggaagaggtttgtcctcactggaatagacaattactctggatatagatttgcctatcctgcacacaatgcttctgccaagactaccatctgtggactcacggaatgctttatccactgtcgtggtattccacacagcattgcctgaccaaggcactcactttatggctaaagaagtgtagcagtagacttatgcttatggagttcactggccttatgttccccatcatcctgaagcagctggattgataagagtggtggaatggccttttgaagtcacaattacaacaccagtgaggtgacaatactttgcagggctgggacaaagttatccagaaggccgtgtatgctctaaatcagcatccaatatatggtactgtttctcccatagccaggattcgtgggtccaggattcaagggatggaagtggaagtggaaatggcaccactcaccatcacccctagtgatccactagaaaatttttgctcctgttcccacgacattatgttctgctggcctaaaggtcttagttccagaggaaggaaggctgccaccaggagacacaacaacgattccattaaactggaagttaagattgccaccaggatactttgggcttctcctcctgtctttaagtcaacaggctaagaagggagttacagtgttggctgggatgattgacccagactatcaagatgaagtcagtctactactccataactgcggcaaggaagagtatgcaggtaatacaggaaattcattagggcatctcttagtattaccatgccctgtgattaaggtcaatgggaaactacaacaggcaggactacaaatggcccagacccctcagaaatgaaggtttggatcactccaccaggaaaaaaaaccacaacctgctgagctgcttgctgaaggcaaagggaatacagaatgggtagaagaaggtagtcatcaatatcagctacgaccacgtgaccagctgcagaaatggggactgtaattgtcatgagaatttcctccttcttttgctaaaatcatgtttgtgcatgtatacacttgtactaagaaaatatcttcattttatttcctttttctctatgatgtgacataagatttattgacttcatagcagcatttaagtattgttaactttatataatagtatttgggttggggattggtgcctttctggttgtatgaaggatagttgtattatgttaggtgtaattatgacattattgtctttaagattatgtatgacctcaggaggtgtgtatgggttcaagttgacaggggttggagttgtgattgttaatgctctgtgtcaacttgattggattgaaggatacaaagtactgatcttgggtgtgttggtgagggtgttgccaagagatattaacatttgagtcagtgggctggggaaggcagatccacccttaatctggtgggcacaatctaatcagctgccagcgaatataaagcaggcagaaaaatgtgaaaaggagagatgggcctagcttccagcctacctctttctcccatgctggatacttcctgcccttgaatattggactctaaggtcttcgctttcaggacttggattggctctccttgctcctcagcttacagatggcctattgtggtaccttgtgatcatatacgtttatacttaataaattcccctttatatatatatatctatgtatatcctattagttctttccctctagagaacgctaatacaccatccttgattaaatcccttcaccctctctccatctttgtaaaaattctcctcattaaattattgttcagtg

SEQ ID NO: 329 - DNA, 1428 bp, Homo sapiens
tttccctgtcctccttcccacatcgatttaaaaaattagatgcaaatgcaaaatccttaaattatagatttatgataaatttaaattctggtagaatcaaggttttataacatttaaagtgtctgacactaagtgtatataatcttttaagaaacgtcttcttaacagcgcatggtattctgtgactgttcgtgtaccatgaatattcttattgggttctagagttagttactgactcttgaagatgggcatctaatggtcctcctgtggaagtggagagcagctctccactgtttgataacatttaaagccaagggtgaaccactcaagaaacatttggtggttataatatttttttgttgttgttaagtaccatcaataaaactgaaaaatctcttaagtacctgactcctgcagtgatacaactgcagtgataaaacttttagctttttacatcaggggtattaggtattttctcacagaaatagccttttgaggtgaaattcacataacatacaattaaccattgtaaaatgaacaattcagtggcgtgtaagagtatgtttacaatgttgagcaaccatcacctctgtctagttgcaaaatgttttcatcactccaaaagaaactcctttattcatcatagcccaaagttggaagtattttcttgattgggctcttgattacatggatgcatctgagtcattgaattgaagcctaagatgtgcttaatttcactgtgtgtaagtttcacctcagttaacaagagagaacagaacaaaccaaaaatcttaattcttttgaaaaaaagactttctggctgctttattaaagaagccaggggaacaaggttaaaaggaaatcagttagcagtgaccaaggcaagagatgatggtggcttggctgaagatggtgacagtggaggtggtaaggtgatcagattctggatatattttgaaggttgagctaatttggtcagctgatgggcataatggatgtgagggaaagaaagttggaaaggatgatgtgaagatttttaatgggatggaataggtgtttaatgaacagccatttaacaacatcagggtaatttcatcttgtgtatcattctctacaacagggttatactctaggacagtagatacccttagtactctactgtcctagagtataaccctgttgtaaagaatgatacacaagacaaacttaccctgatgttgttaaatatatgttagatgaccagttgctttgatttctttgctcaataaacattggattacagctggtttgctgtgtggcatgcctacatggagggaacacactgagccaatgatttcatcatctgggtccctttggtttatatcagtttccaacatgacttgtttgtggggcttgtgggaggggcacatacatcggccccaggattct

SEQ ID NO: 330 - DNA, 2225 bp, Homo sapiens
gattctcacagctactccatctgtgaaagctcctgggagaggggtaaggcggcctccaaagaccacttggaattgcctcacccagaagatcagaaccctactttctgggcagatacatgggatcctctataatctggttcactagaccaatctcactgatcaccattcagtgagagttgcaaagatacggagaaatggaattaaagctatcaaaataagaaaattcctgatcaaaagttttcaactacttatctacaggaaaagttattttatgtgtagtaaactaaattcatttacaatgtctttgtgagttattaatcatccgccagtgggaggcaggcaacaggagaaacaggctgtgtatctgagagtgggaccccttaagagtgcaaaggagaaggggagaggagagaaggtgacaatatgttgcagtttcattattacaatttacaacagcctacacatgtttaatcctgattttcttctctttgaggcactcacagtgcaagtgaagaattaaatcccgtctttatttaaaatgttgatattttgttaatcatagatttttgtgcattgtttgatatctatgtacttgtaataggttgtgatacacataatttgcaactatgtacaaataaactgtggtatcttactaattgaaacagaagcagtagttgaaatttataaaaagttttgtaggtatacagtaacggaactaatttattttgggtgtgtttttgtatgatgaatacaaaagtatactacatagtattttaaaagtgtttgagcctttgactgttttatgaattaacctaagtaacagtaccaaactttttgtaaatgagtcctcaaagttttggttatattttatttaaaattagttgaaaattgtaaatcaaaatattttcaatggagtactcctacatttttaacttctgaagcttttggcaagttgcaatttctcaatacaaatctggcaaacaaaaaagacattgaaattcatttctataaaagccagagacaaactgcatgaaataaaaactgaaagctcctatggggtgcacaatttaatttggaaattcttgattggctcttaggaatattttgattagaggaaagaatcttttgatggatttcttgttttttagtaaattgttaatattctctatcaaaataaagtataaaattgagaaaatttcatttctcacaattatagtgattaaatttggcaaaacactaaaatgaaacaacctgtcaactaagacaacttagttttgtcttcttagttttatctcttaaatctaaccttctgtacctctgtgctgcattctggttaatttttttggatcttccagttcactgactctcttcagcaagtctaatctgctattagattcgtccactgagttttatattttaactgttattattgttcatttttagaattttgattgcatatttttaaaaatgtctagtcattctttataatttttactcactcctcatattgtcagacttctttttatttcattatacataataaacataatttatatttagtgtctctgttaactctaatagcttaagtctctgggtttgcttctgcaggttctcactcatggtgacctcttccattatctgttttatgctcactgcatactgcttattttctttggaactttatctttgaggatttgttgatgccttgttgaaggtgggttccttcagagacgatatacaattgtttttgccagaaacctgagaatacttccagactgggaccactgcaaactggatttcagagtgaggtttgttttagaccaaccaacttaaatgaatttggtctgcatccccatgtgaggatactttttctgctacgaactctcagaagagattttttttgttttctgtcgacagcaccaaggttggagatgggcaagtttcctgcagctgttggcaggctaggcattcgtttctagttctcttttacactgaggatatagctttttggtttccaactttaagggaaggtggcctattagacaacccaccttgggcaggtcctaggctttgtttcttgtccccatactctgtgagtcaaggtcaaggtcaaaagcccttaagacaaaagccagcttcactgctgtcagtatgtagaattcctgccattatttaaattttgacttgagcattttttacttcttgcaagacaatgaatgatttaa

SEQ ID NO: 331 - DNA, 4449 bp, Homo sapiens
gctctggtgctggcggacctcgggtcgcgcagtcagctgctctaagatggcgaaactcaccttcaggacatgctcccttgggctaggagatcaggtgggctccgggtgatgcgcaagtccacccctctagctgcagttccgcctttttctctacaaccaagcaaacattttggcaggcacgtgtgagtgacgaccttgaaaccaatctgatttatttttctgaaaagtaagttattgacaaatgtcaatttttaatatcaacttatttaggatgtatctccaaacctatccttacacacagtatgtctcagcaaggcagctataagccctggtgagctaatgagtcttccatcaggaaagtaaaatggtcaaatattgttctaggaaaaacattctattgattttcttcagaatctctagcaaagcacttgatcaggtactcagaaaacattaccaaattgaagtggcaccacgtatgcattaaaggatttgggaaggaatctcgattcagcatacaaggcttacgtttcctgatgggcttttctttaagtaaaatcaacaaatggtgttcagcacctattgctgattagtgctgtggggtgacaccaagcagtatgtgaaatgacctctagtcttaaggagtgctcatcgtggttggggacataaactaacatactttaaatactaggcaacaagtgaaacatattgtaaggagtaagggttgtaatgtttctgtcccccgccccccccaagttcataggttgaaattaatcccagcgtgatggtctttggaggtggggcctttgggaagtgaataaatcatgagggtggagcctcatgaatgggaatagtgccataacgaggccagagagctctcttgcccactttccaccgtgtgaggatacagtgagaagatggcctgcaacccagaagagaggcctcaccagaacctaaccatgctggtgcctgatctgagacctcagcgcctccagagctatgagaaatgaatttctaaacccagtctatggtactttgctgtagcagtctgaacagtctaagacagggatgaaaaagcttcaaggagcaagtttgtgaactgagcctggaaggaggagtaggatctgacaaagggttagaagaggaaggactccaagcagaaggagcaaacctaggaaagagactgagggaaaaattcaggagaccaaactctcatgcgcaggaggttcatgctgaggggagcaggaagcagagctggactggggaggccttgaaggcaggcagagcaaggagccccaccaggtgactgctcattggcctcccagatggattcgatggtatcgctcagatgatggaacaaaaaagaaaaagagaaaacacaaatgtgacatgtgaaaaataggaatgaaagagaaagataaaagagaaggaaaatcttcccaggtctagaagatacattctcgtatcgaaagggcccagcaggtgcccagcacaacaaacctaggaagaccaacaccaaggcacatcgccacagcattcagaacaccaaggataaagaaaagatcttcagagtttcctgaaggaaaaatgaaaaggtcacatttaaaggactggaaatcagaatggcatggaaattctccacagaatcccaggaagctggaatacaatagggcattaacttcaaaattctgaagaaaataattctaacatagaattcaactctcactatattagctgtttgtgggtaggatgtagatattttcagatatccttatctcagaaagctactggaggatattcttctccaaaattaagaaattagccaagaaagaggataatatttgggacctaaaaaacaggaagtcccagcttaggagagaggagaagggaagtactaggacagaagctaggacttatacagtaggggatagaggcctctaggagagatgtttccagaaggaagtgaatcacatggaatgcctgttatggatgaatatcttaaaagggatcttcagaatttgatgatgataagtaatagctagataggaaagtgaataaggaaataaatgaggccattattgaatctagtgaaaacaatatgcaaaaaaggatatagcatatgtcttggctgtgaataaatatgtaattataacaagataattgctgaatgggagtttaacccaaaggggtgttataattatttttgaaaaaagggaggtgaccttacgtgtgtttacataaatgtgcatgtgtctaggaagtgagggtgggagagttaaatccttgtcttctagagttaggaagtccatagactatacgcacaattgaaaagtaaggacagaacattaaatatgtgttcttagaaaatatgagcataaggccgggcacattggctcatgcctgtaatgccagcactttggggggccaaggtaagaggactctgtgagcccaggagttggagaccagcctgggcaacatagtgagacctcatctctacaaaacatttttaaaaattggccaggcatggtggcatgcacctgtagtcccagctacttaggaggctgaggtgggaggatcatatgagccccagagtttcagtctgcagtgagctgggattgtgccaccacactccagcctgggtgacagagtaggacgctgtctcacacacaaaaaaaggaaaagaaagtagagtaaattctctcatatacaaaagaaatatataagagataaatgtaagagaaggaattgggagtgggagtgtgtggtgtgggcaactactatttttgttaacaaatctagaaataccatttgaattttaagattataaatatttgatataaggaaaaatttttaagttttaaaaagttattcactaatacaagtggtagtaagtggcacgactgtcactcaaattccaatctgtctaaatcttgaagctttaaaaaattgttatgactacagtacactacagcaaagggaaggaaaagtcaaatattacttcaaggtctctttcctgggagactacaagaaaagttgcatgcagaaatcagtgtaacaagagcaagaagagttacgtaggattatccacatcctgcttcacctcctgcttcatagctcaggcaagcacttccctgtgctctgctgtgcacagccagtttatcagtgtgggaaaaaatctataaataggatggaggtttacataaaagagaaacataggaaaagaaaggggaataaaaaagaaactgtagagcgaatttgggggttaatgcagaggaaaaagctaaagtgagagacatcacatcagctgtgagagagaaacccagaaaatgaatggcaggggcatctgggacaggtttctcttggtaacaagttgaccctttaaatagactgcaagatgtatttgcagtttttatttggatgctgaatgaaatttcttttgagtataacaaccacatgagctcaagattttatttgggcaatgatatggtttggctgtgtccccacccaaatctcatcttgaactgtagttcctataatctccacatgtcatgggaaggacctggtgggaggtaattgaatcatgggggcggttacctccatgctgttctcttgatagtgattgagttctcatgagacctgatggttttataaggggcttttcccctgcgtcactccacatttctccttgctgctgccaggtgaagaaggacttgtttgcttccccttccaacacgattgtaagtttcctgaggcctccctaaccatgctgaactgtgagtcaattaaacctctttcctttataaatcacccagtctcaggtatgtctttattagcagtgtgagaatggactaatacagcaaattggtaccaggtagtgaggtgctgttgtaaagatacccaaaaatgtggaagtgactttggaatggggtaacaggcagaggttggaacagttgggagggctcagtagaagataggaaaatgtgggaaagtttgaaacctcctagagacttggagggctcagaagataggaacaggtgggaaagtttagagcttcttagagacttgttgaatggctttgaccaaaatgctgttagtgatatggacaatgaagtccaggctgagatggtcttagatggagatgaggaagttgttgggaactggagtaaaggtcactcttgctatgctttagcaaagagaatggcaacattttgcccttgccttagagatctgtggaactttgcacttgagagagatgatttagggtatctggtggaagaaatttctagacagcaaagcattcaagaggaagcagagcataaaagtttgaaaaatttgcaggctggcaatgcaatagattaaaaaaacccattttctgggggagaaattcaagttggcaacaaatttgcataagcaatgagaagaagaatgttaatcactaaaacagtggggaaa

SEQ ID NO: 332 - DNA, 1279 bp, Homo sapiens
aaatgtcaattgactcctctcactcatagttgtacaaattacagggcttttttttaattgtcataaaacatatacattattcatctattcagtttcatctgaagagaatccaacaaagaagaaattttattttccaataaaatattaaagctgctttaccccacaagagacagagcagaaattccatccatgatctatgtaagtacaaaactttttgcctatcagagcatgtgtgaatttaattttatgaaaatgtagacctgttttttcctgttatgcttcatagtacttgtgtatgaatatgtaacaatttcaatgtttttattagtttgtgaagccttggtaccatgatgacaacaagaacatcctgtgcttttcctagcaaatattgacttagaaggacactgttgatatttgtgctgcatccttaatggaaagcacgtacatattacaagatttgtttccctctaatgtaaatacagtggagcagaaaattcaagtggtgattatacacacgtcattacctttgcctctgggttatggattgaactagaacccaggttaaggtcatcatgacccccccccaccccgccccttatcgggcacttctatcactaatgaaaagagggtgtgccaagctcaacacacacacacatctttctaattaacagaatcccgctctgattcataaaagtcctatctaaaagggagggagaaatgatgttagcattgatacagaggtacatgtcagctcagtgcacaaacataggtaaattatgtaaggataaatctttctcttttccaggagacagttcaccactctccctctgtaaaaggattgtgggagacacataggtagtaaggagaaacctccatctatctcccaacgaacctctgtgtccccatgttccacccaactctccatgattgaataattaagcccttaagtagttaccatatgtccttaaatagttacaatcaacctcaaatgaaaacactcagcaaaaaaaagatgtgggatcaatgctcttggtccaaagataaaagatacattatgaaaaacataggaatgactttataaacaaaacagaactttctcaacaatcttattaaccaatactctttcatcgtaagtgatcacggttatttggcgtcagaagcaaaatatggagagatctttctgcagacaagtggagacaaggcacaataaagggagagttaggtgtgtaaagaaagtgatgaaatggacatactttagtgtttaattcataaggaagaa

SEQ ID NO: 333 - DNA, 8517 bp, Homo sapiens
ctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctggagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggccaatgtggtgaaaccctgtctctactaaaaatacaaaagaaaattagctggatgtggtgacgcacacctgtagtcccagctactcgggaggctaaggcaggagaatcacttgaacctgggaggcagaggttgcagtgagctgaaatcgtgccattgcactccagcctgggcaacagagcaagactccatctcaaataaaaaaaaaagaaatacaggacatagggaatgagtgaaatgacaacataagaaagcaaacagtcaaatctagaatgcagaacatttcatatgacaatcaacatggcttctgtaagccaatgtcaatgtaaaaaggggataggagactgctcttttttttttttttttgtttgtttgtttgtttgtttgtttgagacagagtctcactctgtcgcccaggctggagtgcagtggcaagatctctgctcactgcaaggtccacctcccgggttcacgccattctcctgcctcagcctcccgagtagctgggactacaggcgcccgccaccacgcctggctaattttttgtatttttagtagagatggggttccactgtgttagccaggatggtctccatctcctgacctcgtgaactgcccgcctcggcctcccaaagtgctgggattaggcgtgagccaccgcgcccggctgaggagactgctttttaaaaaatgtaaccaaatgtaatgtgtggatttgtttggatcttgagtcaaactaagtcatttttcagccaaggaaatttgattatggattgaatactaagaaagtatgatttaataagtgatattatggtaaatttccatatttcttaagagacattgaagttaaaggagtgaaatgatataatgcttggatttgatttaaagtaacttcatcaaggaaaaacaagaaggctgagtgctgtggctcacgcctgtaatcccaacaccttgggacgctgaggcgggcggatcacctgaggtcgggagttcaagaccagcctgaccaacatggagaaacccccatctctactaaaaatacaaaattagctgggtatggtggcacatgcccataatcccagctactcgagaggctgaggcaggggaatcgcttgaatccaggaggcggaggttgcagtgagccaagattgcaccattgcactccagcctgggcaacaagagcgaaactctgtctcaaaaaaaaaaaaaaaaaaaagaaaaaagaaaaacaacaaaaagagaaagtaaatgtggcaaatttgataactgttgcatctggtcatggagattctttgtatagttctacttttacgctgcttaaaaatgtttgataaaaccaacatggcatatgtatacctatgtaacaaacctgcacattgcgcacatgtactgtagaacttaaagtataaaaaaaaaatttgataaaatggttgggtgcagtggctcacgcctgtaatcccagcactttgggaggccaaggcaggtggattgcttgaggtcaagagttcaagaccagcctgacccacatggtgaaaccccgtctctactaaaaatacaaaaattagctaagtgtggtggcaggcacctgtgatcccagctacttgggaggctgaggcaggagaattgcttgaacccagaaggcagaggttgcagtgagccgagatagtgccattgcactccagcctgggagacgagtgactctttctcaaaaaaaaaaaaattcaataacacacatatatacccaatagataactcttcattttaagctaaccagtggttggactcacagtctggccccaacttacctttgcagtttgatcactcaacaataagactcagttctagcctcactatactatgtgacacttttacattggccactcactttaaggcctattctttgtgttcaagctgtttcttctttttttttcttccctaactgggcaattacttatctttcaaggactaggttagatgtgacttgtaagttttcaccaatcttttgttcatactactactgggttacctcatactgtagatactatcttcttatgccatggtaagcgttccttaagggaatatagcacaaaagttaagggcacagtttctagatccagactgcctgaggtcacatcctggtttagctactgactagctgtgttacctagggcaagtaacttcatctctctgtctgccttgggtaagtaacttaacctttctgtgtctgagctgtgttgccttgggcaagcaacttaacctttctatgcttccattatctcatctgtaaaatcgcatttacttcatagagttgtattattatttttatttttagagatggagcctcgctttgttgcccaggctggagtgcaatggtgccatctcagctcactgcaatctccatctcctgggttcaagcgattcttctgcctcagcctctggagtagctgggattacaggcatgcgccaccacgcccagctaatttttgtatttagtgtagagacagggtttcatcatgttggccaggctggtcttgaactcttgacctgaggtgatctgcctgcctcggcctcccaaatgagccactgcgcccagccttcatagagttgtattaatcttcctaaatgggtaagaaagggttcagaacagtttctgacacacagttaaatattcaacaaatgctaatttataaggttaggactctctttttgagacagggtctcactctgtcacccaggctggagtgcagcggcacaatcatggcttactgcagcctctacctcctggactcaagcaatcctctggcttcagcctcctgagtagctggaacaacagatgagcacaaccatgcccagctaatttttattttttgtagagaccggattgccatgttgcccaggctggtctcaaacctctgggctcaaacaatcctcctgccttagcctcccaaaatgctgagattacaggaatgagtcactgcactcagcccaggactatttgttttcatattcctcctcacacccagtttagtgtctggcatgtagatgctcagtgaatgattgatttgggtagttttggttctttatacgggtcttcaggttagtcccaatgtactggcatggagctagttacttgagcaggtcttcacaaaggtctgagtagcaggtgataaaaggggttgtgaagtctggactcctaacttaagtggtggagatgctaaaagagaaacaaaggcagcagagttgctgagggtagggagtatggcatttattaaccctgtgtttcccccgtcactggtcactgctcttgactcgtagaacaacaggtacagaactgcaagggatcatccccagctccgtgatcaccagatccacaagctctgggggagtcacatcatagactagattcaacaaccgtagggatgcgtggttctgccagttagccagcgcaacatgttctccccgcttacattgcagatcatcagggtcatctgcaatggaaggcgtacccattatgttctttcagaaaagaagttctagtttatccgcccctctccctccctctcaagtcttcacaggtagctggaggcttctcttttgcctccttacctagctcattagagacaaaggcatcagtctgcacacgctcacagaacttgtatgtttcacagcaaaccagcactggtacattatgggctcgagccaccagggctaactgtgctgtccctacccgtgacatcacagacccgttggccaagagtgcatgagctcccaatagcaccttggaaacctgtttcacaggagaagaggaagaaaaaaatgtcattgttgtatcaatgcaaaataaggtcccctacttacaggacagcaacattaagacaagtaataaatctcaacacctgtgaaaagaagggaaagaaacaaaaacagacaacaagtaataaatcttttttttttttttctttgagatgaagttctgctcttgttgcccaggctggagtgcaatggcgcgatctcggctcaccacaacctctgcctcctgggttcaagtgattctcctgcctcagcctcccgagtagctgggattacaggcatgcaccaccactcccagctgatttgttgtatttttatatttttagtagagacggggtttctccacgttggtcaggctggtctcgaactcccaacctcaggtgatctgcccgcctcagccacccaaagtgccaggataacaggcgtgagccactgagtccggcaattaataaatcctttttttttttttttttgagatggagtctcgctctgtcgcccaggctggagtgcagtggcatgatctcggctcactgcaagctctgcctcctgggttcacgccattctcctgactcagcctccagattagctgggactacaggcgcccaccaccacgcccggctaattttttgtatttttagtagagacggggtttcactgtgttagccaggatgattgtgaactcctgacctcgtgaactgccctcctcggcctcccaaagtgctggaattacaggcttgagccactgtgcccggcctaataaatcttaatgatggcttttcttctgtgaaaacacctgaccactgacccaccaaatctcccacaggaaaagtaaactttgaagttacttttgtcttgttccctcttcctggttgctagtttaatgtaatgtttttgcaatagctagactgctgtaatatactgtcagtgtttttccaattaaatagaaacagagctatataattattttttttgacacagggtttcattctgtcacccaggctggagtgcagtggtgcaatgacagctcactgtagcctcaacctcctgggctcaagcagtcctctcacctcagcctcctaagtagctggaactacatgcgcatgccaccatgcccgggtgtgtgtgtgtgtgtgtgtgttcaagcagtcctctcacctcagcctcctaagtagctgtgtgtgtgtgtgtgtgtgtgcgtgcgcgcgcgcacgcactcaagcagtcctctcacctcagcctaagtagctggaactacatgcgcatgccaccatgcccggggtgggggtggggtggggtgtgtgtgtgtgtgtgtgtgtgtgtgtgtgtgtgtgtgtgtgtgtacagggtctcattatgttgagcaggctggtcttgaactcctgggctcaagtgatcctcctgccttagtgctgagattgcaggcattgagccatggcaccaagccagggctatataattctaatatttttaaataattgtggctgggcacagtggctcatgcctatgatcccagtactttgggaggccgagacagggggaactgcttgagcccaggagttccagcctgggcaatgtagcgatatcccatctctacaagaaaaataaaaaactagctgggcatggtggcacacaccagtagtcccagctactcagaggcggaggtgg

SEQ ID NO: 334 - DNA, 755 bp, Homo sapiens
acctatctgctctctggcctgcgtcagtggtctacagcagttacacacaggcagtggtatctgtgagcagctctgtggactcaaaggttttctccctgagaggcatgacccaggccagctgattcatcagaatcagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccgggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggccttgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggt

SEQ ID NO: 335 - DNA, 2317 bp, Homo sapiens
cctaattaggagtcactgaaaacagctgtgcttttgtaaagccctgcaaactgaagctagacaacttaaacttcagaagaaaataacagcaacctatttacacgcataagccactttcatacctgcctactgatgtatggacttcagaataacgtggcctatgtatattttccaggattgttcttttgtttgttgtttttcacccttcctccccctattttctcttcacaagacatgggagttcacagccttctaaaaattagctttcctaataacttgggacttacctgtctaggaataaaccatcctagcatgagcgatcagatgaaatctgggaccaaagactcatttttcttctaaaatgctttctccaaaaaaaaattttttttaaaaaaaagaaaaggaaaattcaagctaggaactacttaagacaaacttgcctcccattctattcaaagtcatccctctgctcattgagataaatgtgtatctgactgcctccttaggaaaggtaaatcagaaactcaaaagaatgcaaccatttgtctcccacctacccgtgacctggaagcccccttcccgcttcaagttgtcccgcctttccgaacccaaccagtgttcattttacatatattgattgatgtcttatatgtccctaaaacgcataaaaccaagctgtgctctgaccaccttgggcacatgttgtcaggacctcctgaggctgtgtcactgcgtgcgcatcctcaaccttggcaaaataaactttctaaattaactgatacctgtctcaaatttttggggttcacaaggtttagttataaatgcttcttatggagcatgattttcttacaagcgaggcaggagaatcggatctggaggcagggaacctagggctgtttcacgctgacttcctagaactaaattgaaagtaaaaccctaacttcccacaccaagtaacaaaagaaccagaggcttctccctttccaaacccccaccttttctgtgtggcagatgggaaattgaaagtacctctgattggttgcaaaaagcaaaattacgctaagaagtaagttatcccttaaaaaaaattattctttctgcaaccaatcagatcttcccataggagtgtaactatgtaacttcaccatctgattgcacgccacgtcttcgtttgcatataagggcaactttgtaacttcactttagcctttcattggttgcttttcacagccaattgtgggtcaccacttcatttacatgagatgagtaccaagtggccaataggagacttcaatggggtattagggcccctgagctgctgctccacaccccaaacacaggagtgtcctttcattttcagtaaatccctgcttttggcggggcatggtggctcatgcctgtaatcccagcacttcgggaggccaaggcaggtggatcacctgaggtcagcagtttgagaccagcctgaccaacatgatgaaaccctgtctctaataaaaataaagaattagccaggcttggtggcgcatgcctgtaatcatcccagctacttggaaggctgaggcatgagaatcacttgaacccaggaggcggaggttgcagtgagccgagatcgtgtcactgcactcccgcatgggcaacagagcaagactccatctcaaaacaacaacaacaacaaacaccttcaaggtctggcgtggcggctcacaccagtaatcccagcactttgggaggcggaggcaggcgtttcacctgaggtcgggagttcgagagcagcctgaccaacatggagaaaccctgtctctactaaaagtacaatattagctgggcatggtggcgcatgcctgtaatcccagccactcgggaggctgagtgaggcaggagaattgtttgaaccagggaggtggaggttgcagtgagccgagatcgcgccattgcactccagcctaggcaacaagggcgaaacctcatcctaaaaaaacaaaaacaaacaaacaccttcgggctttgtgagtgctggtctcagaaaagcactcagtcttcctccaagggctaacttacttcttcaggagttgggtgcctttgagaaatttcccaaaccactacagaggaacaacttctcccttcgttcaccactctaccaagcacttggcttttgtaccttattgcaattatttatcttctaatcttctagagcctagagaattagactgtaatgtgccttaaatgcagaggtttctcttactcttctctggagcaatgcagacgtttgttggttgaaggatcaaactccaaagtccctcccagccttggaact

SEQ ID NO: 336 - DNA, 3210 bp, Homo sapiens
agtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttgggggaggtaaaataaaaataaaataaaataaaaataaaccataaaaataaaaggaagccaggcacttagaggagggttcaaaggaggtggggcagtattagcatgtaaaaggatgtgcccgcctactctccccagtcacacaagattgtcatgcgagctgaagggggctgaaattattccctctgaagaagaagaagaagaagaaaacatactgcagctcccgatttgaaacatcatatttgaaaacaaggtggggccttcatcatatgcaaccttcatattttagggcctgcctctttctattccttgacataaaccggactcttcatgctaatcaggctggaagtgtatcataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaa

SEQ ID NO: 337 - DNA, 1806 bp, Homo sapiens
ctaccgcggtcgctgttggtggcgccgccgggcctgcgactaggtggcatccttcagacactataggccgtctctgcacacgtgatgcggggctcggtcacgttgccccctggaagcttgaggatgcgccaggtttgactctgcagggcgtacgcgctttagggatggaaggaagaggaacgcggcaggaaggcgagccccaaggtggagaatcgcctgggcgcgcaggctgcggcggcttcgcacagccgccctgggcgctgcacgggtccgcgcgcaccctgctgcgcacccactcgcggccagctccctacagaggagtggagtgactgctcgactaccacccctcttttagtgtgagcgtctggagtcctgaccgccccagccagcccagctacgatgaactgtctaagaggatgtggcaagacccagaagtatgggtgaccttatgtcagaggaagtggctttcttattgcagcaaaaattcccgtaccaatgtcagtgctaggatggagtttcactgtgtcacccaggctggagtgcagtggcacgatctcagctcaatgcaacctctgtctcctgggttcaagcaaatctcctgcctcagcctcttgagtagcctgagtagctgggactaaagtatgaaagttttcaagacgcctacaagtggaaaatgcactcctcccagccaaatcaagcttcgccagattccttacagctgtgtgcagtgaaatgactaatgaaagagccctctgctgctggtggaactttcacatatggcactgttatgccactcagcaggacccgaccctggtatttacatattggatgtcaccccaaaagcccctgaccagggggtttccgggatgtaataagaatgccactctgggctttggaaggtgcaccgtatgcacacccatactatagggcaggggttagcatttcagacccctgttcctcccttgacaagcaagtgcttttctccagggaagacgttcaggttcattcatagatccattggtgccgtgggcagctcagtaacaatagctctgctgcctaccagctgctggtggaggtgttgagaatacctaatgaggaagtcagggcccctgcgtgcttcagcagagctggatgcctggcatggcaatcaatggacacaaacctttggataatttccgtccttggcggtgtgttctatagcataggtatgaagtgggtgctctgggagctcagaagaggggctcttctcttaacttatgggtggccagggaaggcttcctggagctcaaatgactgagtggagtcttcaacattaaaaaaaaaaaaaagaaaaaaaaagtgcttccctcccacccccagttaaaaaggtaatacacctcattgaaataatttaaactttacagaaatgtgttcctttaaagttcagagagtaaagaggaagtaataaagctgaaatagtagaatttctaattaactggagcctgtagctttcttcctgaaaagggagtggtgtgtgtgcatgtgtgagtgtgtgtaggtgaatctgtaaaggatggagtagtactaaaaagagggaggtgaagacggaggtgagatctcatctttgtgccctgaacctctttgttataatgtcaggcaatgagagaaatcagtactcaccctctatgggactctggctttttcaaacttggttttctaggttttggtcttggttattgatggcttgtaacttcagagtctcattgctggccacgcttccacgtggtttattaagatgttttcctaaacaaaattgatctctcccta

SEQ ID NO: 338 - DNA, 10095 bp, Homo sapiens
ggtgtgcgcccccggcgctggagcagccgcgtttcggggacccgggcaggcgtggggggctgcgctgagctccaggcctcctgcaggtagggatgctttgctgacagattcgggcgtcctcccctgaacgaatgtcctggcggggcgtgcccagccaccatccagcttcagaggcaatggccgggcgtcgtgagaaggggagggagaaggaagcggaagagagagagttggaaagactagaggaagaggtggccacgtcttttgccatcccagctttaaactgcagtgtttaaggcctcgtctgccctgctaaggtcaccgaactttttactttatgtgaaaagtgcttcccaagggaggcacagggactccggttctgaaaccgattaatggtcttagagcccccagtaagccgttaccaaagtgtccgggtcacagttgcagaggaagtgagaagcgtgttcgacctcatttgaaacggcttcacagagggtaaacctcaagttgattttgtaaaaaggaaagcctgtggtttggccgagaagaataaataatatattctagatccacgtgtagtgacttggtttgggaaaaaagaatccacagggagaggaacagcgcagagggttctgtggtctatcgcccaggctggcttgcagagaacggaattcaatctagttagtttaagcagaaagggatttgcggcaggatattaagtggtttacagactctttgggaagactgaaggatcagattccagactgatcttttaagaacacgacccaaagccaccctgaagaactaaagaatctaatgcccctcctcgaattcagcagacaccagtggcgtagggaaacggtggccacagctgctagccccagaaccatgccacctgcccgggtcggaaaccaccatgacaggcaattgatatagtcaagaaactcccccaagccgaaagctactgctagtgctgccaactctaaaaccgtgacacccctggcataacccacaccagcaaataggttccctgggcagtgctttttaatactccacaaagccagtaagtagacactgagacctctcctcccgctttcagagcgaaaccaggtaccttcacaatggtgcttgtcagcagaatattagaaacatgccttcctaatctcgcactaattctcctgaatagtggaatctaaatcaccgtagaaccctagatgcaagggagttggggaaatatagtaaaaactccagcgtcccagctcctacaatacatgaaggcatgctaggatgatgtcagcatggttgctggtgactcaatccgcagttcccatcacagtcctccacctggttactcaactcccatgcactcctctcttctcatacgtacacttccaaatggcaatgattccccctgcagtaaaacatggaactcactttcttcccaaaatggggaagtgccatgagccactgcatcctgctgtcacggaggttctatgttctagattctgtcctggtgttcattcgagttcagtcataatcctcccttgatatcttataacccgtagacctaattataaagtcacatcttatataaaacacatccaatataaaatgttaagggaaacggggaggacaaatataaattgactaggatagagaaaagaaggaaaacaatgctattacagtcctcatttttccaaggcttgtgagtctgaggttggactgttgagcatccttgctttatcctggcatgtatttcctttcaccatatccggcgcctctgctggttagtgctctttatctagtggagcaatctaagtcttttttcctgagaggtcctatttctgtgtggtctttcttgtattgagatgctgtagtcttccaccaactctgtgattggacatacagccttgcctatgattttccttgaggggttctgcagtggcatattctggcagtggtatgttcagtcttacatttttaaaataagacctaacattttaaaataagacaccatcgtatcctgattggctatggatgcttccagcactattagatctgttacggatccaagtggtggtaaagctgcttgcacatggcctgaaatttttgtttttgttttttaagacagtctctctctgtcacccaggctggagtggcacagtggtgcaaccatacctcactgcagccttcaactcctggggctcaagaaatcctcttgcctcagcatcctgagaagctaggactataggtgtatgccaccatgcacccagctaattaaaaaaaattttttttgagacagagtcatggtttttttttgcccaggcttgtcttgaacttctgggttcaagcgatcctactgccttggccctcacaaagtgctgggattataggcatgagctaccatgcctggcctgccctgggattttctcaaagctggcagactaatgggttattcagaatatgggtcagagctgcacacacacccacatacacacacacacacacacacacacacacacagtacatattggttccccaatccagagtcgtatcaagtgctatagctctttattagcagtagggggtgcaagattcagagagatatcccatcgctcaccagatcactgggcacagcaattctgctgagagagcaggttcttgaattcttgtgacacaacattccactctttggcacacatgtaggcacataatgtacttgtttccgctcactaggtgcaataagaatcgtattactaatgtggtgtcctctggaatggtcacatgaacacagttccctgcagatgtaattgggagagaaggcacagtcctgacacagggtaagactgtggaggtgtattgctgtccctaccaggtaaaataatattgcttctggtggttttattgggaaagagacaacacatttaccaaactgatagctgcatattgggtgctgggggctgtgttgatttgctacagtcataaaactatgtctagaacaaaagctgcaatggaagccatctattgactaaattaacagtgaacccttattatcctccaacagccatatgtgttctacataggtgaagcaggggagttaagtggccgtaataggaaatgtcatctctacatcttttttgtttgtttgttttgtttttttttttagacagagtcttactctgtcgcccaggctggggggcagtggcgtgatcttggctcactacaagctctgcctcctgggttcatcccattctcctcctcagcctcccgagtagctggaactacaagtgcccgccaccaagcccggctaattttttgtatttttagtagagacagggtttcactgtgttagccaggatggtcttgatctcctgacctcatgatccacctgcctcggcctcccaaagtgctgggattacaggcatgagccaccacgcccggccatctctacatctttcaagtctttggcagttcattcagggatgtgatgttgcttttgataactcttgataggaagaagtggttccagggttttccacttgctccttcttacctaaatagtcctcacttcctgggccagggatgagtgtggggattctgtagctgggtgtttctgcatacattcatagagtttctgcatagagagtgctctgcattcagaaacccaggaaatgctacaggataagtttatagacctacaaggtacatcatgagaagcacgtgagccaaaactccacttatcacttgactcctataaccccaactctgaaagcagagttcaagcaactgttgcgtcacctcttgctacagagcaccagggtcccaccttctgatgtgaatgagacctcctgtgcttcaagcccagccaagtcagataacttagtggtcttcaaatttttttctgcatacactcctgaagacaatttagaaaaaatttagaaaaataatgtacccttcacccactttttttttttctgagatggagtctcactttgttgccaggatagagtgcagtggcaggatcttggcttactgcaacctctgcctcctgggttcgagcaattcccctgcctcagcctcccaagtagctgggactacaggcatgcgccaccactcctggctaatttttgtatttttagtagagacagcgtttcaccatgttggccaggatgatctcaatctcctgacctcaccttcacccactttttaacttgacatctcaccttttcctgataagtgtaaatagttgaaatggatcacagaacattagaagtttaaaaaaagctaacatgacaaaacctaagaaagagatctttttattgaagatctgcctgattcatctctattatgtttttacgtagactggcttctggttgtgtacatttccaaccttatttcttctctactgtccacacattcatggtgctggtcaccacagaaaatgaatatcacagcatgacttctggtcctcaggaccgtgggcagagggagtatttctagaaatcatttttacactagaggggctagcaataacataatcatatgtggaagttactgcaccagtaaatacatcctctgaaaccccaactaacttgtttatcccaattcaattagtggactttcaaaagcacccatggccactgcaatgccaccacacatggggagaagaaagacaaaggggagtgtaaaaagaggtattaatccttaaggttgaaaggtcttactcttgtaaattttactaaaatatgtgacccagaagagccatttctaggccttgggggtggcctgtgctagtgaaagcctctgaagattggggtttgttagctacggggtgaatctaccgctgcactgtcaatagggacattatgataaaaatgtcatgtaactttgtgaaaagtatccatggagcctaaacactataatgacatgctatccatcatcatttactttgaaatatttgaacaatctctttaattttcgaaaatttttcaaaattttgaaaatttgtctttttactcttgaacatataaagttccatttcactttcttcttaggattccttcataatgtaatgtgtgtgtgtgtgtgtgtgtatgtatatatatatttttagacagggtctcactctgttgctccagctgaagtacgtagtgcaatcacagctcactgcagctttgaactcctgggcttaagccatcctcccacctcagcctcctgaccagctggggttacagacatgtgccaccacacccagctaattgctttttcatttcttttgtagagatagagggtctcactgtgtttcccacgctggtctcgaactcctggtctcaaacagtcctcccatctcagcctcccaaagtgctgtgattataggtgtgagccactgtgcccagcctaatgtatatttttaacagctttattaagatataatttatctattgtacaattcacataagtaaagtgtgctattgaatggcttttaatatattcacagacttttacatcgtgaccacaatatatgttagaacatttttatttcaaaagaagccctacacccctcagctatcaccccggcaattgttccatctccctcaaccccacccagttctaggtcaccattaattcactttctgtctctatggagttgctcactccaagcatttatatgtaaatggaatcatgcagtatgctatcctttgagactggcttccttcagttacaaggttcatcctatacttacgcttgaaacatttattaatcacccttttctgcaaccaaaaatgtatgtgaatcgaaattgtaaagtgttctttatttcctgccaccaaaagactttaggaatttaaagtattttctgggtcatgattacaatggttgttatcatgcaacttatgaaaacaacataaatgttataaacgttgctaaaaaaattgtgttaattcaaagagtgaaattttattggaaatgtctcacttacatgatgagtttttaaaattttctctgtctttctctctctcgggatctcactttgctgcccagcctggagtgcagtagtgtaatctcggctcactgcagcctcaaacttctgggctcgagcgatcctctcacctcagcctcctgagtagctgggactacaggagttcgagagcaacctgaccaacatgtgaaaccccgtctctgctaaaaatacaaaattagctgggtgtggtggtgcacgcctgtaatcccagctattcgggaagctgaggcaggagaattgcttgaacctgggaggtggaggttgcagtgagccgagatcacgccattgcactccagcctgggcaacaagagtgaaattccatctcgaaaaaaaaaaaaaaaaaatgagccgggcttggtggtgcacgcctgtagtcctggctacttgggaggctgatgcgggaggatcgctcccagtccaggaggttgaggctaccttgagctatgcttgcaccactatactctagcctgggccacagagtgagacttggtctctaaaaaaacaaaaattaattaattaaaaataaaataagataaaaaattaaaaacaaagaccataaatgccatgagttatgtttgttttttctaaaattttattcccagcatagggaataaatgcagaagaggtgcttcataaatatgtactgaattaacagataaaacgagggttcataataagaacctagactccttggagggtccatgagaaggtttttctttgtgtctgcgtgacaaattgtcagtcccaggatggtgccagaagtaaagttgggtcattggagggtgactttgacaacgtctgacatctgcagagaagaggcagatgtttcgatcacctagccgacactgttcatgacgtcaaaggccacggtggctttacagctacaatctcaacagcaacaagaatttaatgagggccgattatgtgcaagatactatagtaagtgcttaatattcattatctcatgtaatccttacaataggccttggggtagcttttattattcctatttataagtgagtaaacgttgtctcaggtaggtaagtgaccaacccaaggtccttggattagagcctagttgaattttcacttgagccatttactctggccacagaataggaacattggaaggaaatccagaggacttggtgatatggtttggatctatgtccccacccaaatctcatgctcaattgtaatccccaatattggaggtggggcctggtgggtggtgattggatcacagggctggtttctcatggtttagcatttggtactgtatagtgagtgagttctcatgaggtctggttgtttaacagtgtatggcatttccccctccttcttcctcctgctctggccatgtgaggtgtctgcttgccctttgccttccaccatgtctgtaggcttcctgaggactctccagaagccaagcagatgctggcaccatgcttcctgtacagtctgcagaactgtgagccaattaaatcccttttctttataaattgcctagtctcaggtatttctttataacagtgtgagaacagactaatatgcttgggctctggacccagctctgctgctgcctgccctggcttggtggacgtcgccagcctctctcctgccctgcccacaaagagaagtgtacttcccagccactgctcggggacagtcacgcggccaactctgcccaacaggcagtgagtggagatgacttgtgctctgtgtgggtgaagcactttgatcgctggtcgcctccttttctctcaccgtgagacggaggagacacgtgttcgccagcctcccagatgagaaggccgtgtgctttgatgctgtggctgtaagatgaaagagcctccatcctaggtcccaaacagggctgtagagcagaattttgtgcaactcatgttggataccatgtgagcaagagcacacgtgtatgttgaggcactgggattttaggattgtttgtcaacataggtaacccaggttattgtgactaatgcatttgatccactcttgttaatcctctaagtatcggttttgccatctgtaactgatgataataatatctatcagccagctatctgggggctgttaaaagagataagggaggaaatggttccctccaggtctaacattctccagaaccatctagcttagtgaaatggcatgctctaaaaatagagttttcttcatgaccattgtattatgtgcttaaggtcttaagatctgaccctctgtattcgcagatttgatgacaaagagccggaactagagatgtccagggcttcctgtggctttgggttgggatttttccaagcttctgtcagaggtcaattctgttattttgagaaaggtgttgcagtgagccttgtttttgtctctccctacccttgtaatgcaaaatatgggaggtatagaccattcccaaagctgccctgtgggttattaaatagtgactgcagtcagggctggtgtggaagacatttcgcaagctccctaatatttttattctccccttcttggacataacggaggattacatttctccaacttcccagagccttgctttggctaatgagatgggagtggcagggacacaggtcacttttgggtggaggcatggaagagctgctgggagacttctatgttctctctacccacagcagtgaacttgaagactgtctggggagatggccatgacctcagatggtgaaactctgtcagccgaagtctctgactggctgaggtgagcagagcacccttctgcagaacagctgtggacatgtggtgtaggcaggaagtcaaccattgttgttttgagccatggagatttggccattggttcctattgcagaataaattagtttgaactggctaattccattaggactgagacaaaatagcaatattagacctctggactgggaggcagcagtcttggattttaggtctcactgggggaaccatggacttggtctccctgggcttcagcttcctcatcagtacataaagggaaatgaactacattttctctcaatcatctgatgattctaatagtttctctatttgtctctctctctctctcttactcttttcctctccttctctcatccatccactcacccttccacctatccatccatccgtccatccatccatccacccatccactcatccatccacccatccactcatccatacacccatccactcatccatccatccacccacccatccactcacccatccatccacccacccacccatccatccatccacccattcatctacccacccatccgttcacccatgtactcatccatccatccatccacccaccagtccactcatccatccaccgacccacccatccatctacctatccactcatccatccactcttccacccacccatcagtttattcttctatttacccatccttccattcacccatccacacacccatcaatccctctatctctttatttattcatccatccttattctaaagaccaaagcaagtgactgaatcatgatattttcacaaaattcaactaatattttacttaattaacatcgtatgcaaaagttaccttaaaagaagaaagcaaacttatcatgaacttttccttagatgacattatttctgagaggaagaagaatccaacattttcattgtgagaaaaccttttgtttctaaggtgggccttgcttcattttgtttgcacatagaaagaataaggagctcttgagttggggtcagacagctggaaaagatatttaatcaaacatattctaatcaaaatagttttgcttcccttcttacatcaatttactgactcaaaaataaacttcctcttattgaaacttgattcctgacagatggagaaaaaggggtaggaacctggagaaaagatcacaactgagtgacttggcaacctcgtggtgagagtctccatccaaaagggcaagcaggcaagaaaatgagaataagatttacaggagaaatttatatcatgaaagcaaagattggtgcaaacccacgtgtataacactttaaggaatctggcaa

SEQ ID NO: 339 - DNA, 4602 bp, Homo sapiens
gcaaacttcttggcttgtgctcggacccttttctcgtactccactctgttttggctgaggaggtcaaaagagaagagacgtgttagagggctgagctgcctggccctcacgctcgccccggagccagctgggcagaccaggctgcaggatgggacctcctgggggagggcagtgtggagctcgtcatagtaacagaagcagaagcccggagaagcagggaggcctgcgtggtggggagcccatgctggctctgacgtggctgagactgtcccgtggtctgacgggggcagaagggcagggaggagaggaacccacgctgggtgaacgtggtgttcaagggggacagaggggtcccgcagggctgcgaggagggctcaggcccagagggcccacgccagggcctgcaacatcgttgccgatgccaagtctggtcctaactagtaatcagcagcttctcttttctgtaggtctggggacagtcctaataaactgaaaacactgactgcttgccactgtttttgttaattcccaaaaatagacaccaatttctggagggtttttccatgaggctctcagccgcaggggcaaaggtgtgggaaggcaggcctggttgagaaggcgttgtgcccgagctgggcagtgcaggggcatcagcgaacaggtctggagctgggtagagtgaggctcagcctgcaagcagctgcccaggagagtggcatggcacacactgcccgggcaaaacaggtgggcgggagggcggccgaggctgcacctaggggctgatgggtcacagggtgcagtgtgaccctgaggatgggggaacaccatgacatttatggaggtggctcctggggtcgcagtcctgccagtctcgccaggattggacctggtctgagacactgagcctcactctgcatggtggaacagcccaggacggcagcagcgccggtgccacccccacccacgccaagggcctggaccgcagcccagaccccagcgccctccttgggccaccagccggccccagggcagagcagctcagctgggtgggcgtggaaggaaccagaggcggtggctacacgtcccagctcttccttgaccaagcagaggccccgagaaaaggcacctgccagggcaggaacacggtccaaggcctccaggaaacccaggaaaaacgatctgaaacccgcacacatgcttcacaaagggtgcttttcaagcggatgtgtgtaggagaaagaacgtttgtttacgtgcacgcaagtgtacagtgcagcccagcaggcaccaagcccaggagacgctggggagagtcacacggggcgggggactgcaaccctgcccagcccacgccgcagatgggagccacagcccagctctggagatggtcggcaaatggggtgcaggccagacagagctcacgcccacaccatgctggggatggcagaccatctaagggctaggcaggaaaacatttgccttttgttttgtttttttgagacagagtctggctctgttgcccaggctggagtgcagtggcgtgatctcggctcactgtaagctccgcctcccaggttcaagccattctcctgcctcagcctcccgagtagctggggttacaggtgtgcgccaccacgcccggctaattttttttatttttactagagatggggtttcaccgtgttagccaggatggtctcaatctcctgacctcgtgatctgcccaccttggcctcccaaagtgctgggattacaggcgtgagccaccgcgcccggcatgcttttttttttttttttgagacagggtctcactttgtcacccaggctgcaatcttggctcactgcagcatcaaccacctgggctcaagcagtcctcccacctcagcctcccaaatagctgggactacaggcatgcaccatcatccccggcttaattttttttttttttttttttttaaagagagcaggtcttgccatgtggcccaggctggtctccaactcctgggctcaggtaacgtcccacagtggccttgcaaagtgctgggattacaggcatgagccaccacccctggcaaattttttaattttttgtagagatagggtctcgctatgttgcccagtctagtcatgaactcctgagttcaagcaatcagcccaccttggcctcccaaagtgttgagattacaggtgttgggccaccacacttggcctagaaatcattttccaggcacggtggctcatgcctataatcccggcactttgggaggcgaggcgggtggatcacctgaggtcagaagttcgagaccagcctggccaacgtggtgaaacactgtctttactaaaaatacaaaaattagtcaggtgtggtggtgggtgcctgtaatcccagctacttgggaggctgaggcaggagaatcacttgaacccaggaggcagaggttgtagtgagctgagatcacaccactgcactccagcctgggcgacagagtgagactctgtttaaaaaaaaaaaaaaaaaaaaaaaagaaaacattttctgcctcaagggccatgtggacacccacgagcactgtggcttcctgtccaagggaatgcatttcacggactcctagggcacagcaggccagcacacaaacccaggtcacgccacgtcccacgagccacttccagcaatggcttggctgactgagcggctatgagtttttttttttttttgagacagggtctcgctttgtcaagcaggctggattgcggtgctgcaatctcaactcactgcgcatcaacctcctgggctcaagcagtcctcccacctcagcctcccaaatagctgggactacaggtgtgcaccaccatgcaggggagccaggctgagcctggggtggctgctgtgatacttgctccctgcctggggcctctgtgccaccctcggccaccagggagggcaccttgcagacacctgggctgggcccgcatccagggagaaacacatctctccaaaaccacgtgctttttttttttttgagacagcattcctccgtcgccaggctggagagcagtggcaggatctcggctcactgcaacttccgcctcccgggttcaagtgattctcctgtctcagcctcccaggtagctgggattagaggcacccaccactacgcccaactaattttttgtatttttagtagggacgagggtttcgccatgttggccaggctggtctcgaactcctgaccgcatgattcacccacctcggcctcccaaagtgctgggattacaagcgtgagccactgcgcccggccgaaaccaggtgcttttcctcacgacctgtgcaggccgggcctaaggcaaccgggacccctcagcctcccccctcctgaccaggagatgcaccctggagggagagggcctctgatgcccacagtggcagggatgtgtggggtggctgcaggtgagccttctgggtccctggccattgggggccctgagaccccctcagaggtgtggggacccgtggtgagatggggctgggtttctcaacgctgcaggcggagcagtggggggtcggaggccccaacccaccttcttatggacctgcccagaacagctgcagagggaacaggacaggcgggcgcatggcctctgctcagggcagggtcctccctgctttccccagcactgtttggctgtcgtctgcatcctaactcacaccaggccctcctcggtgcagacaggaccccaggcccacggggacccttctagccacagcagcacctcacagggacagggtggaagcccagggtccgtgtgacagcatcacgtcactgagccctgctgggctgggcccccccacagaaggaaccaagttgtagaggggatggggacaagcagcaagggcggcgcgggaggctggggtccatgggaggctgagccggtggagaggcctctcagcatggcctcctctggcacccacgcccagggtccttcccctcctagctggccacaactcactggggcagtggcccaagacagcccgtcacctggcctgctccctccccgggacacggctccggcgccatccatgcccaccgcagacggtgtgcaacggtgcctgctgcccacagggtttatgccccccgaccttccccacagaggcgtggaccctggctgtccgtagggtgagcctgtgtcctccactcccgtcctgccaggcggccttggctgggacggggaggagctgccaccagcggggccagggctgctactaaccagtaaatcgtgtaggcctctgcttgagctgggtcttggatatttggttcatttagaagttcctgtattcctaataggatctgtgccagagacaaaaacacaagacgggtgtgagcagtttgaaagggagacaccgtgagactcggcctcagccacagagaatgaccacagacccacgtgtccggaggggagactaaggcagccctgccggtgccagaggcggaggccccgtacctgtttgattgtgatggctggcctccagtccttgtcctcctctaagatggacaggcacactgtccccgaagggtacacattcgggtgaaataatggtggttc

SEQ ID NO: 340 - DNA, 4105 bp, Homo sapiens
gcggcgggcgcagcagagcggcgggcggcggcggcgtcgtcgagcgacaatacaagcgcctcggaccgagtccccgaacctgccctagccaaaatggcggccgagaaagagcggaagtgacggtctcactctgttgtccaggcatgatcacagctcactgcagccttgacctcccagactcaagtgaacctcccacctcagcctcccaagtagctgggaccacaggtgagtgccaccacacccagctttttttatatttttgtagagacaggatctccctatgttccctaggctggtctcaaatgcctgtgctcaagccatcctcttgccttggcctcccaaagtgctgggattatagacatgggccattgtgctgggcctcaatttcttcagcagccaagttaagccaggaaaatgtagtaattaggaatactgttcaataaataatttagagacacctcttacttttatttccagaagaaagtcaacttaaacttacttgctcaaagcatgcccttactcaaattttaaaagatactacatgaccataacctatgctacagttagaaattaactgatctcttctgaaatacctactttagagaaagtgggtaaacataatatttgccctggctttattggatagcttagcccaaattttaactggcagaacacttttctaaatggagagaagagcttaaggcagagatttttcaaattagtagggatgtgagctttgctgagggtctttaaataatatgaaaacaagtcttttgagaaaaaaattgttatataattcagtaagatgtttaaaaattactgtagcagctaagtttctgcctcagtgtcattaatatttttccttactgatagaggttattgctcaaaagagaaaaaaacggctatgtaatcaactgctgtcaaattgtttcccaattcacaatatgcattttaaatagacctgctttgatagatgaaatgtttcatcaattcaacagctgaaaagaaccgaactgtaaatgcctgctctaaatgtattttctagtttaagaaatttgagatacatttttaaggaaagggcagaggtgtgtatttctttttcaattcatacagacacagccataaacatttcatcagttaacattatcttacttctgagatcaattaggtataaagatctatgattccagtttttaaaaagactatttcaaattattccccatgtaaaaaattctacattcacatactctaatgaaggcagcaatactttatgcaaaaaaaaatatacatttatttataggtctcaatacagcaaaatgaaaacgaaaattgagaacattgctcattaggccagcaactttaaaattatttaatttgaaatataaaataggtggtcttcataaaaagatgcatgaaatttaccttaccttatattttatactttaagagtacattttatacaaatcagtaaccaggcttctttcatgtttaacctgaaatgaacgtaactataaatgagtatctttcttttatgtagtagcaaaaagagtcaataatcctttcaagaaagatactatttcatttcctcccaacttggattcaccataaacacgatccacaaatgatattggaacctagtttaaaaaaaaaaaagtaacgttagtctttaaaaacaattaggcagcttagccggtataccacattaccaacacaacagaaataggattagtcctacaacagaggtccttaaagtaagtataaaattaggggattatgaaagcaactgtgtgtatctccaagtctttaaaattaaacatgcattatctaaagataggtcacatgaaacaaatctgcaactgtttaaaaagcactgattctaggtattaccttggtttactcaagtttcagtttgcatttcaaggaaaaattatactccaaaagtaaaatggccttgtgcgtagatttttcacttgtcaaatttagctacaatggtttagcattaagtaaaatagcttgtaacttccacaagagaagtgacattccatagctattttcttgctctgaataagagttttactattaaatgaggagagtcttccctaccctaagagctcactaacgagccctaaatattacagatcaccacctccttgctctgtaattcctggtcttctcttactaacaggaaatggacatatggaactcatcattcattttaaagtatggtggccattggcggtgacaaaaggaaaagaagcaaagagactcagtccataatgctgattagttagaagaaagggctaggattgagaaagtaccaggaacttttaattatttaaaagagaatgctgactgttaatgttttaaatcttactgttcaaatgtactaatatgaatttttaccctttgtgcatgaatattctaaacaactagaagacctccacaatttagcagttatgaaagttaaactttttattataaaaattctaaaccttactgctcctttaccaggaacatgacacactatttagcatcagttgcatacctcgccaatagtataattcaactgtcttgcccgaacaatcatctccatctggaagacgtagcctttagaaacacatttttctattaatttctctagaacttcttttcggtataatctgtaagaaattaaaaatatatatcaacttctggataaatacacatgcctatgtatcctgacctttcaaagagttcactggtatgtataaagcctaaaactttcactggccattggtaaacagaaaagctcgcacacttgatgattatgatacatttgtcctaagcaagaaaggccattaaatatttgctaaataacttagaataattgtgaaaatgaattctcagttatctttttatagaattattttcccaccatactatcagaaattagtgaaatacggtaaaatgaatcatttgatgcagaaccatccattatttaagatttccctaaaatttaaagttgaaagaaactgttccaaatattgaacaacagggtggacagatgatcatgaagcaactatatatgttagatgacaagaaagaacctcataattcacagtcattttccaataaatgtttatgatgagttttgatttctcatgatttcctttataaattccccaggataaactaagttgctctaggatgagcttgggaagctaggttaaaacaggaacgaggcatcacaggatagaaacaatcctggtgggattcacctatcaccagttgaggtcacagttagacacttaacagtgggtgaatgtgcagcctaactttagatggactgcaggccaaacaccagatttacaaagacagcggagttgggcagtccagtgggtagacccaagcactttcttcagtaactaaatagcagggagctccgtattttcagagtcacacttttttttttttttttttaaagatcagtgtctcagttcatagggaggcagcaatttctacctttttttgtggggagaggggagaaagcaagaagaggcagtttggtgtaactttgttctcttcaaagttaaggccatctggacctactgtgcctcagggtttcaccctgaatccacattttttttccctcagacttctaaggcgaccttatcttttgactatgaagtgggtataggacagcacagcccttagaaaaacctgacagcttagtgtgtgcaatcctttatccacatagtttccttaaggattcaaaggaatcaatttggaataaatatggagagaggagaatctgatggtagcaatatttattcaataataaatatttattgaccaatgtactgggtttcaggttttttttttatgttttggggttaagaagtgaacttaaaaactcaatgaagatatataatatgtcagatgctgttaggggagggagcactgggattgtggggtgggaagaactatgatactgatgggactatgtttccacattacctttatttatatatttgtatttttggagacaaggtctcactctgttgcccagagtacagtggcacaaccatggctcactgcagtctcaactttccaggctcaaaagatc

SEQ ID NO: 341 - DNA, 3253 bp, Homo sapiens
gtggacccaggtgctagtccagactcctccccctcaaatagacgcagcaaggggacctgacttcagggagcctccagctggtactggagccctctgccaagggtgaaggggtaaagtcagggaagagagtcgacaggactcctgctcgagcaaagcagagaggagcagagaccacagcctggcagagggactccccagatctctggtgagtgttcccccagcctggcgtagggcatgccccagttcactttcgcctgcttctgtggtctccacggcttctgcaaaatgaagaggaagaaggaggaagttcacagagagcgggagacggcggtgtgatcagaaccagggcccctccatcaagcccccagcaggtcccaggcctgatggtgcctgcttctggctggggcttggagcaggaagccgtgtgtgtatcttaagtcttgatttagccagtgctcttctcagcctgactctcacccgagggcatcagcctcctgtgtgcctctcatcctcctcatgcccacacccattagcttccaattctcagacctccttggagagaggccccagccacacaagggggaaccccaggacctgccgcatgccttccagagactgagaagccccagggaggccaaggagtgaaacttctttcctgccctgagagcttcgggggactcttctcagggtaaccgcatgaggcatgtgccgccttgggctaggagagctgttgctaaatgggaaactggctgctctagcagagaacttccagcagccctgaccctggagaaggcctccagggcggaagtgtgagactctcctgggattccaggacctggggcaagaatccttttccagccccctgccagcatcctcctgggccaggtggggccaggcctgaggtggccagcccagtgaggaggaaggcagaggtggccagtggctccgtggctccctctgttcttgctctccagaaagcagtgtttcctccagccccggccctgacccacccgtgttcatgatgcctgtgcctccttgccagcatcacagatgtggggaggcctgttccccaggccctgactcccctcctcagggactgtcttgccgtggccagactgagggacccctttcctggactgagccgtgccctcccttgattctcctgtctcccctgcctttttcttctctcctcagaagccatagaggggactgcgttcatatgtggtgccttcagtggaaactcttagggtggggggacctctaggaccttcctcgactttttccctcatcccccacccccgccaaccttccagcttcagcctctgcccttacccccagcccatttccaggaggtaggaagcaaaagaaaaaagcatttccttccctctttccttcttccttccttcctctctcccttcattttggtataacttagccttttgtctttaatcctggagttctccggggctagaagacaggcagagacgaatgccagcagcagagatgcttcaggcagattctgtaagcctgttctccctcatcagggagcagctcagccaaggagcaaagtcagaccccctctagctccccagggacagaatagcccttctgacaggtaaacaggtgacctgggtagagagggcaaggccccaagataggagagtcagggctcccctttccttggaatgtgggcctctctgggcaactagggagggcaaaagtcttcctcggctggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggacagaagaaaaactccctggttctttgtcctcttggatagtagaggccttgggtgaggcaaagagatgggcagaaaaagttaccttgatacagaggccagagagcctcctggagggcatgtgtttccctagcggtcacctgcgaggctgcaatcctagaaaagtcacttctgtggcagaggatgaaattgtatccccggagactcagagatattgggtgttatgtcctgaccacacaggctcaccaggaggaaaggttaggaaagtggagaaagtacgtcctggggagcgggtggccgaggagagctttccccttgtgcgcctctcaggccttggcagggattgcagctgcaggggtttggcagtgagcccatccagagagcttcctcccccgggagaactcccttggctccagagggatactagatatcttgagccctggctttgggaacatgggtggggtcccaaggtcaaagtgttctgagtggaggtccagttgtcctctgcctccaagccggcagccccttcttcacccagggctgaggttggggccagcactgcagctggaattgtctgagcaggaggtagcagcttctagccaggcacaccccaaccccacattctattgtccctcagtttccttctcaggaaaatggggactttgctccttttagcatctcaggaagcagtctggacacctgtgccctcctctaggcccttggatgagcccagggaatagggaaaggccaaagcagccccagcattcgcagaccctgcgccctgggcctctgacttcgggccaggcttctgctccttctagggttggcctggctgccctgccttcccatcctctctccatggttctctcccagagactccaccttgaggtgggggccctgagctcttggggtgagggaggggcacatgggtagatgattctgtggaggagatcaggcctcttgttcttgctgcgtggcactgattcctccttgcagatgggtgagggggccagttttccccatctgtaaagcgaggacttcccatggccattttccctcttgggcttcaggctgctgaatggaagatcaagaagtgtgaagggtgcttggggtccttgtgacttgagtgttgcctaggaccctggcccacaggacccaaggggcttcttgtctcaggttgaaacctttttatcagaatgtcatttccttc

SEQ ID NO: 342 - DNA, 7823 bp, Homo sapiens
cgcgtgacgcaccgcggggcctcgcccgggtgttcgctccgccgcctgtccgcggatcggcgctgcgagccccgcggctgcctgcgggacacctgagcgcggagggtgcggcaccttggcaccttgaccctgtggcagggacatctcggcccaggaaagaatgaggtttaggcacggcctaaccacctaagtgagggcactgaagctgccgggggaagggcaaggtccgcgttgcagagcccaagcccagtggcgcaggatttgttttggtaagaggggatttagcgtcccaattgctgcaaattgacacagttgcggacgtgcaagcgcagaagaaatttgtccttcctcaccccacagaacagaaacaactgtacacttctgctttttaacttacatctcctctgtcctccaaacctgtgtgtccagatgtgaaactcagatccccaggggctgtggtaatttttaaatctggggctagccccccccacctctaggccctctgtggctttggctcttggtcaagcttgtgtatttgacaaggccaggccaggctcttcaccaaagagcaatggccttgcagaaagaaaatctagcttctaagtttatttgccaagtatgtattgagtgcctttcgtgtaccaggcactgttttagactctgtggatacaaccgtaaataaaacaaaaacccggcattccgggcatagagcttaaatggggatggagagaacagacaatacatatcttaaaggtaaatagtctgttgaagagtgaaaagtgctattggaaaggggcggggtgcggtgggggagagtcaggagagaggtggagaggcaaattgcagaattaaatcgtgtctatgtaggccttattggtaagatgagagttgagccaatttaaataaggagagttcgctatgtgtatgattggggtgtgctccagacaagaaaaaaaaatcgaaggctctaggtgcgttgtgtgtttgtggaagattaaggcagatccgtgttgctggagcagattgagcaaagcagagagtagtggagagcaggttaaggtgatggaggggaaggattatatagggtcttgtaggtaattgcagacttttgaagggtgtgacttaaaattttaaaaggattgcagtgttgagaatccacctattaggaagctgttacagtgttccagtagagagatggcggagcctagaatcaacatggtgaatttggtgagaagtaagaggattccagctctattttgaagatagagccaatagaatcaaattcgatatgggatacaagagaaagaaagtcatgagggatgatgccaaaggcatgaattaagtaagttaatatatgtagggaacttaaaattatgccaggtacatagtaagcattcaattttattttgacattctcaactctaatagtaggggtgactagagcagtgacagtctacatatcagttttagcgtctagaatcatacagctttaagattttgcagttatgaatatttaccaaatgagtcaagtatttaagaagtttgcagtctaattggaggagataaatacgtgaaacacacttaaaatgatacagctccaatgagtggaagaagcaccagggctctcgtctcatgccgaattgggtaaaatgacacagacacacatggagtggttttaaggggtggagaatttaataggcaagaaagaagggtgaagaaaggaagaagctcccctgtagagacacatggaagtgggctccaaagcctagagaggaaacccccagtgctggggttaacaggcagttatatgaggagactggaagaggcggtgtcagatttgcatagggctcaggggattggtttgaccaggcatgtcattcacatagcccacgaaaaacctggctctcccaccctagccttttaatatgcaaatgcaggtcgccttgatgttctacacgtgtggcgatatgtggggatggccatgttgccagacacatacaggggcaagggcaagaggacagcggtggctatcgccatgtttgtgtggacccagtttctaatggcctgcatttgcatatcaaaggtcgccagccgggctctaagagcaggggctttcctgctagacaagaaacatttctggagctgctttaaaagagacaaaaactttccaaggaccccttttcctatctgcctaaaattatttttttaataaatcctataacagtaatccaagataacacattttgaaagtaacaagttatgtaatgtgtatggcaagagtcccatgagtcaaactcacagggtaatggctggaatgaggatgggacttgaaagatgagtagaattgaacaggaatgggcggaacttccaaacaaagcaaggcaagaatgagcgtggtgtgttgaacaacagggggtagactagcttgactaatttggaaggtatatgggaaagaagaaaaaataagttgaataaataggatgaggccagtttatccagggtcatggaaaaccaaaatgaggaatttcaaaataaggcaggttactgtggctacttgacatcatttttcaggagattgtgtgaaatagcagtaatgaacatgatgaatgattttgataaaataggcactcccaaagatgccaatggattatcttttccaccaagggatatcttttccttgccacttcccaggagggataaagagagaagattctaaggctaccttcctaaaactacatctttaggattatttttttgtttctctttgcgctctgtaggcttcattttaagacatcctcaacaaacaggtttattacagtgtgtatatcctggcattaaactgtatgttaggaaatatgttgaggccgttctccaaggtcacccagtttttagcttgatggtgttgctttccccactcgattctttctagcacctgtggtatctctcctccaggtccttttgaccccttgaacaaaatttctctcagcacctattccctccttttaaaactttctaccagaattatttaaattaatgaatgtttctggttgcctaatgtaacactgcaacgtgtattttcttaaaaatttttatatttcctcacattagtgcctttctctcagcattaccacacaaggctctgtgcttgaatgtcctatcaaggccaccataaaaatggtaggttcaattcattttggttcaatagacatattggtatttccgaaattaatatatgtcagattggtcttgacccagccatcaaagttattcttagagtcatacatatttttgaagttctttttttttatagctaactgaacaaaaccagattaattattgacccctgaaaaacttgttaaaaactagagattaggccatgctctaacttttcccattgagaatctttcttaattcattgtagtcacctttgtgggtgtcattttcttttgccgaaatttaaaagcaacacccagtttgtcaattacaggtttctgagaagcagatgccaagacgggattacatgtgcaggagataagagaaaatgcctgtgaaggacaaagggagaccagcaagagaaggcagggagactccgattggaatgcaggggagtcgaaatctgaaaaagcagaatgggaaggaagaataggttgaaagaacctgtttgtaatgtcattctgagagactcagccaggtcaatggggagtcctaagccaaagttgttcattagaggaattccaaattggtcaggatctgctgtgctcagtaactgtctgagagcagtgcaggaaaaacttagtccggtgcaaactcagtggtgaatccaaaagtgcagtaggcggagactgtaaatcaattcataataacattcatggtgtcgcttcatgatttctgtaaacctctctaaaaacttaggaaagggaagttaataggacaaactatcatcacaggtggtctgggaccacactagtacttaccctgtcctacactatccactctatattcccatcactctcagctctcacttcagcagatcttgttgacttacttggtggcatgacctaaacattcactcctaagtggtcttgggcttttgtcatcatactcttctcagtccgtgactgcagtttgtgtccattcacagttagaactaggtaagggcataccaagaggcacccaagtggatcatctgagtttcacatgtgtatttctccctgtccccaaggtgtaaaggtggccccacctcctcatactaatcaattatccttgcttgctggcccctggctgcaaagagccaaaagtgtcgtgctatacatagcttatagttcaatggattcccgctctacccctttgcaagagagaaaacctgtaattctactcaacccagagttggggaaagtgaagcacagagttctccagtgggttattaggagtgattttaaataaagccatttgtgatttcaccttttggttcctagatccatgtatttgccgtactagagacacagtgccatgtagaaatctctgattagtgcctatactaaatactgagagatgtcatgccatccttgcagattattgtctctgagctgctgatttcgctgtgacttaagtaggcttttccagtactctatgaggccaacttcacctaaatagtgcagtatatgataaaacaattagacctcatggacatggcctattcctgtacctccttttctataaagtaagttttcttgtggatgctctgctaggtgggattctgtgactagagaggcattctgctagtggtgccagctaaatctttgcagacaggaaaggccaggttctagtacctgctcaatcaaagcctggaagcagccaggggaagcgtggcttatcacgaactccacagtggatccaaaggtgtggcagctgaaggctgtcagtcagctgcgctctccacagcaggtgcttttgaggagagatctgagtggaacacttgtaaggctgccagagcaagacagtgactctcacaaaatcatatgaggagcgggaacatttgcagcgccctgctggagtaagaaatgtagaataaagagttattcaaacttagaatagtacttgaaggagaacctacctaaatttgtgaaagtctaaattataaacaatactgtttttaaggaaatgccttaatttacttccaaacaaatattctaatcttgagcatactaacatactgatattgaatcctggctaagggttttactataagttaatagaggaaacatttttaactagtagtatttatttgcctacatgtaatttgctcaaattttaaggacagttcatttaccaagacccctacattcataattttccacatggatagtgtaaaggcaacttcagcccagtaaatgtcaataaattaaaagacttttttcttttgattagtgcagtctaaagtaattctttttgcaatatattaaaatgacttgctcaagattcacttttcaaaggcattgtgagcttacttcctacagtctgagactgttacatatgagtaactatggattagcttgtagggccagcaaaataggtgaacagaaaatcagcctcaaaaaacctccatcctttgccaatttacttaaggaaaactctccatagccaaacactgttgctggtaataaaagctgcaagctgtcactgaattctgctttcttggcagcacatctcgatatactgattgataaagactcagataatcaaatcaagaatgctacaggtggttactcctcagaaaccttgaaaggatttaaattcattctgcttaaagtcatgccatacaggaagccatcagaagttgcctggtaaggatttaagaaaaaaggaattaagtggttatttgggtcataaattttagggcatcaggttatgagtatctgatgtatttatattaataattacagcttaccatgggccagtcactcttttaaatgccacagcaaatttatgaagtaggatatattattatcctcatttgcacatgaggaaactgtgcacaaagacgttaaatggactgccaaaaatcctaaagctagtaagtgccagtaccagtattcaaacctaggcagtctagctcttaaccgctatactatatcttccattgaaatggacagctggttattttgactaaatatcctaagatatgtttggaagggaattaccatcactgacctcttaaatctcctttttctgtacttccaagctgatcaactctttttttgtgaaagactcaaattgttgtgttgtattacatgaatcgatatatgggataattgctaaacattatagacctgagagtcattctatctcttttagaaatctttttctttattccataatggataatgacaaattcaaaagctttaggaagtaggcagataacataagtgagggagatggcttggtataagacaatttgaaatggcgagaactgtggcaaaccactactcactcgtcacttggctccagctgctctgtgcaaatgtggatccaatgttatcagatattttaaggccaggaatggtggcttatgcctataatcccagcactttgggaggccaaggtgggaggattgcttgagcctaggagtttgagacctgcctgggcaacacagtgagaccctgtctctaccaaaaaaaaaaaaacattagcgacatgtggtggcatgtgcctgtagttccagctacttgggagggtgaagtgggaagattgcttgagttcaggaggtcaaggctgcagtgagctatggttgtgccacagcactccagcctgggtgacaaagcaagactctgtctcaaaaaaaaaaaaaaaaaagatatttgaaattttaccttaagggtaagttattacctctgcaaatagctcatttcttcatcgtctgttttactctattcagtttcagagagagaccacagtcttgactttattttcaagttctgtgaatccattatttttagagcttttacctctttacagtctccatgtatatattcaataatgtaaaatatgttaacagttcattgtttggactgtgtcctttttacagacaattgactatataaaaggctgaagggcttttccagtatatccctagtactacaaagtacgttttggagtcagacaaatctgagtttgaattctgtttctgagacattaacttgtaatttcagcaagatgttttttcttcatctgtacaatagggttacttatacctcctaattagatgaggattaaatatatataaatacactgatcatagcagctgtcatatgcaaattctgaagcaaacaaaaaattaaaaaacaatgagttatcattaataagtcataaaggaaataaaggaaagattatatggaatcgtataaaaatactcaaaaagggccaggcatggtggctcatgcctgtaatcccagtactttgggaggccaaagtgggtggatcacctgaagtcatgggttcaagatcagcctggccaacatgggtaaaccccgtctctactgaaaatacaaaaattagccaggcatggtggcatgtgcctgtaaacccagctactcaggaggctgaggcagaaagaactgcttgaacccaggttgcagtgagccaagatcgtgccactgaactccagcctgggtgacagagcaagaccctgtctcagaaataaataaatgaaaatgaaaatactcaaaaaggacatttatatgtaactatatcaaaatcaaaaaggcgatttatatggaatcatataaaaatagcctaaaagaagtcagaaaaaaagaggaagaaaa

SEQ ID NO: 343 - DNA, 1838 bp, Homo sapiens
tttttgcatatacctcatgtgaacgaaaggacagaaaggggagtgaatatactatgaatgtgctatagtcggagttggggggcaaggaagaagtcatcgatgatggctcttctcaggccctccctcctcccacctctttctgccctccaccccactcccactccatcacctacatctatgaccttgcagcaaaatcattagagcagagcctacaaaaccggccccaagtcccaattcctctacttccttgttagaggaccccaaataactcactcagcctctctgagccccaatttcctcacctgtaaagtgagggaataacatctacctcgcaaggttgttgtgaggacgaaatgagagaacatgggcaaacatgaatgttcttgaattcaccaccccaggagaagccaggggtctgagctgggaggagcagaggttctgggtgccccctgcccctacagagcctggcaccttcagcttttctcaacttctgagggctgcttcctacaggccaaatctcccagccggaaccacttggtcagaggaacactcacagcagcctttcccagcacctgacctcaagggatatggcgtctaccaatttacataattgcctttgtcatcagttttcccataacatggtacgaagttaaatgagagcacctgagctccccttcctctgagtgcatttattccatccctccaagctgtggccttccatccccatccaagagacctgcagctgtgaagaagctcaagacttctttctcattgcctgcctcccagccattagtccccaccacagcccaggccacctggaaaatgggttccaaagcactatcactactaggtgacccctgaatgtggacaaggccacagctcttcaggcagcatttcaggggctatccagttgtcatccctctcatacccctctcctacccacccctatccccactattgtggaatgcacgaagggacagctggcaaaggcagtgaaccaagatgcagggaaggccctgtatgatggggaggatctaaagcaaaagccttttgtgcattgcctcaggttcagcagcagcagccctcactctgaagcctaccttgagaagccaggcatttctgtgaaaagctcatcagcatgcatttacaatgcaaactagaaccaactcccagtcagctaataacagaccccaggaaaaagaaaaggtcttccagacctccccgacacactttagaaccctcaggggtgaaaaagagggtgctccagggcagtgcaacttaaactgtggttgaaggacaaacagcctctgcaatacttgaggagcttgttagaaacccaaactcacagccccctccagacctacgtacagaatgtatattagcaagattcgctaggtggtttatgtgcacgttaaagtttaagaagcactgcctgagaatcccttggtcctaattaattcttttccacactcagatttgctaatgggtttcaccttatctcttgactcttgtttgatggcaacaggaaatagtagcatttcaggaagggtggaaaatataaaaagcactcccaacccaagcctccaaaaaacagcaattttcattttgtgtccatatattcccttctaatcattgtcctcatgcaagattttttttcataaagatgatctgctacataattttatatcatactctttctcctaacattacatcacaagtatactttcatgttgctgctacattcttcacacttgtcattttaatggccataaaacatgacatctagtgcacatatataattatgtagactcctattattaaatatttggatttcttcc

SEQ ID NO: 344 - DNA, 2036 bp, Homo sapiens
aacaaaaggcaacatttcctgagtaaagggcttgatatcaaccccagggaggatttctggactccagtgcagtgcctgctatgaagcacacacaatgcttatctgctgctccattggaaagccaatagcaaagaagggaaaggaccttctgattggagagtggaggaagaggcatcatctttgatcatcatcagattttacaactcattgttcccttccagtccacagggtgagagaatcatgtaaatggtcaaacaaacacttggattatagaagacacttgatattaataatgacaataaaaatgtttacctaacttggatagattttgtgtatagataggatgtgtgtgcgcatgcacgaatgtgtgtgtgtgtgtctgtgtgtgtgtgtgtgtatactccccccttactgggaaaggacatatcagaagatcaggaaatgcattacacaatttttgtatgcaatattagtccatttcttggcggagacccaaatctattgtggcgagaaagtaatagatgaactaactagggactcagacttactggctagtgtccaagaaacattaaaaaattgagtactgaacataacaagtaggatggtgcatgcaaatttagatgtcttattgaaaacagcacatttattaatatattagacttgtagacgtgagggtgttttaatacctactcagaaattactcatgggtcggcttcacagaaatatcacttgcataagtgtgagcttcagagaaatggtgccaggcatgagtgatcatggctggactaatctaaagaaaactggaatgcctgtagttaatgatactatattttacacgtaaaaatttttaagagggtagatatcatgttaactgttcttatcacaatgaaataaaaatttaaaaataaaactgattaatgggcaaaatatgttattgtcattgtcaaactgtcatctttcttcctaattccttagaaactgcttaacataactttatttgatgcctactatgtgtcaggctattttctaagacactagaaatatccagataaagtaaaaagattaaaagcatgattatataggaactacatttttgtcagatttatttaagatagcatttatgtacagtaaaatgtaccctttaaaatgtacagcttgaggagttttgacaaatatatacagatatatgaccatcactacaatcaatatacaaaacttttccatcatcccagaaagttcccagctgatctctgtagtcaatgccttcctcagacccccagcctctggcaaccactgatctgatgtttgtccctgaagttttgccttttccaaaatgtcatataaatgaaatcatacaaaatataaccttttgtgtctgttttctttcacttagcacaatgcttttggatccatcctagttcacacctttttatcactgagtggtatttcatttgtttatacattattcagttgatagacttttaaattattttcaattttgtcaactatggataaagctgctgcaagtatttgtatacaggtcttgtccattgtgtgggcttatattttcagtaggcaaatacctgggagtgagattgccaggtaatatggtaaatatatgttgaacattgtaagaaactgccagagagcttttgaaatgattctaccattttgctttctcaccacaatgaatgagatttttagtagatctgcatccttgttgacatcgccagtcattttaatttaagcaattctaatcaatatgtaatggtgtctcatcacagtttttccttgcatattgctaatgactaataatgttgagtacatttgtatgtgcttatttgtcaacgaggtctcttctttggtaaagtgtgtgttctatcttttgtccatttttaaaaattgggtttttgtctatcttactgaactcttctgtgaatttaaatattgtttcctaatgtgttaaatgaagataatgcctatctcactgttttgtgtgtgtgtgtgtgaaaataaatgaaacatatgtacaattg

SEQ ID NO: 345 - DNA, 2149 bp, Homo sapiens
ggttcacgctcctgcctcagcctcccgagtagctggaactacaggcgcccgccaccacgcccagctaatttttgtattttcagtagagacaggatttcattgtgttagccgggatggtctcgatctcctgacctcgtgatccacccgcctcggcctcccaaagtgctgggattacaggcgtgagccaccacaccccgccacttcaaatactctttaactttacacttaagcaaagaaatattacatatttcagtcctgaaaatattatgataaatcaaatagaccctatgacataggatatattaaatatttaagttttggaaatgtcctttatatacaaaatatttccattgttaacaagtgcttttcaaaaaatatttttattataccttagaaagagccaatttagggtctacactatctttgttcatctcgttttcttttttgcacatattcctttactaatgtagattagcactacaagataaaaagtatccagcatcataacattgtaattaattcccccatatcaaattatatgaaaaatcccacctcagacactctgccaaagggtatggaacatttaatcaagatgaagtgcttcaattgaagcagtatatgctcacctctatcagtaattttgtctcactttatttcaaagtattattatttttcgtcccaagattttagtaacacgttgtgttaaattcttgtcatatttaaaattaaaccctcttattcgtattatatttaaaagcaaattttcattgtttcaatgaaatcgttcagtatactcggcaaagtttatagtaaagttctgaacaataaatacattctgaaatgtcctgtgctttcaaaagtacatattagagctgatggcttaagcaccattatttagtggcatttctaattattactttcctttatgtggttttttttaagaggcaccaaagttccttttgtcacatggctcgtgttgccttcagtaacagccacttgaatttgcccttagttgcaaactcagatcatgacacaaaatatactcataaaagaactttattctggacattcttccagactatggaaatgatgttagacaaaaagcaaacttgagcgattttctcattcgagttcaaaatgggtcataaagcagtggagacaattcgcaatatgaacaacacatttggcccagggactgttaatgaaggtacagtgcgggggcggttcgagaagttttgcaaaagagatgagacccttgaagacgaggagcataatggttggtcacaggaagttgacaacaaccgagagcaatcattgaagctgatcctctcacaacaccacaagaagttgcagaactcattgttgaccattccacagtcattcggcctttgaagcaaattgggaaggtgagaactctagataagtgggatgccccatgagctgagccaaaataaaataaaaaagtcattttgaagtgtcatcttctcttattctatgcaacaacaatgaaacacttttctattggattgtgatgtgcgacgaaatgtagattttataggacaaccagtgatgaccagctgaataactggatccagaagaagctccaaagcacttcccaaagccaaacttgcaccaaataaaaggtcatcgtcattgttgggtgctctgctgccagcctaatttactacagctttctgaatcctaatgaaactattacatctgagacgtatgctcagcaaatcgatgagatgtcctgaaaactgcaatgcctgcagccgacactggtccacagaaaaagcccaattattccccacaactacacgtgaccgcatgtagcacaaccaatgcatcaaaagtcgaacaaattgggctacaaatttttgcctcgtccactttattcacctgacctctcaccaactgacctcccaactctctgccacttcttcaagcatctcgccaactttttgcaaggaaaaagcttccacaactagtaggaggcagaaaatgctttccaagagttcatcgaatcctgaagcacgtatttttttttttatgccatggaaataaacaaacttattttctttctttggcaaaaatgtgttgattgtaatggttcctattttgattaataaagatgtatttgtgccta

SEQ ID NO: 346 - DNA, 1212 bp, Homo sapiens
cgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcagtgcctacaatagttcctggtatgtagaaggtatacaataaatattggcggagtgaaggaacaaatgggatttgcttgattctgctgcagaagactaagaaaaagacataaatgaataaataactagtagaatgttaacacaatcagaaaaaggaccatttcttttcatttggatgtctcaaatctatttgttgtttttgttgttgttgtttttctggctgggcttgaaatgtaggcatgcagccaggaggctccatgctgactaatgagatagaggtacccatttagcccagcaatattcatacattgtatatgcattcatttttctctagtgactttttaatatattttggtgaagatattcccaagataatgaagatatgttgagtgggcattaaaagtgatgagtctttttttccattatcaaagacaaatacaggtgtgtgatgtatgcagagaattagaagtagggaaaaaaatgagggaatccaaaataatgaaaagaaattaaagctctccaataatcgaaagaaaggccaaactgaaaacataaatctccagactctgcaaggatttatactgatgtggggcatgtggaccaatggctttcaggatgtgattcattttgaaaaaagtgtcatttccattgccaagtagagttcatggtttagtgaaaatttcatcttcagtctgatcacatgagccaaattctggccctatatattctgatgtgaggaatgaagtatttctagtttatttgtgagattccaagcataatatccaggagggttagtcacattacagctaaggtaagattttgttatatttgtgttagtccttattctaggcactgaaatttccttgtaacattacttgaaaaagcataagaactatttaatgaaagaatgctttggctctgcccaaatgaccaagaaagacatcaactcacttataacacagtcttgatggtcagaccaaaaggtacgtgattgtcaattattttcagcagagactcatagaacaacaaagcagggaagaatctgaacagggattggactttaa

SEQ ID NO: 347 - DNA, 12826 bp, Homo sapiens
ctttctggattcactctaggactatctggagaaagaggtaagaatgatcagattctgtaacttattgcttttcctttccttctgtactatccctgcacacagatctacagtttgaaagtacagtaataagatcctcacccagccccatccgcaggaatgcatcaacagctggccaaacataatccaacacacagagctgcctttgtagaattagtaacaaacagtggaagggccagacaggcgtcccagaagagctccccatgacaactgggaaacctcctcacccccagggttgagctgactccactgagctggggttggagaaccccagctctcacatctgaatctacaacaagcctcaagtgcctgccctcaacctcactagaagctattcagagggcattcggctctccataacagcaagttagaagcaagcattctccatactaacaacagccatactctgcctcatggcacatgccttttgaaatgcaacactgcaaatctccaaatcacatgaacagcatttacacctgtacctaaccatcagctgtgagctggtaggaccacctctcgtctttagaaaataatttctttttgcaaattataggctgatcccggcactctgaaacatgtaaatataacactgtattcatctccactgagcatttagcatctgaagcctgtggtagccagctggtctcaaagtcatctgggatacatttattttgattaaattgatcagatttctatttacaggatagaatttttttgccattactgaatacagctgtgtttacagggatttgtagaagaagaaaacaaaaccccacaatcggtcctagcaaagcacagagcattcagaactggaaggagttaaaacagagggggcttgctttcacagtaaaaagaaaattctgcatgcagctgctttggccatgctgtctcactagtcaggaaatgggtgttgaactggagctgaaaacacaagctgcaatcaagcccgatccagcaaagtgacagacttcctgtgtaaaatggtcagaaaccttttttcatgtctctacatgcatgcacatgcatttaaatccatgctgcgaggctgcgattttctctggggacactggtacagtcacctagcccatcagttccttcgtcgacagcgccggggacatccagactacaatttacagttcctctatccatgtgctgggttataaattatgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgaggtaaaatgccaccacatctcgccatgggttgtccccccagactaaatccctgggaacagcctgagctgggtgcacgcggccgaggcgacggctgcccttgccctgcggagcacgggtgggcattggatgtaaggtattcctaacttccccttccccagtccttggcgtcctctctagccatcccaccccaggtcttctgcagcttcaccctgtcctccaagtcccctcgcccagctgcgaggcaggagaccccggccggagctccgccagcaggtccttctttcgcagggcgcagacgcacgattccgggatcgggtgcaccacggcgaagcccaggcgggagacggcaggagcagctcagatgaagaaactgaaacccacagagatgaagtaacatcctcaagatcaaaaggtaacaaacgattgaggcaggatttggatattgctctacatgacgggaaagcctgtgctcttggaattacagtcatagtacaacagatcaagttcaaagcatcatctaagtcaaggaaaaccagtaaagaggtttggagagacaaacagggtcaactccaggcatttgggtcagcagaaacggcacgattgagcagcactgtgactataggatcatggatcagaggctgcttcctctttggttctgggcatcagcctcatgtccactcaaagatcccatccgggccaccacattgaatttatttgtcattttaggtacctcttggctgtgagtttcttagactttccttgtttttggtgaccctgacagtttgagggagtactagtcagtcagttatttttgcagaatgccctaaatttgagtttggctgatgtttttcttagggtttgactggggttatgggttttggggaggaagaccacagaggtgaagtaccattctcaccaaattatattaaaggtacataccatcagcatgccttatactattgatgtgaactttgattgcctggctgtggtagtgtttgtcatgtttcttcactgtaaagttactcttctcatcacccacttttctgtactgtactctttggaagaaagtcactatatgcatcccaaatttaaggagtgggaagttatgctccacccatttgtaagcagaaaatctacataatttgtttggcattcttctgcataggaaaatcatctcactctcccagttatttatttatttgatctttttttatatcagtatggactcatgggtatttcttttatactttgggttataatccaatactaacacaataaagaaatttttaatggagatgcattcaaattcgttgctaaaatgggcctgacacctcttgaccttggctaaacagagattctggatggagcaaagcactgtgacgtcatgtggactttgaaggttaagaaactacggatcatcaggacatatttgctcttccatctcacagagaaaatggggatatacctcctcattccaggaaactttcttcctatatttctaatatatccaggataaaattcaatatatatagtcagtagcttcaaagttaagcataatttgtttactagaattcttaaggcagatgttggatcattaactcattctcttagaaataactttggtgcttataagtaggcatcacataatctgatacactgatattatatatataatcgtgaaaaacatatcagattatatgatatcacataatctgatatatgtgatatataatcagattatgtggtatcatataatctgatatataaatgtttttcataattatacatatatttcaagtataattgtgaaaaacatttgccagtttaaagtttaatatgtagacagaataatgcctggaggtatagggatataattgggaattagagtaataaaataaatattttaagtacttactacatattactcattaacacaaaagtaactttacgtataaaatgcatgacaagactccattataaagaagtgtctgaaagctatagggcagaaaggtatagaacacagtatagactagaaggagataaagacaatcagaagattttattcattcatttattcaacaaaaatttacagagtacctccaattatcagcagctgtgctgaagattaggtatattacctacacagttacaaattttgctttcatgtagtctgcaggaagagagacattaatcaaagaatggcactattgacacttgtgcaggaaagggttacgtcaacaggcctgggctgctcaaaccttgcgtattcccagagtctcaagactggtcttggcctggctcctgggaagattacttctgagcccttggctgagataggagtttatgccaacagtgtgatttatggcaaacacctgtttttgtatgcctgaggctttggatcatgctgtaccaatttgatctgaggcctgaagactggtagctaaggtgctgcatgcctacatgactgacctccagtaaaaaccctggacacatgcctcaagtgagtttcgttggttggcaacactttacatatgttgtcacacgttgttgctgagaaaattaagtgtactccatgtaatggcactgggagaggacaactggaagctggtgcttaatttctcctctactccacgctatccaccttttcacttcgctgagttttttctgtatcctttcaatgtaataaactttaaccatgagtataacagcttttttgggtcctgtgagtctttccagcaaatcactgagcctgagaattatcttggggatccccaacacaatactacaattaaaaaatgaggtacatattctaaagaagaagaatatagtttgtgggagtttataacatagtaacctgaagtagactaggaggtcaagaaagtcttccccgaaaaagagaggtttgagctgtgataatggatgcataagacattgcttataaaggtggagagagctttccagcatgatgaattgcatgtacaaatcctctggtcagggagagtaaagtgtgtgtgagcagctgaaagtgacatgcacagctggagtggagagaacagcaggaggtgggatgggagatgtgtgggacagtcctcagaggctgggcttggcaaaccatgtgaaggattttggtcattatcctgagagtcacgggaagccatggaaaggctggaagcaaaggggggctcagggtggtcttctgaaataagcattctggcaatgggggttggggggagaacttatagggggtgatgagtcgacagaatgaaaacaaggcaatctctttttatagaactcagaagagagatgatggtatctctggctattgtgctggcagagggaatgttgagaaatggaagcttttcatagaaatttagtgggccaaattactttgctggcttgtgcaaatgacagaatggttggaccactcattgaagcaggacacactaggagagaccaggtttatttttgtcaggatgaagcacaagaatgacatacatttggtcttggatacactgagtttgatgtgcctttagagttgaatatggagatagttataggccactgaatacataggtatggactgatgtcattcaggtttcatccacaaattgtaactacagctatcgactcaaggggcaactatcatttgcctggcattactttaagtactttccatatatgaactcattatatcctcacaattattaaatgagcagatcctataactagcctatgtcattctcatagcaagccaaggaagggcgttgaaaccaactttggagacggtagggggtaaaaaagaagagggattttgacgttgccagtattagtaactgattcctggcagacaagactgagagtatatcaccagacctgaaggaggaggaggctgggctatcctggaagccaagggaagttggtgctccagaagaagacagtttttatttaatgctgttaagtttactaagaagaggactatgggatggacaacagtcagtcattgcaagtaaaagttgttttgatgaagctggaagctaaattagagaagggtgcatggaaggcaagaaagtgaagacagggaagtgctttcagcacatctcgctataaagagtaggaaagaaagcaatacctgcagggagctaaaggagtcagggaggagctgtttgtttacaggtgagatgggagagctgtattcaagtctgaaagtcaatggaaaggattcatttgagagggaatagttgagtacacatgagagaagtacatcgattgcagtgagctgagatcgcaccattgcattccagcctgggcgacaagaacaaaactccgtctcaaaaaaaaaaaaaaaaaaaaaaaggagtacgttgatagtgtaagcttcttcagcagtccagagtgagagagatgggatgtaaatatggtcaaacatatttgggcagagccagtcagtgaaatgatactcttcataacacatgtcacagaaaccagtaatagatccaagccctgcctatgctccactctgctctcatacccattggtttccttatttctctttggctatccctgccttccttcatgactccatatgccacgttcctctcacttcggacacatcgcacttgctgtttttctcagctaagaatgtttttcactccatccaatgccccacctcttcaaccagtttctagcctgatgaagatgttcaataaacagtcattggttgaacaacttgtgttcaaaacatttactgaaacaaacctgtattagtccgtttttacactgctataaagagctacccaagcctaagtaatttataaaggaaagaggtttaattgactcacagttcagcatggctggggaggtctcaggaaatttacaatcatgatggaaggcaaaggggaagcaggtatcttcttcacaaggtggcaggaaggagaagtgccaagtgaaggtggaagagccccttataaaaccatcagatctcgtgagaactcactcactatcagtatgcttcaattacttccacttggtctgtcccttgatacgcggggattatggggattacaattcaagatgagatttggatagggacacgaagcctaaccatatcaaaacccaatctgaaactcaatccgattttggatatttgcttctgattttggtcaccaataagtatttttatcaatataaatttgaatcataattaaagaaggcattgtagtctaatatttagttatacttttatatccatgatcatattcatccctcctacaaatataaaaacatatgcatatgccattttattattttatacaaaagagtatttttaagcagacacacacctgtcaattaattctctcctactaagcaaacaacacggaaagaaattctaatcagaatgtcaatctattaatttacaatgagatgtacaactgtcaattcaaccagatatttttgttaatctgaccaatgcatatttttaccctggccaagccagccacagattggtaaaccttacattaaaaaatgtaggtaggcccatatctctcaccatatacaacaataaactcaggatgaattaaaaacttaaatgtaatacttgaaactgtaaaaataccagaagaaaacctagagaaaactcttctggacactggtctaagaaaataattcatgactaagacctcaaaaacacaagccacaaaaaacaaaaataaaaaactgagacgtaatgaaataaaaaggtttctgcacagcaaaggaaataatcaacagagcaaacagacaacctgcagaatgagagaaaatattcacaaactatgcatctgacagaaaactaatatccggaatttacaaggaatgcaaacaactcaacaacaacaaaaacaaccccattaacaagtgggcaaaggacatgaatagatattttttaaaagaagacatacaaatggtaaacccgcatatgaaaaaaaatgccccaaatcactaatcatcagagaaatgcaaattaaaaccacaatgatattatcttacattagtcagaatggctattagtaaaaagtcaaaaaacaacagatgttggcgaagatgggaagaaaagggaactcttatacactagtaaaacctctgtggaaaacagtatggagatttctcaaagaactaaagatagaactaccactcaggtcagcaatcccactaccatgtgtctgcccagaggaaaagaaattgtgtcaaaaagatacctgcactcttatatttatcacagcactattcccaatagcaacgatatgggatcaacctatgtgttcatcaacactggacaaagaaaatatggtatatatacataattgaatactattcagccataaaacaagaataaaatcatgtattggagcaacatggatggacggagaggccattatcttaagtgaaacaactccaaaacagaaagtcagataccgcatgttcccgcttgtaaggggaagatgaaaaaaaaaaaaaaagatagacattagagactagaaagcggggtgcagaaggagagtgggtgatgaaaaataacttagtgggtagaatgtaaattattcagatgatggctaccctaaaagccaagacttcaccatgcaataaatgcacataacaaaattccacttgtaccccttaagtttacacaagtaaatataattttaaaataaaaatacatttttaaaatgtaggtgggaacggaagacagagcaatggcttccaggtacttagagtaggaatatagggattgttttcaaagtggcaggagagatttgattatcttgatggctgtatgactctatgtgttaagtgggtacttcaaggagtataagaagtttattttacttatagcaaatagtcttggtacaagaaaattatatagcacagttagtgagactgtagtctttggaaccctaaaaccttggttcaaatcccagctttataactgaattacttggtaataagaaatttattagaacgaatccctgacagttcaaaacacaacagtagattctaaaaaattgaggaggagggaatcctcctccctaacacattcaatgaggccagtgtcattctgatactaaaacctggtagaaacacaacaaaaaaaagaaacttcaggtcaatatccctgattaacatggatgcagaaattctcaacaaaatgctcgcatactaaatccagcaccacatcaaaatgctaatccaccacaatcaagtaggtattcctgggaggcatggttgcttcaacatatgcaaaccaatcaatgtgatttatcacataaatagaatttaaaaccacatgatcatctcaatagatgcagggaagtcttttggtaaaatacaatatctcttcatgttaaaaaccctcagcaaactaggcattgaaggaacatacctcaaaataataagagccatatatgacaaaccacagccaacatcatactgaatgggcaaaggctggaagcattcctcttaagaatcagaacaagacaaggatgcccactctcaccactcctcttcaacatggtactggaagtcgtagccagagcaatcaggcaagagaaagaaacagaaggcatccaaataggaagagaggcaatcaaactatctctcttcacagatgatatgattttatacctaggaaacgccacagtccctgccaaaaagctcattgattccttgatctaataaatcagcaaagtttcagggtacaaaatcaatgtacaaaatcagaagcatttcaatacatcaacatcaacaatgtccaagtcaaatcgagaatgcaatgtcattcacaatatccattaagaaaaaaagaaaaaaaaaaacctaggaatacagctaaccaaggaggtgaaaaatctctacagcaagaattataaaatgctgctgaaagaaatcagagatgatagaagcaaatggaaaacattccatgatcaagaatagaatcaatattattaaaatggccatattgcccaaagcaatttacagattctacactattcctatcaaactatcaacaacatttttcaaagaaatagaaaaaaaaactattctaaaagttatgcagaaccaaaaaagaggctgaatagccaaagcaatcctaagcaaaaagaacaaagccagaggcattatactatccaacttcaaactatactatacactacaataaccaaaacagcatggtatttgtaaaacaaacaaacaaaaaaaaccagacacatagaccaatggaacaggtcagagaacccaaaaataaagctgcacacttacaaccatctaatctttaacaaagctgacaaaaacaagcaatggggaaaggactctattcaaaaaatggtgctgggataattggctagccatatgcagaagattgaaactagaccccttccttacactatgtacaaaaatcaactcaagatggattaaagacttaaatgtaaaacctaaaactataaaaaccctagaaaaagataaaggaaatacattcaggacataggccatgacaaagatttcattttaaagactccaaaagcaattgtgacaaaaacaaaaattgacaaacaggacctaattctacacaacaaaataaattatcaagagagtaaacagactacctacagaatgagagaaaatatttgcaagccatgcacccaacaaagatctaacatcctggatctataaggaatgtaaacaaattaacaagcaaaaaacaataccattaaaaaatgggcaaaggacatgaacaggcacttatcaaaagaagacatacacgcaaccaacaaacatatggaaaaatgctcaacatcactaaacattatagaaaagtaaatcaaaaccacaagatactgtctcacaccaatcagaatggctatttttaaaaaggcaaaaaataacagatgctggtgaggttgcagaggaaaaagagcacttatacactgctggtgggaatgtaaattagttcagccattgtggaaagcagtttgaagatttctcaaagaacttaaaacagaactaccatttgacccagcaatcccattactgggtatatacccaaaggaacataacatgttctaccatgaagacacatgcacacatacgttcactgcaggaatgttcacaaaagcaaagacacggaatcaacctaaatgcccatcaacagtggactggataaagaaaatgcagtacatatacaccatggcatactatgcaaccataaaaataatgaaatcatgtcctttgcagcaacatggatacagctggaggccattaccctaggcaaattaatgcaggaaaagaaaactaaataccacatgttctcacttagatgtgggagctaaatagtgagtacacatggacacaaagaggggaacaatagacaccagggcctatttgagggtggagcgtgaggatcgaaaaaccacctttgggtactatggttattaactgggtgacaaaataatctgtacaccaaactccagtgaccgtaattcacccatgtaacaaacctgcacatggatccctgaacctaaaacaaaagttggaaagaaaaaaatgcaacagtaggtcaaaagtccttttaagaagttatgagaatagtgcagataaagtttttagcatatgcctggcacaatagatgctaaatttatcagtagttttgctggtaaggttcaagtcttttattcaagacttcctctccaccagactttgcttacatgaacatcaacagtatttgcctttgtgactttccttttctacattttcttagttgctaacctggttatatttgtatagcccttttcaaaacaggatacaatactccgataatgtttctgattagcaaatgataaccactttccagtcctgcctctcagatttttcccagagtccaccttgattagcatctatgggttctgtaatctcttgagtctctatttatagaaaattttgagttaacaattactcatgataaatcactttgtgcagatttatgcaagttgactcttaacaggccaatctaatgtctatggtagtaaggtatacgttctcatcatgcccacagactaacaacattgtttaaatgccttcagagagctaatgccggtggtagaacctttagactcatctatagaaatcaagacccaaaagaaaatatcctgcaaagatattgcttaaagcagcaagcttcaatctgataagattgctattgctaaatcaggattgaacaggggcagaaaagtggataattaatgtatatagggcccattctgggatgcaccaagcagatgtgatgttctatctataatctaattggtagcatcacaaaggcagaaaggataagatacagaaagttcacatgagatcttgaataaaaacctaggaggtactaaaagtcatcaaaaaaatcagagtgaaacaggagtaacagtaatttggacccagaggacatgtacaattttcaggacagtagcaggggccctaatcaatctgccttataatgaagcaatgttaaaaggagtgtgcccatcagttcatgttccccaacctcttaaatgtgccactcagcctttgcaatggagaggattaatgaatgatcataaaacatactttcagttgtggtgtgtgatatttgataatcaaggatatgcagaagttcatggacaaagtcaggtatctcgagacattcctatactctaacatactccaggagacaacagttcaagctttcaaaattccttccagaaaaaagaaaaaaaaaatccagtgcattttatcacatttataaaactaggctccattcttgtacacaagaaaatacatatgaggtggccacaactaacatgaatcaaatcagtctgagactaatgcatagactcatgccaagacatgacaaggtaaggaggcagaatttggattcagaggttttgtaacacgactctttgtaggctgaagggaagtttgaagaaaaagttccaggtaaggccagtgcagtggctcatgcctgtaatctcagcactttgggagcctgaggctgaggcaggtgaatcacttgagtccaggagttcaagaccagcctgggcaacatagtgaaaccctgtctcaacgacaacaacaaaaaattaaccaggcatggtggcacatgcctatagttccagctacccaggaggctgaggtgggaggatcacctgagccaaggaggtcaaggctgcagtaagatgtgattgcaccattgcactccagcctgggtgacagagcaggaccctgtctcaaaaacaaaaacaaaaacaaaacaaaagtgccaggtaaaagagaatggctttgattcaaattctgtctattcaaacccaaatattaaagcatttaaaagggaaaagaagtctttttgtttgtttgtttgttttgatatggaatctcg

SEQ ID NO: 348 - DNA, 3188 bp, Homo sapiens
gctgggacctgttggacgtgagggtgttgagcatgtagaacatctcctggatcaggaagtagatgttagggtcactgttggtggctgccccagtgctgccacagtcccacttctatggctcattcaggagcctaagcagcgaggggctgttgctggaatttgccttctggaagagctcatacgtgtttagcaggtcccccgagggagggttcttcttctccatgaccttgtgggagatgccatacagaggcttcttgtagtaaggggtggtggcatggttgcggggctcctccttgcctggccacacagagcccgagctcctgccttgccggcctgctctccattgccttggcagggcgagctgttctcgggttccacatgcctgctaggagcgcctctgggatcagctacctcctctccacgctggggatggagtctggctggccattgctgaccagctgagtcctggagggcagtaaagacgctgtccagaaggtgcttctcagaagtcctggaattcacggagcagcctagagcagcatctttggcctctgtctccactctcacttcttagaagttcttctacatcaattttttttggagatggttctgactctgtcacccaggctggagtgcagcagttgctcagagctcactgcatccttgacctcccagactcaaaagagcctagctacttaggagtagctaggactacaggccacggccaccatgcctggctaatcttttaaattttttgtagaggcagaggtctctcattgtgttgcccagacaagtctcaaattctcgggctcaagtgttcctcccaaagtgctgggattaatggcgtgagccactgtacctggccatattttttttttcaaaaaattcatttgtagagtttaaaaagtatcttttgatcaagagttcttattgtatttatgtttgcaaatttcatttcccattctgttgcttgccttttcactctcagtgagttattttatgattacaaatccttattttttatgttattttattactatttattaacttatttatcttatttattagccttcaatcgttactttttgagtcttttttaaaatcttaaggtcatagaagtgtcctctgtattactttttaaaaactgtactgttttatgttacacattggcttctatatgaaataatttttgtgtatgttgtgaggttggatgttaatattcatttttatctgtaccgatgtatgaaagacagcacaatttattgaaaatgaatcttttcctcattgtactgaagcactatttttttcacaaatcagctaaatatattgtgtggttctctttacgagctctctattctgtttcattgaaatatctatacttgcaccttttccataatgtcataattaatatacatttataaaaactttatatctaatagtgtaagtcttcacattatattttttcttcaaagttatctatacactgcatttttatttgcattttatagtcagtttttcagttgccaccaaatataatgcagacaaattatgctattactaatcacagtattgtgattttcagtgtattacaaatatagatttatttaaaatactgaatctttcttctaataccaggaatgacataggactcacagtacacctttatttctgttgaatatctttaatttctctcagtaaaatttcacaattttcagtaaagggattgcatatgatatgttacattttatattaggaattcaatgtttcttcctggaaacatttcagatttttaatattttatttgatttagactcactacatttggaaagctttaattgtaattttatttttaatagatatagagctattaggatttgctatttattcttgtgtcactattaatgattttctagaaatgtatctatttcatcaaattatttcaaaatttttgacttaaagttacttattacattctctttttctctcccatgactatagaatctataatgatttccttgttattattcatgatatttagaatttgtggatactcttttttttaaatttcatgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgaaattgacaattagattattaattttcaagctttaattttttaaacatatttatgtaagcatatgcatttatctccaagctgaggtttgcctaagcctcccatcttttaacaagcagtatttttactttcgtttttattaaattcaaaatatattttaatattcactgtaattactttttcgatccatgaataacttagaaatgtgatgcttaatttctaaacatttggtcactttcaaagtcttgctatagatttgcagcttaataacattgttgtacaaaaaacactgtcaaggatttcaaatttttggtatttattgattcttgttttgggcctaacctcagcctatatctgtctatctaacctatctatctatctatctatctatctatctatctatctatctatctacctacctacctatctattatctatctacctagatagacagagatatctatagatagctatggtaaattttgaaacacgttccaaatacattataataaattgtgtgttttgctatttttgggtgcagtttttatatcaaagtatttaatcctactgctttaaatttttctattattattgatattttgtatcctttttgctatcagttattgaaaaaggtatattaaagtctttatgattgaagacgcggctattgctccttttagttctataaaaattgtaaatgtgtgttaactgtgtgtgagtgaatatacatacacaagtttgacaacttcctcaatagttgattcttttatatggatgatggatacatcttcctttcaagtaataatttctgccttaaaatctcttttgtctgatattaacatagctaaacaaattttcatttggcttgtgtttgattaccttttatatgcatatatgaaaggtttttaaattaagatggttctatagatagatatatagatagaagatagtagatatcttctac

SEQ ID NO: 349 - DNA, 1620 bp, Homo sapiens
gggtttccctgctatgttttgtcacacatcattgctgggagagttcagtgctatccaagtgactcccccgggagaggacaactggaaatttatgcctggtgtcttcctggactccgacctatgcacctttttccttggatgattttaacctgtctccttttgctgcaatgaaccataaccatgagtatatcagcttttctaatttttgtgagtccctcaagtgaattatcaaacctaaggtagttttgggacccccatcacagagagtcaaacaggggcagggcaagaagagctgcttttcctggaaggctaatgagtctgaacttcgccctggaggtaatcgttatagtaactccaggctctaacctggagctgacatgataaggtcaaatgtacacctctagaagacttccgactgcagaggggaatggatgggggagctgagggaggagagctgaagcaggaagaccatggcctggaaagagatggctgaaccagtccaggtaagagctggtgggcccttggtagtgggcagtggccacggcaaaggactaaactcaagagacagaaaatagatacaacaagacttgccagccaattagactgtggggtgagggagacaagtcaaggacgactcccagatttctggcctgggcaattggagggatgatgaagtcagtcactgaagtgagaaatcctgagtggggaagctgatgttcaggggcttgagggaggttctgacccccaagcccagcctggtactttcactgtgttcatttctacaattcaggaaccatccgattgctcttttttctctccttgaagccatccccttagccctctgcccacagtgatcactaactgattgctcctccttaaaagccaccgaaaagtgtgcttggctgatctccctgacctcaatttctctgctggcagaatcacaagaaaggcatcagcaccttctgtgaaatggggagccatgcagaggaggtgcccaggtggcgaggagtccatgtcagctgccgtcatccacaccacagatcagacatggcaaagagtggccaggccttctgagtgaaggtgatccaacctgtcaccaagcctaagggcaaatcctggctgtgctgtgatggctccaacaaccccaaacagcagcgcagaggctgcagccgccctcggaggcaacactgggaaacgctcattagcagccttccattgctcacccgccccatcccacctctgtgcatcccagatcatcagcgaagtgcacagctggcttccatcctcggagccttcctccttcatttgcctattcaacagttacaaaggcctgagttgcaaaggggcttacaacccattccacccagaagaaagagaactgagactgagcaagacagagaataggtggaaggggagatgaaaccaagcaatctctagatcccaaatggggaccctgatgtagcaagagcctcttttaaatccttttccaatagggtaatatggaaaatagttgaaagcacaagccaagtggggctggaatcccaaatgggccatttactagctgtgtgactggacaagtaatttcatatttctgggcctcgatttttctcatctgtaaaa

SEQ ID NO: 350 - DNA, 1643 bp, Homo sapiens
tcagcggactacaagaagcagagccaccctcaatctgggtagacaccatctaatcagctaccagcaaggctagaataaaacaggcaggagaagatggaagagcagacttgctgagacttctggccttcatctttctcctgtgctaggtgcttcctgccctcgaacatcagactccaagttcttcagctttcaaaatcttggacttatattggtaatttgccagagacccttgggcctttggccacagactgaaggctgcactgttggcttccctattcttgaggttttgggactcgcactgatccaccactggcttccttggctcctcaacttgcagccggcctatcatgggacttacctagtgatcatgaatgctgtgacctctgagataattcacccaccggagtcagactgctgaagaacactggatgggtggaaaaggaacatctcaaccaggagagaaggaactgagtcaagaaagggctgcatctggtgaatatgtccctcccagtgatggaacccagggctgctgcagccaagagtctataacagtggagacgccttgagcaaagccccagagcccttgagctgcctgttcccctcctctgacatgatgggtaatctgatggaagcgctgagaggcactgcctagaattaagccctatgtgtaaacgaagcaaggaagaaagaacatgtgctatcaaatatgattcatgattcaaatatattttaatatcttattcttttcacactctgagaaactattctgataatgtgattgttttgtaaaggagtgtatcttcggataatatacagattttatagctattgcacagttttaataagcaaaagacttgctaggttgaactgggttcaacccaaaccactgtacaatttaattcaacacaatattcctctgtttaaagtgcatgtaattgccaatttatacagtcaccaagaccaaaggtttgctaaatagagttctgcaaacatagtatggcatgttttatccccaagtaccataaacgaagaaagaatgaaactaatcattaatcaatcatgtatctaattcatttcaagggcttctttcaactgtacaattatccaatgaataaattcaaatccacctgtgttagtatttttctagactttatcaccataagtttttaaaaatccttagaaactcaaggaaatgcgtaaaatgaaattgacattatcttaaacagtattagattgctattccctcttctttcataaagattttctttatggagagttattcttaaatagcactgatatttctgaaagtttccccaagtgctccattcttaaagaaatttttatttaaaggatgaacaatacataacactgcttagtgtgtgtgtgtttcagtgaaaaccattatactgtaaaaactcattctacaactttttttctgtctaaattgtaatttttgagatgtagtaaacatatcactgtgtgtaaatagatctaattctactaactggaaaaaacgctcaacactcatgacagaggttatttctagggacctagggaggggaatgaggcttggaatcccagacaaaaggcatgtgaactttatatataatgtattatttattttattaaatattgaagtaaat

SEQ ID NO: 351 - DNA, 1363 bp, Homo sapiens
atgctaaaaataactattcctacaattatactactaccaataacatgactctctaaaaattatacaatttgaatcaatatggctacccacagcctaatcaccagcttcattgccctattattctttaactaattcaacgacaatctattcaacttctcattaactttctcctctgatccgctaacatcaccccttctaatcttaacagcctgactactacctcttataactatagcaagccagtaccacctctccagtgaatcacccctatggaaaaaaccctgtatttccatattaatttccctacaaatttttctaatcatagcatttacagccacagaactaattatattttatattctctttgaagctacacttatccctatcttaattattatcacccgatggggtaaccaaccagaacgcctcaatgcaggtacatatctcttattttacacactagtgggatccctccccctacttattacacttatttatgcccaaaatatcctaggctcactgagcatgataataataacatttaatatcaagaactaccaatctcctgatccaacaatctcatgtgattggcatgtataatggccttcatagtaaaaatacccctatactgacttcacctatgacttcccaaagcccatgtataagcacctaaggctggctcaatagtacttgcagcagtgctcctaaaattgggcggctacacaaaatgcgacttaccctcatcctcagccctctgacagaacatatagcctatcctttcctgatattatccttatgaggcatattatgacaagctccatctgtctacgacaaactgatctaaagtcacttattgcacattcctccgtaagccacatggtacttgttactgtggctatcctcattcaaaccccctgaagttttaccagtgcaattatcctcataattccccatggacttacttcgtccctactattctgcctagcaaattcaaactacaagtgaatccacagctgaatcatattactctctcgaggacgtcaaacattacttccactagtaaccttttgatgacttacagcaaatctcaccaaccttgccctaccccccactattaatctagtaggagaactccttgtaacaacggcttcattctcctgatcaaacactaccatcatgcttataggacttaatatattaatcacagccctttattccctctatatacttgtcacaacacaacaaggaacactaacatactatattaacagcattaaaccttcctttacacgagaaaacatactaatactcatacacctttcaccaattctcttactatctctaaatcctaaaattattatag

SEQ ID NO: 352 - DNA, 2952 bp, Homo sapiens
gactcgtcgctgagggactttaagattgcggaggagtcggcaccggggcctggctgccggggaaggagagcacgggagcggggactcctgtgtctggcggagggacacggcgttccggtggagggatctgttccttgtacctggtccagggttgcggtcggggatggagcggttaccccgaccctgcgggaccttcttcctctggcggaggtgcacggcgcggcgtggtgtttttctggcggaagtatctgtgcgtggccccaggcccttcccggcgcggtctcatctggggccacttgttggccctcgcgttggggaggttcatgtggtgcatcctgatgagaaggggggtcacaggggtctcggggccagggttcagccagccaggccccagcttgctctcttctggtgctgcccctgtccctgaattcatagacccggctttccctctcttgagcacctactatgtgccaggctgcgctttgcgcatgtagcagaggcaacagtgtcacctgggaagctggtttcccccaaaggaactcttgtctgtccgttgttgcagagccagcgcatgagaccaagtgtaacctggatcccaaaatgagaacagaagaaccacttcatgtgacttgaaccagatctgaaatctgaagtgaagcccagaagagtgtagctgaagacaagtgaacctacttgaccagcaaacgcacatagttggagatgaggtctggagatgtttcccaggctggattcgaacttctgggctcatgtcatcctcctgtctcggcctccagagtagctgggaccacaggcacatgccaccatgcctggctggttactgtacacatttaaagattaaaaaaaaaatcaagggtgtttgaaaaaaaaaatactaccctgtctgtgtgttcatttacatacccctataggcactggagtttttgatatctaggtaggtcaacagaacaaaaagactcctttctcacctaccccaaagcccagatcaacaaaacagttaaaaaaaagaaagaaaaaaaaaaaaaaaagaaaaaaacctcagctgcgcagacaaacacagaaactgaggatggggagaagaaagttgtggattctattccagatgcaatttccaatctcctatgcatagtaacagacaactccttcctaatgtaaattgccagccatcaagtattcttaggtggtatttgaatttaagtaaaatgactccttgggcaactacctgacggccaacagcttttacaacatgttttctgatataaactgttttacaaagagcttgtatctttttactaccaagcattacattctgaacagaaacttaataagatttttcagcagagatttttaagagtttccatcataggacctaacaacaactgtgttctattatttttagtgcaagagtaaagacccaagagaaacagcattttcaatttgactttatggccccccaagttgtgctcaaggtaaatcagagttaaaaactggtactgggaaaagagcaaagactttcgactccaacttgggtttgaaatccactactacttatgagctattgcactttgggcaagttgcttaagtcatttgtgtctcagttttctcatctattaacaaaagtaattctactctatagaattgatgcagcaaaggtttatagtatggagcctcatacatagtagggtatcccaaatgctttagttctatgtaactcaactcaaaccggcttaagaaaaaatgaaaatttcttggcctgcctaactgaaaagttcagcgtaaggtggcttcaggcatagctggatccaggagctcaaacaatgtcatcaggatacaatcacccccaactttaggcttcattcttcattgagcccagtggactagctagcttatttctggagcaagcaaaacagaaaactctgaaagaacagaggctgagatgcaggaaggcctggatgaaccctttccggacaggaaaaaacaggtttggacaccatagcccatgtgatgtgtcctagtgggaatggcattcaggccagcgtaaggacacatttcatctttgagggcagcaaagatcccctggtggccatcaagcagaccacccggaggcaaaactccttagctgtggaattcagaagtaattagacttttctattatctgaaacagacatctggtaccaggcttcttttctaaaatgtgtaagaaactagaatttctatacatctctgcatagcatgcatgtcagaactcattgtgcaaaccttgctgacatcaaggcaccaaaatgtctacaaatgtaatcatttatcatgaccaacatggatgatagggcccaaattacccttaggctctgtattagttcatgctcatgctgctaataaagacctacctgagactgggtaatttataaaggctagaggtttaatagactcacagttccacatgcttggagaggcctcacaatcatggctgaaggtgaaggagaagcaaagtcacgtcttacatggtggcagccaagaaagcatgtgcggggaactcccctttataaaaccatcagatcttgtgagacttattcactatcatgagaatagcatgggaaagatccacccccatgattcagttacctcccactgggtccctcccatgacatgtgggaattatgggagctacaattccagatgagatttgggtggggacacagacaaaccatattaaagtaaaaatccacaccatggcaccctcagtcctctcttcctggggcaccttgatgccctcttctgcagggttctttctttttaacaaaacctatactgttgttgggaaattcttcttactaccggtgagccaatcactttccattgccagggctctgatgcctctcctggtaatcatcatcaaagtcccatggaacaggcaggtccaagattataatttcc

SEQ ID NO: 353 - DNA, 4766 bp, Homo sapiens
cccaaaaaattggacacagcctactagcccaaaaagaacatgttgccaattatctccatgtttatttaaatattttgctctaaaggaagcaatcattcctttatacttctttaaatttagtattaaaccttttcctatttgccatggccactgcttgtgaagctaaaggtggtgaaggcagacacaggcaatggggccaggagcatatgcctttcaattccttcctggcaaccttcctgtcttctcctccactgactcttccctctcatcaccctctctatggtgccaaaataggcttagtggaatgctaatttggcaccctgacatataatgttctaaaatggatgcattctgaatttcttcttcccagatttgaaatgttttgaactgaatttgaactgaaattctattgactttctctttgatttcttcacctataaactggaccagtaccagccactacaaaaacataccaaattgtataggccatcgacactatgaagaaactgcatcaactaatggactaaataaccagctagcatcataatgacaggatcaaattcacactcaataaaatactggcaaactgaatccagcagcacatcaaaaagtttatccaccacgatcaagtcagcttcatccctgggatgcaaggctggttcaacatatgcaaatcaataaacataatctatcatataaacagaaccaatgacaaaaatcacatgattatctcaatagatgcagaaaagaccttcgataaaattcaacacccccttcatactaaaaactctcaatagactaggtattgatggaacatatctcaaaataattagagccgtttatgacaaacccacagccaatatcatactgaatgggcaaaatctggaagcattccctttgacaactggcataagacatggatgccctatctcacccctccaattcaacatagtattggaagttctggccaggacaatcaggcaagagaaaaaaataaagggtattcaaataggaagaaaggaagtcaaattgtctctctttgcagatgacatgattgtgtatttagaaaaccccatcatctcagccccaaaactccttaagctgataagcaacttcagcaaagtctcaggatacaaaatcaatgtgcaaaaattacaagtactcctctacaccaataatagacaaacagagagccaaatcatgagtgaactcccattcacaattgctacaaagagaataaaatacctaggaatacaacttacaagggatgtgaaggacctcttcaaggagaactacacaccacttctcaaggaaataagaaaagacacaaacaaattgaaaaacattccatgctcatgtataggaagaatcaatattgtgaaaatggccatattgcccaaggtaatttatagattcaatgctatccccatcaagctaccattgactttcttcacagaattagaaaaatctactttaaatttcatgtggaaccaaaaaaagcctgtatagccaagacaatcctaagcaaaagaacaaagctggaggcatcatgctactttacttcaaactacactacaaggctacagtaatcaaaacagcatggtactggtaccaaaacagatatatagaccaatggaacagggcagaggcctcaaaaataatgccacacatctacaaccatctgacctttcacaaacctgacaaaaactagcaacgaggaaaggattccctatttaataaatggcattgagtaattggctagccttatgcagaaaactgaaactggaccccttccttacaccttatacaaaaattgactcaagatggattaaagacttaaacgtaagacctaaaaccataaaatccctagaagaaaacctaggcaataccattcaggacataggcatgggcaaagacttcatgactaaaacaccaaaaagcagtggcaacaaaagccacaattgacaaatgggatctaattaaactaaagagcttctgcacagcaaaagaaactatcatctgagtgaacaggcaacctacagaatgggagaaagtttttgcaatctatccatctgacaaagggctaatatccagaatctacaaggaacttaaacaaatttacaagaaaaaaacaccatcaaaaagtgggcaaaggatatgaacagactcttatcaaaagaagacatttatgtggccaacaaacatatgaataaaagctcatcatcactggtcattagagaaatgcaaatcaaactcacaatgagatatcaatttacaccagttactagagaggatgtggggacataggaacgcttttacattgttggtaggagagtctagctatgaaagtcctagatgacatcttctaatagaagactatttaatctacattggaaatctgttgtttagggtaaccaccttcatcagtaatcttagctagatcttctggataacttctccatcagctcttgctgcttcaccttgcacttttatgttatagagactgcttctttccttcaacctcatgaaccaacctctgataggtactgacttttcttctgctgtttctttgagagcctcatagaattgaagagtgttaggggcttgctttagcttatgagtatgttgtggctggtttaatcttcccagatcactaaaactttcaccatgtcaccaataaggctgttttgctttttttgtaattcacctgtttattggaatagcactttagttgcctttaagagctttacctttaaatacagaacttggctgtttggtgcaagaagccagtttagcctctctcagctttcgacatacctttctcactaagcttaaacatttgtagcttttgatttaaagtgagaaatatgtgactcttcctttcacttgaacacttagaggcaattgtagaattattaattggcctaattttaataatgttgtgtctcggggaatagggaggcccaaggagagggagagaggtgggggaatggctgtttagtagaccagtcagaacatacacaaaatttgtggattaagtttgccgtcttacattggtgtggttcatggtccccacgacaattaaaatagtaactttagagatcactgataccagatcaccataccagatatcataatgaaaaatttgaaatattgtgagaactgccaaaatatgacacagagacaagagctcatgctattgaaaaaaatggctctgatagacttggcttgatgcagggttgcacaaaaccttcaatttgtaagagacatggttatctgtgaagctcaataaagcacaatacaataaaacaaggtatgcctgtatgaattcctttaatataatcctcataataatctaacaaggtagacattatgcccatttgatagaactaggaaattgaggcataacaaggttaagcaaattgcacaaaatcacttgctttgtaaacggcatgatcaggaaccaaactaggccagcctgatgccaaaacttgttcttaatgcactaaattgattggtttcaagacttaactcctgctgcatttaaaagtcttcctatctcattggttccctttattctcacttctaatgggcattttgggcaaactttcacgatttagcttccttgaaatagcaggtagatttcttacctttgagcctcgctctgaccccttcccggtagaagactcatgaaccataggttgaaggtgccttctacttgcagggtattttggtttagctggatgggggagggatgttgatcccttttttgattgatttacatttggtggctcagcatgataaagtagaaagagtattgatggagtaagattcagtagatccaaatcccagatccagtgcttgcagcagcatcacttcaggaaaacttgaagagtttttctgagtcttcctatcacagattataggatttctataaatatttagttggaatatataacaaaataattaggaaagttagttttctttctacttaattggcttaaagcaattctgtaattttattcttatcagtttaaaaatatctcctccgctatttaacatttgatattatattacttctagcactaaatgcataatcaatgttgtggtgtgtttgaaccagggaatttatcagtttctgaggatgttagaaatttaagtgcctaatgtaagaaccatgcccagtttggcagagaaattttcagttcagagacaattcaagtaccctcccacatttcccactcctctagaagttaggcaatcccgtctaactacttctggccagtgggctgagatgggaagtaatgtgagtctcttccaggcaaaatgcatttatgagctggtgtgtggtgcttcagctctctttttccctaatgcagcaaccttgaagttgaatattcctgttgacatagttagaagatataagtagtctgaatccctgtgacatcacttggaagccagcaaacccacagaggactttgcatgagcaatcactaaatctttatgaattatactgtgatttgggggatttgtttgttattgtattatagcctaatctaacttgactaatatacatagcctttggaggtgtgtggtttttgcttggtaaggatataggtaactaaaaaatactaagaagagttgcagcagacacccaaatctaagtagactcctaatcaaaaggtcattgttaccaataactagttctgtggttctatagatagagaaaaatttttttcgtaacattttcaaagcaaacattttgt

SEQ ID NO: 354 - DNA, 969 bp, Homo sapiens
tgagaatgggcctacaaccgctggatttactggttgtatcatatacttacagtatcaagaagtaactggcctgttgctctaacaggccttctagcaatggccttctcaagacataggtgaagctccagcttgaaggcaataatccgaaaggatgaagaagcaccatactcagaatgcacactatacatttaaacagagacctaaatgtgatgctctgccaataataggaagaatatatgggcccaggtaccaaggtgggtagcagaagggttcctcttgccatcatctctgacatactggaggacattgtacttctcatccctataattctgggcattgcattgctagagttccttgcctaaagtgagaggactcttacaaggagacatagcaagagtttcattcaactggaacactttggacatcttgtgttcagggtctcacaggtaagaagagactcatcatttggtagaataattgacactgatcagcagaaggaggtagcgaaactttcagacattgatggttaggaggaatgtatagaaagcaagtaatctctgagcacatcttggtactctcttatctcaacataagtctacatggacctatgcagcaactctgaagaaagaaccgtgtgaaaaccaggagatcagatccttcagaaatgatattttgggtcacaccaccaggttccattgaagacttgacgaaggcgaagaatctgcaacaccttttggacctttgggctcacaccattgatacctctgatcttgatgacaaaggccaatttggcttctgcaggtacatagaaattgccagcttttcttgccatcctcgccattcgaatttcagttctgtaaatctgcctatattccttgtaatagtgcttctctttttcatagataagcttcctccttgcctttcaaagcatcttttgggcaaacttctttctcaggcgcttgatcttca

SEQ ID NO: 355 - DNA, 772 bp, Homo sapiens
ctgggtgaactgtctgattacattcagaaacgctccatgcaataccgcatggaaatcaaaaatgccttttaccacagacacggcagattccaattattcctcagatcggaatttttttcccctccattgataatcaatgaatgatatttacatgatttttatcgtatgtgttccctgcagagcaaactagtatctgaaaattacattgtcttgtctacagtttcctatgttcaattttattgagttttgtcttccttagtcaaactacagtagacttggggaacaaatgtatcatctctctctctttctcccctctctctccataccgtgaatatcataaaactttttattttctgctaattcggaacacaattttctactccagttttgggggtttcctgtcatttctaactgaatgaaatttatgcctttttcacatctttaatgtattcccaagtctcaatcatgttacctactgtaggtcatcttcttcatgctttaagacatcattttcagaacattaagaccttctgttcaatctggatcattttctgtggaaaagccaaagttgtatgttcaccaaactgcttgagtttttccttggcacacacaaagattgtctctcccagatcatttaggcgatgtcatgtgattaattttggccagtggaatgcagtcagatgcgacgcccaccactctcacctctagtctatgagaaatctcccacacacaatctccactatcacccctttcataacagtcttgggctgat

SEQ ID NO: 356 - DNA, 1257 bp, Homo sapiens
aagtcttggaggacagtcaccaagaactgctttggattcgggaacagagctgcctaacccatccgcagccctggggtcctgccctgttcctctggccccttcagggcagcgggggaagcagggaaaacagcctgtcagagatggcagagaaaccgagcaagaataattatcctggaaaagactttcagaagtaaccaccagaaacttcgagtccccagatccaaacagctgagaatgtggggcctgagccacgctctgactccactcccaccacatgaggagaaacaagagctgcttttctggaagacttgaacaacccctgctgtgctctggaaggacacatatccaaagaacaacaggactcagatgaaaactggatgacaattagaagaactatttctcagggctgggcgcagtggctcacacctgtaatcctagcacttcaggaggccgaagccggtggatcatgaggtcaggaggtcaagaccagcctgaccaacatggtgaaaccctgtctctactaaaaacacaaaaattagccgggcatggtggtgcatgcctgtaaccccagctactcaggaggctgaggcatgagaatcgcttgaacctgggaggcagaggttgcagtgagctgaaatcacgccatttcactgaagcctgggcaacaagagcaaaactctgtctcaaaaaaaaaaaaaaaagaaagaaaaagagaaaagaaaataatgccggccagaggcggtggctcacgcctgtaatcgcagcactttgggaggccgagccaggcggatcacctgaggtcaggagtttgagaccagcctgaccaacatggagaaagctcgtctctactaaaaatacaaaattagcctggtgtggtgacgcgtgcctgtaatcccagctactcggaagccagaggcaggagaatcgcttgaacccgggaggtggaggttgcggtgagctaaaattgtcccattgcaatgcagcctgggcaacaagagcaaaactccgtctcaaaacaaaacaaaacaaaacaaaaaacaagaaagtaatccccatctccctcactgtaaagggtttcaatgaacaagaagataatttggacaaagcaatctatgaaacaaagagaaacaagctatgatgacgttgatatgtgacttgggtattgcacatgaacaataattagtatgtgagtaggcaaaatagctaggcatggtggtgctcacctgtggtcccagctactcaggaggctgaggtggg

SEQ ID NO: 357 - DNA, 1000 bp, Homo sapiens
ggtgaagaatttggggttgtaggtcttagcagtctggaatgggtccagttatctgaactgttgagactctacctaaaacaggaatagaaaatccaactatgagaactaagagatgagcttgatagagcgactcttgagaatgataacattttgtatcaaatataaaaaatattaagatctaagaggtttaactaactttttttgaatcttctccagaaacttttattgtggctgccaatattttggacagatccttggcttttctgaagttgaaacctaaaattcatctttcactggggtctgttgtttatgctgattgccagaatagttgaaaaagaatgccatgttttatctactcatgaagtaatcttgattcgtcaatgtaaacgcactgcttcttctgacagaaaactgatggaaaaataatttcagaaaaaaatttggaactatgaattggaacgtactgtaccttaaacttcttttgcttctataagactcatatttctttatatttgagaaaggaaagaaatattgggccttataaaccggaagctcagctgaaaacttgcaattttttgctaatgttttcaaaagcaaaaccatctgtattagttttgtgtcttcttaatctggaagtagaactgttgtaatttactgaattattgaaaaatgtcctgcttcttataaggcattcaaagattaatgacaccgaattcttttagtggagggaactagtttctaaatgcctagctgaatattttctctatgtgttggaagaaattgctttgcattgtttctagatgcagagcccagaccctccaagacagctactgtggtgttcctaaattgtcaacaatattggaggataactgtcctgatgaaagtgaaagtgaggactctgaagatgtgagttgtggggaatgaagtctcagcagctttcatcgcagagatcaaagacgtacatctttttgaacttgaaagtgacacagtctctgtgctt

SEQ ID NO: 358 - DNA, 1816 bp, Homo sapiens
actcccttatgtggggagcaggactgatgccttgagttacttatagtgactcgttagttgggggatttgctagtattttcatcaaacttgaatctagtgaaacatttgattgaactggcttccaaattgaaaataaaccaacaccactcaggaaacctatttacagcgagaagtcaggagtgggaatgcatcttgcactgtcaccttgattaacaatagctctgacctgtgggaggacggtcctctctcctgtaacaaacatagggtagtgatgggccaggtcctgctgctcctacattctcatcacttagataagcacaggcaggtgactgcaagccttccagcctccaccagcatcctccagttctcccctgaccgctctcattcatattccgcactgattcagaggtccagtcctgagtggcaaaaagaaacatgcgtgagcctttctagaaatcaatcaatcattcatggattatagtgaattcttccctactaaacacatctccagaaattcaggcgtagtaactcccttcctgaatgtctttccaaggccctaagtgacattgatgttccatagacaatgtcttacacggcaaagtgcttctgggggtgggaacctgctgaccttccctggaatcctgactgcaggttctgtttagaacatggggtctcattttgagaagctcttggtatttatcattcacgggaagttcacaggttccagaaaacactggacagcattcaggggaaagaaaaggggcagagatggagacacctggtcagtttggccagagcatcctgggggaaatgcactgagggacagaggggcaaatgcacatgggtggtggggagaggagcaacgcagatagcaaagacactgtccagacaacctcccaactcaggagaagggactgaatccaagaggagaagaggagggatgaggctgggtgctgaggcatgccccaaagtctttgaagtctgaaaatcagacacccgtagacttgattttggtgtcctgatagaaaaacaaaaacaatgctagccataatttttaaaggctttcatattttgggaaataagcttctcatttgaggctagatttagttccttccctctgaaacatgttcaattcatgatttctacttaattcagattttctagttttgtaacaacttaagctggttgatctagctttgcaggcaggcaggcaggcaggaaggaaggaagaaaggagggaaaagaaggaaggaaggaaggaaagaaacagtaaaagaaaaaaaaggaaagaaggaaggaagaagactacaaaagtctcaacatgaagtgtttctgcaagtaaacaaggaattcctgcttttgtaccaaggactccatagttgtctggactccttaggggccacaaggccactggccgtgatgtttcagtgaactgtgaaacaaagcactgacccgctgctgttccaccatgatgcctccaatctctgggcctcgagggaagatagtattcgttcattctgaaaatacttatttaggatgtaccacttgtctggtgagtggtgagcatgatggctgacaggcagacacaggcaataatcaagtacacaagtaaagagtaattaagtccgcttattttggaattaaataatttggagttcaagtcatagttcagtttttgacaaccatgtcactttgggtgagacacttaaatgtatagagcctgcacttcctcacttgtaaaggggaattaaaaatgtgggtattgagaagattgaagcagataggttaggtagtgcttagaaggcagttccaagca

SEQ ID NO: 359 - DNA, 2619 bp, Homo sapiens
tttgttctttcactcttcacagtaaatcttggctgctgctcactctttggttctgcattacagcaagggtctgctgcttcactcctgaagtcagctagaccatgaacccaccaggaggaacaaactctggacacaccatctttaagaactgtaacactcactgggaggagccacagcttcattcttgaagtcagcaagaccaagaacctaccggaagtaaccaattccagatacaatgtcatactacatttcaacaaacattgtgctacaatacaatgcatttaaaatatttggactttttcaaactttcaacttttagaagactaacattttctttaaaatatatgttgcttttctctgttatttatgggttatttagccaacaatttgtgattgaagctgtgtgtccaagcaattggagcttctgaatttaataaaaacaaatcttcaccatttggtttccattatttagcacaatgaagtaaatactgtgcctttaaatgcttttttgacatactatttaaatgttttattgacatattatttaatctgtgtaataatactatgtataggtcatataacacctattttaaaatgaagaaataaggcccagagaatttaaataaatcacccaaggtcacacagacaatcaaaagcagagctaaatttttaacccaggtttatctaactccaaagctcatggtcttaatcacactgtagtttacattgcattatttaaatgagtgagcatcattattaagtgaatgagtatataacttattttcttttagccatttcagggagcctgttttccatcacatggaagataatttcacaataatatgactattcttctctcatagccataagatgatgaaaataaatcatttaaagtgcattttcttacctagaaatgtcttttgtttggcagaatgattaaaataactgtcacttattcacttaggaaaataaaagtagttgaaggggagaataactttataaagtgatattttcagcagcaagggtggcctctttttcttctcttcaacacaattatttctagttaattttactgagggagggaatttcatgaattttgtactctgtatttagtgaccaatatgtttctcaaggtgctaattttctgttaatgagcaattgctgtggttggttggcattataaactgaagtttataaactactttaaaaaattagttaaaatatctgattgtgatcctaccagaaggtaacattagaaacctattgaaatgatccgtagctttattttttttgttaagcataattgtattgcttgataatatgtactaatcatcaagagtcatagtaaacatataatctactcaccaactgaaatcttatggctcaggaaaattttttgttttgttttaataagcagtttctttgcaaattaagatatttttaaattgtcgggataaatataatggggactattctcatacattcatacatactaaaaactgctttaggcaattttttgaaaatatttccacattatatgcaagctttggaaaacaggaaccaccgctataagcatatctgctatgttagaacatgaagcaaaggttaatttccaatttaatgtttcctcccagatggagcttctacctagcttgtcatcaacatctccatttagtgtgaccaaaatgaatagtgaccaaatcagaattctagagtttatagaaatgttgagttcatcctccagcctctaagctgaaatgtggttaattctcccctggcccaagtctctctcaatgtaatgctgttcatttcccaaaggtttcttcttcttcccttatataaacatgactgaagcctacaatgatacactgtaggagcatccccactgatgcaatgttggaaggaagcagagattggcaccttatatccttattttaattattagattttggagaaatccctattctgagcttctccacaaaaagatctcaggtgcttttcttgcctcgcagcaccaattcctcttctgttaatatcacatatattcacttgaggaaaactctcctcccagacatgatttaggtggaattgctccgatttccacttccttcacttgaaaggaaaacacacacaccaagacctaaaaaactagtgcttaagtgcttggcagacaaacccaaatttgcaggcttctaagagctcacattctggatctgaccgccccaagatcctagtttacaggtagtcatatgtcaccttcaggatattcgccacagctaaataccacctgttctgtaatttacttactcttttttctctaatttgactttgttaagtaaactttctattttgaaatgattttaaattgacatgcattggtaggaaataatatagagatgcatttgtaggagataataacatgcatttgtaggaaataatatagagatgtttttacctggtttccctcaatggtagcatcttgtaaaactatagtaccacatgccaacgaggatattgacattaatacagtctaccaatcttagttggattttgctgctacccagttttacatgagctttggataccagatacatagaatgacatgtcctcatttgcatc

SEQ ID NO: 360 - DNA, 4642 bp, Homo sapiens
gtcaatgggcagggcttgcgatcttcgcatgtgtcttatcgtaaagaattgttaaaatttaggatagggaaaaaactatttaatggatgaagcgagaacagcaggaagaaaaggagggaaggtagttttctagtacaagcatattgagaagaatggaggacaaagtttgcgaagagccaggtataaataggctggggcagggtgctagtaactgggcggggtggggtggtgggaagtctcccgaaatcaggaggtgcgtgcctctggcttgctgtgtgaacagacacactgggtccggtgatttaagctgtaaaatatgtgattagactgcaggtagtctaaatgtcaaaactgcagcactccacagctctcactaggcactgctgccttagtatttattttaaaatatagattacaaggccgggcgcagtggctcactcctgtaatcccaacactttgggaggccgaggcgggccgatcatttgaggtcaggagttcgagaccagcctgaccaacatggtgaaaccccgtctctactaaaaattacacaaaattagctgggcgtggtggtgcacgcctgtaatcccagctacttgggaggctggggcaggagaattgcttgaacctgggagacggaagttgcagcgagctgagatcgttccactgcactccagcctgggcgacagagctgagactgtctcagaaaaaaaaaaaaagaataaaatatagactacaggccaggcgtggtggctcacgcctgtaatcctagcacttagggaaactgaggcagtcatatcacttgaggtcagcagttcaagaccagcctggccaacatggtgaaagcccgtctctagtaaaaatacaaaaattagccctgcgtcgtggcgtgcgcctgtattcccagccactcgggagggtgaggcaccagaatcacctgaactcgggaagccgagtttgcagtgagctgagatcatgccattgcactccagtctgggagacaaagcgagactccctctcaaaataaataaatagactacatagagatatatagactgtgtatatatatcatataatccatataaatgcagaaacatttattgaaagacatttcgaagccatcgtgtttgtatttcatgttcatgacaataaaacttgtaaacttcagtaacagttaaaccttctttaattatggattagccattaacatttttgaaacgtggaccatttaacctcggcctaccccctccaactgtcctggtgatgagttcattagctaagttaaaattaatttgaactttgatctaaaccaaaacaaatcaggaaaataaagctgtaaaggaactttatcaagcattccaaaaccaactagaaattacttgaagttttcgagtgagcattgcctgtgccagtattcttcattataggattataaactcgtttttttcccaaagcgcatgtctacgccaggcagaggagtaattattcagccaatttcatggatgtaaacgatggatataaataattgatagcacctagaggcttccagtttgggtggaaggctaaaagtagaggggaactcactcacttgagaaatgatatttaagtgaataaatagttctcttctatgaaactattactatttagttctctggaaaacttaagtgtattaatgattagaacatcaaatcctaagtaaagaaatgacattttaaatataaaaagccaaactttaaataaatcatagagacctcagacataatataggaaagaattcttttgtccttgtttacactgtgtacatagtacaaatataattttaaagctacatcctataacatttaagaaataacagtagtttcaaaatgcttaagatgaggagaaaaatgccttagaagactaggtttctaaaagtcagaaataaaagtacaagttatttttcttctatccagcaactttataaagcaacttgagtcctgaagaaaagaccgttgttcttttaagaaatgggtcttctcgaattataaactttaacaccattttgcatcgaagaatgagaatatttagtgagtaatgcacctatggtttgcttctctccacacaattactgaatatatggagcaatatcttcttctgtccacttctcccttagagagaaaaggctattaaaacgttcctgattatcctcaggtaaatcatctactttcagcaaaaatatgatttctggtctcgagtgtctatccaccagcgctaaaccctacaagaaatgagaagaaacagagcagttaaagtaatgttgtaatgtttaaacatgactcattcttttacctttaggtttagcttagctcaagatattcaaaatgtcagctacatgaaacttaaactatccagagatttacaatcgcctttttcatacaaagagctcctttaagcagtgacttctttcctcctctgcaatctggcttctaccatcagcagtctatcaagacagctttggttctaaaggtcaccagtaacctgtcattgccaaatccagtgggcccttttcttggattcatcgtgttagccctctattttctattttgtttttttttcctttttgagacagagtcttgctctgtcacccaggctggagtgcagtggcacagtcttggctcactgcaacctctgcctcctgggttcaagagagtctcctgactccgcctcctgagtagctgtgactacaggtgcacaccaccacatccagctaatttttatatttttagtagagaaggggtttcaccatgtaggttaggctggtcttgaactcctggcctcaagtgatccacccacctcaacttcccaaagtgctgagattacaggtgtgagccactgtgcccagtccctagccgtctattttcgttactgttgattactcctcctcctttaaatatctctccatccctgacatcagtctttttattttcctcgtaacttgatgttgtagctccctgaggcttccatcccaaccactccacttgcttcactgtcactctactgagtaacctcatctaaacctgtagcctgagccaccacttacttgctaatgactataatacttatatcttcagctgagatgtctctcttgagtcccagacctctatatccaaatctatacatgaactcatttatcatccaaacctgctctagttccactatcctaggaaaacaggaaactgaggcatcagctttgattccattagtcaaaccccacacctatgtggtcactaaagtctatataataggtgttaaggcttcaggattcctctgtccattcccccattacctatctctttagccagtactctcttagttgggagcatatgtgttgacagcctgcacagtaatcctttttcataatctaaccaaccttccgtctgtccatcttgtttattgtcatagtattcttttcaaaaggccaaactgatgagttcctgatgaggtaacctctctaactgatgtcactcagtggcctcaaagagctttctagaaagagttgaaagtccttagcgcagtccacagtgtccttacctcacaagcatcctttactccagcccatgcatccctacaacagtgccttaatttttatttgccccccacctttgaccgtgctctcctagatttccacctctggctttccctccatctagagagcaacagttcatctttccatactcagcagctaaaacgtctattccgtcagaaagtcatccgtgattgaccagtctgatggctaagccccttttctttgttctcataacatcgtgtgcatgcctttcccatggcgtagatcactctgcattgtaagaacagatttatgcatgtaatatgtctcccccattgccagttcccaggctaagcaccataatgacacctggtatgacatttctcctgagcacctagcatggtgcctcaacataaaaagaactccataaataccaagcaaatcttttcatttaactaacaaaatatttaccaagtatacgccacatgccaggtagtatgctacatactagcaagcaacagcaaacaaaatgccatcaaagtagagagtggtgaaccacataaacatttttccaagctaaggggagagtgccatgaaggaaagaatagcgtgctatcaaagagtaaaaccagaggtctttgcttcaagcagagaatgaaggaaggcctccttgaagtgactcaaagatgagcaggaggtgaccagatgaaattagagagaatatcattctagaacaaaaagctttgtgtgaaggtcctaaggtaggtgagagcttgatgatgttgaaaacctgaaagagggttggtatgcagtgagcagaagggaagtagccagagatgaagctatgaaggtgatcctgaagggccttataggccaagacatgaattctgagttttttatcctgagtgcagtaggtgaccattaaactgatttaaggccgggtgcagtggctcacatctataatctcagcactttgggaggccaaggtgggcagatcacctgaggtcaggagttcgagaccagcctggccaacatggcgaaaccccgtctctactaagcatacaaaaattagctgggtgtggtggtgggtgccagtaatcc

SEQ ID NO: 361 - DNA, 4674 bp, Homo sapiens
agcaggagtcggaagtggcccaggcgcaggagagcgcggagaagggctgggcggcggcccgggagccggactcggaccgcgaggcccagatcgctgggcgctggagaacaggaccctcttgggagatgtgcataggatacggtattcctgagcctctcagtttcttccgttgtaaaaatgagacgccaacctcgtagtgtgttgagatggttaaatggggccatacacatttgcactgtgccttgcacttaacaagaacgcgtgaatgttagtgtctgctgccatcattattgactattatgatgatgatccgtgaaagcccctgaattccgcctgctcttttgcttttaattttctgcgggccttaagtctaccctacgatagctgacgcgctcccgattcctggtttccatttgcggagaatgcagggcttcctcttggagttaaagactcattggctcctggaaagccctcgctctctgccgccccccgcggacttagctgtgactgtccttgcctgtggagcagaaggcttgccctcctcaggggccacccgagaccgccaggatggagtaggatctggaccttcagtctgttgaggagccctggcccggggtagccattttcaagggcgagggaccttggtgggagtacgatgaatccatccatacaataaacatccattaagcacctagtacatggcagcggggggcagagggctggaaatattaataatactagtaaaacttaatatgtgtaggtcaccgttctactccttacaacaatctatgatatagatcctgtcgctatccctgttttacaaagggaaagggagacatcgtgaagtaaatagccttcccaaagaaagttacacgtttgggaaatggctgagtttggcttggagagaggaaagtaaactcttgataggtgaaatagacaaaatcacaacacatttgggtttaatgcaaaagatagaaacatacacaaggtacggaggtttttaaaagaggaccttgtcctgtggttataactttggggaagggcgtcagggagatcttcctggtgtaggtgatgtctgagctgggtttggaagaagaaatgggagcttcaaaggcagcttataagtgaagaagaatcacagtaaactttttcaagcctgaataaggatggaggagaagtggaatggtggccggaataaagctaaaacagtaaaacaggaccaaactcaagggctgttttcctatagaaactaaacaacattaatttgacctttgattggtaggaagccagaagggttttaagcacaggagatatgtcaggtgtggttctagaaagtttaatctggaaacatagaagatcccagaaccaagaaacttgcttaggaaatattgaaatatgtcggtgagatacttcagtaggcagaatgagtagagttacagaaagaggtccacttcttaatccctggaacctgtaaatatgttatcttacatggcaaaagaatttttgcaggtgttaccttctcattcggtcatgggaaaaaaaagaataaagaaattttgcaggtgtgattaagattgatgccattgagatgggggattatcctggattatttcagtgagcccaatctaatcacatgaatcccctaaaatggaagaagagtgggtcaaagagattcaaagtgtgagagggactcaacctgaaccacgaaccaaggactgtggataacctccaggagctgggaaaggaccttagctgacagccaacaaaaaattcactttctttatctggtctagacttgtttttcttccacagtcctacaacagcagaaactgaattctgccaataacctaaatgagcaaggaaatggatcctcccttagagtcttcagaaagtgattgagctctactgacaccttaattttatcctgaaggggtttcaccatgtttcccagactggtcttgaactcctggactcaagcaatcctcccactttgacctctcaaagtgctgggattacagacatgagccacccctcctcccctgctttttttgagacatggtctcactttggacccagactgaagtagtggtatgatcactactcactgcagcctcaacctccccagctcagacaatcctcctgcctcaagtagctgggaccacaagaatgtgctaccatgcccggctaatttttaaattatttgtagagatgggggtcttcctatgttgcccaggctggtcttgaactcttaggctcaagcaatcctcttgcctgggccttccagtgctgggattacaggaactggccactgcacctggcctagcgtgtttttgtatgttcaaagaaacgttttgagagtaaatttgtgtggatttttttttcacatgtggtataaactattcacgttacaatagtaaacaatcttatggacaagtgtaggggggctgtttttttcattcaggagcacagtgctttatttgtaaaataaatcacgatttcctttaaaaaaatcacacacctttatggaggatatttttggattctttgatatcttgttaaacgacacttaccttcatttacttccttctctcccttcaccaataagcctccaaaggacatcagttcctctgaagatggcctatttcagaactaatttcccaaaatattcacacctaatcacatacaatttccaactctatttttcagtagccagttatttgttctatttcaccattcagaatgagaccctctccttctaaactccagttcatattgtgtcagtaccagtagaatcctgcactcttctatgtaccccttttccaatcattttctgctacagtgtggggtctgggagactcagatatttatttcctaaattatatgtaatttaaaggttgctgtcttctctgccatctaatatgcttaggtatggtatctgagtgatttgttctttttgttctttaaagggatttgtgaaacagttgaaatttagatgactgtcattactgtataagaatcttgggcttctgactatgaggtacagggccatggtgaatgcttatataacttattagggggatgtgttggggtgaagtctagccctcgcttcatttgctgtttcttgtggaactgcattatcagaagatatgcctcatttgtagggctacatccatgtaacttcatctacacatgaagttttctttaatgtaaactccagatggggcattcccccccgtcataaaacttctcattaggaaaaagccctatgagatcttaacatacactgcaagtattgtagcttgcttagttatcttcatgtctgaatggccatagtaatctgatgcattttctgcaaaacacagaatgaaacaacccaaatacagacaaccagatcctattttaaggaattatctttgcttgtgttcagaataaactgaaaaaaaaaaaaaaaaggtatggcttcagaaaacaaatatgctgcaatttcagaaatgatgctaagagtagattccaaaggatttttaaaacttatttaacgtatgtccagggatacaccatactggctgagttctgttacacaggtcatacctgtacattgcatagaaaattgattgtccatgaataaagcattttttccactgtggagtgaaatgtgttgtcacaccaattgtttctattagtcatctgtatttgcagtggaagaacttaaaagtgtttttgttccaaggacccctgtgaaacaatgtgacactctcagtgttagttccttgagtaatggaccatatatgtgcaatgacagccaagcagaaagaaaaaacatcttgaaaagctcaaaaacagattcagctttgaaaataactggactgaaatctacacacatttctagaatactaacaggcacattcaaataatctatgatcaactttttccaggtactccaatgcagcaatccccaacccttttggcaccagggactggtttcgtgggaagacagttattccatggagccagatggtttcaggatgattcaagcgcattacacgtattgtgcagtttattattacattgtaatatatgatgaaataattatacaactcaccatgacataaaatcagtgggagtcttgagcttgttttcctacaactggatggtcccatctgggggtgatgggagacagtgacagatcatcaggcatcactctcataatgagcacacaacctagatcccttgcatgcgcagttcacagtagggttcctgctcctatgagaatcgaatgcctccactgatctgacaggaggcggagctcaggtggtaatgcaagcaatggggagcagctataaatacacatgaagctttgcccaacactcacctcctgctgtgcaacccggtaccagttgtcacccatgggctggggactcctgctccaaagggtaacattttaacattcagcttaaataaatttcaccaaaaatatctcaacaattcaaagaggagtgttcctgacaccagatcactttattcaacagagcagctcccaaagtcatgaagtactacttggtttaaaaataaagctgtttttcccacgtacacacattcaacaaaactatctttggtattactttactgagtgaggtttaaaggagtttgggaaaatattacagccttcttcctttt

SEQ ID NO: 362 - DNA, 4392 bp, Homo sapiens
gggacacggacagccgccgcctgcggctccgaagctcgaggtctcccggggtgcggggacgtggggccgaagaccccgctccgcagccgcggcgaggcctcgtccttcactgtgcagatgcgaagctttcaaggacacgtctgcaccggcccggcgggagggaagagggaaggagctgccatctatggaacccaatctcacttcatctgcaccgagcatggtctcagggagcatagcgagacatctcaccatccacccagctttccgtggggtgcattagtttcaagatgaaagattagaaacctgtggtcatgtactttcggatacaaacgttttagtgagtataaagcagtggtggtttttttttttcattcatattcttttattaggtaatgtaccccctaatttataagttgagttccatataactcaataaagggggtgtcatttttaaagttaaacattttctggagataattttagattttcatgcagttgtgagaaacactaaagagagatcccatgtacccttactcagtttcccctgatgataccatctcacagtgaagtgggctgtcacaaccaagatactgacagtgacgtgaacgtttccattaccactggattcctcatgccaccctccagctggccaccccttaaccctgaacaatgactaatctattctctttttctataattttatcatttcaatagtgttatagaaatgaactcattcggccaggcacagtggctcatgcctgtaatcccagcactctgggaggctgaggtgggtggatcatgaggtcaggagatcaagaccatcctggctaacacggtgaaaccccgtctctactaaaaatacaaaaaaaaaaattagccaggtgtggtggcgggtgcctgtagtcccagctacttgggaggctgaggcaggagaatggcgtgaacccggtaggcagagcttgcagtgagccgagatcaagccactgcactccagcctgggcaacagagtgagactctgtctcaaaaaaaaaaaaaaaaaaataaagaactcattcaaggccgggcacagtgcctcatgcctggaatccctgtactttaggagactgaggtgggtggatcatttgaggtgaggagtttgagaccagcctggccaacatggtgaagccccatctctactaaaaactaaaaacattagctaggtgtggcgtcaggcgcctgtaaacccagctactcaggaggctgaggcaggagaatcgcttgaacctgggaggcagaggttgcagtgagccaagatcgtgccattgcactctagcctaggaaacagagcgagactccatctcaaaaaaaaaaaaaaaaaaaaaaaaaagaaagaaagaaacgaactcattcagcatatagccttttggaactggctcttttcaccaagcataaccctctggagattcatctagattgttgcatgtgtctctagttcacccctctgtattgctgggtaacagttcatggtatggttatgccagcatgtaaacactcacctgttgaaggacatccgcaggatttctagtttccaactacagcttagaaaactgaggccagagagtgaagcaactgcacaggcataatacggcacagctggcatttcagctccagtccatttgccagagtcacacgggatgacaggtgagaaacagaccaggcagcttcaatgggatagatggagacttgacgtcattgataatctgatgccttgaaagtcgtgtgtaagaagctgactctgaattggagggaggccaggagatttgcacccagctctggcaatgggtttggggaagctataaaccacctttcaaagggaacacctggtcgggtgcagtggctcatgcctgtaatcccagtactttgggaggccaaggtgggtggatcacctgaagtcaggagttcgacaccagcctggccaacatggtgaaaccccgtctctactaaaaatacaaaaaaaaaaaaaaaaaaattagccgggcatggtggcgggtgcctgtagtcccagctactcgggaggctgagacaggagaatcacttgaacctgggaggcggaggttgcagtgagccaagattgcgccactgcactccagcctgggtgacagagcaagactttatctccaaacaaacaaaaaaccacaaagggaacatctattgctgactgaaaacagatgaggagggacgtagcaactgatttgcattgttctaggagcatccagatcaaacgtatattcaggggccagaggagaagtgtaactgaatttagaggagcggatggagtggagaataactcgaggaacagcgccatcggtgtgacactactcacactgcagccatgaagggatgggctctccggggagtgtggagaccagaggttcgggggtaggctacaacctggggctggaagagatgacaacaaaggagagagaagggggctcagggaggcagggcgagccagatgaatgaatgaaggccaaagacaaagggactcagtatttccgaggcaagaggtcagggaggaaggagtgcatttgttatctacagcgcataacaagttagcccatatcttagcggctgaaacaacacgtattgtctctctgtttccatgggtcaggaatctgtgagtggcttgctggggtcctcaggctcaggctctctcacagactgcaatcaaggtgtccggctgctgtcatctcaaggtttgatggggaaggatccacttccagcctcactcacatggttgttgttgacagaatctagttcctcacaggttggtggactgagggcttcaattcaatgctggctattggccagaggctgccctcagctccttgccacgtgggcctctccacaggacgctcccaagatggcagctggcctcaccagagaggaaggaggagagagcgagagagtgtgtggcaagcgaagagacgaactttcataaccaaatcttggaggcatttgcgctgttctctccgttaatagccagtcactagaaccagcccacactgaagtggaggggattacaaggatccagataccaggaagccattttagaagctgcccaccacaggagcaaaggcaagggggctggacccgacctaagactaccccaggcagcccagagcagactgtccgagagtgtgaggacagaatcccagcccgaatcccagctgtcccagcaccacagggagacatggacacactcagggcctcctgccggttcccagaagagcctggctcagtcatttgcctgggttcactcccaccacccccagcagtgccgggaataaaacaataatacacagcagcaaaatgcccctccagcagcccatgtacacagcctggctcaccttccccatcttaccagccggcactgccatcgggacacggaaacctcttcaggacgtgggaggaggggaagcaattccatagacatttctgggcccttctcagctgcccccaccagcagccagcagccccctggatccatctggggaaggagactcccctttccctgagggcctccccctctgagcctggccagcaccctgggcctgttctcctgtccccctgcagctgcagggccataggtccccttgtgggagggacagaaggacagagaggcaccaggaaggtgggcaccagggccttcccaccaggagccgacactccccagggaacatttccggggcatgctcaggaggcaggaagtgggatgcaggggaaatcctcaaaggctgaggctgcggctggacagagacttgagggaggaacagaggaggatggcaggtacaaatctcaacccacggcaggtaaaagacatgcacctttttagaagtcccctgatgtcagtttttagaagtcccctgatatttgtctctgcccaaatctcatgtcgaactgtaatcctttgcatgggaggtgcttggatcactgggctggatttcttgtgaatggtttaacgccatccccttggtgccgtccatgtgttagtaagttcttatgagatttggtcatttaaaagtgacacatagcatctctcacaaagtgtgggagcacactctcactctcttgttcctgcttttgctacctgcctgctcttcctttgccttccatcatgattggaaacttcctgaggcctccctggaagccaagcagatgccatcatcatgcttcctataaagcctgcagaactatgagcccatcaaaactcttttctttagaaatcacccagtctcaagtttttttgtgtgtttttttgtttgtttgtttttgagacggagtttcactccgtcacccaggctggagtgcaatggcgcgatctcggctcactgcaacctctgcctcctggct

SEQ ID NO: 363 - DNA, 1047 bp, Homo sapiens
tgtgttacagtttcttacagtgttgagtagagttgcatgctgtacaggtttgtagccgaggagcaataggttctgtcatacagcctaggtctgcagtaggttgtcccatttaggtttgtgtaaggacactctttgatgtgtacacatgaagaaaattgcctaatgacacatttctccaaatgtgtgtctgtcattaagcaacagatgactgatgtgaaatgtcagaataggccaatccatagagagattgtctggggatggagtaggagatgggtaagcaggaatcaggaagactgctgtagcacagggtttctcccccacttcccaccacttttttcaatagagacagggtcttgctctgttgcccaggctgaagtgtagtggcatgatcatggctcactgcagcctctaactcctgggatcctcccacctcagcctcccaggtgagtgccaccacacccagctaatcaaaaaaatttttctagaggcagggtctcactatgttgcccaggcctgcagagagtttctttggggggcattgaaaatgttctaaaattagattgtggtgatgtaattcagtgtgtctttgaatgagtttaagtgtcatgtcaagtacaattgtcttattcagcttagatttttggaatgtttgaagacaaacattgccgtggagatcacctggtagctttctgagcaggaggctgtggactgaggggagccatccactctgccgagagcttgagaaaatgaagactgaaaacagagcactggaggtcgttcatacgcaaaaatgctttcccctcggaattgtctccagctccttcacctcttggttgtaggtacagacagcagagacaagaagagccttgaagaggcagccacacattgtggtgaggagcacacagcctcttgctaggataggaatatgctacctatgctttggttcccaatatccttgccaataaaacctttgtctctgatcctctgatgaacatcaaatggatccacggctctgcggaggacccaagacaacttgcttgaattgtt

SEQ ID NO: 364 - DNA, 2239 bp, Homo sapiens
aagaatgaagtggggtttagaccctaaatgcttcagtgtgagctgtgaagccccacagcttggctggatcaatctggacttcgggcagatgcgcactaagggctgcttacctagaggagccacgtttctcctgggcagtcaagataactgccagaggagccacatgctgggtaaatcctgaacccaaagtggaattttgccctagtataatgggttcatattcgattggctgcacttagctataaatcctgaggaggagaagaagaaagacatcagaaagtaattggactagaagaaccttagtttggaagcaaaacacagaatccagaaactatgaagaaatttacatgcacacatatgtatacaagccatgagagggaaatgggaatgtacctgagagtgtcgtcaaagcgtacagtggctgcacagtgaaatattatgtttgtacaggagagaagctcctgcatgtcctctttgctgatggcaaagtcattctgattgagatctgcataaatagctctgatcttctcatgcacatttggacaaacttctttgactttctcaaatagctgaaacataaatatagatcaatatacaaaaaatagcaccatcattatcacattgttcttgtttataacaacctgcttaattatactcaaaaactggttttagttgtaataacattacttaaagaagacatctggctgggcatggtggcatatgcctgtaatctcagcactttgggaagccaaagcagggagatcacttgagcccaggagttcgacaccagcctgcgcaacatgggttctgtggactctttcactttggcctgtgaagacttctgactactggaaagcaagaagtaggagatggtttcagcatccacccttctcacgatggggttccttacatatgataatctgatgcctaccagaagaaactctgacccagacaggatcattgcataagaggttggttttagaagtagagttggctgaaattaaagtctcgagtgacatgaagacagtgttaaagataaatccaaactcttctttattgcttgacacttttccaatcagcattgacttcattcctggcaagctgatgtaacatgaatgagttatgaagccaaagatcgcaagaagagcacacttcttaacagccacttcagaggtgacagccagggaataagaaataaggaagaactttccagaggatggagccaccacaaataataatggaaaagaaggttcctcccagagattagatttagaggctatttaaggaatttccccactcccagtgtaggaagcttctcaatactcgctaatcaggatttccttatggttatattctagggactgctgcttgcctgcctgtcttctcttttttgaatagaaggtgtctttgtttgtttgattttattttttcttcaacttcgctgttctacaatgacaagagatagaacagagacattttctacctcaacattgggaggcagaaaattcacctttttatccaagaataccaaaccagaagctgaaatatctggatctgatagagaggatagtctattcccccttggactttggactggatgcaataatggtatgagaccctggggtaggaatgagtgtcttctatgtgtgggaaagagaggaaagcagatatttggcgacctaaaaagaaggccatggcagaacctcattagttgttcaacaatcctattttccttttctcctggacacacagctatgcattttccagccatccttgtggttagatgcccagtgacagttctgagaatggaatatggacagatgtgataggcacttctgggcctgggccacaaaaaccttccacatgatgtccagtgcctcttttaccccactgacagttttttattgtcatccagagagaccttggatggtttagaagccatgtgtagaagatggcaaccttcccttagcatggatccttgaatgactgtggagtgcaatgccttctaccaattacacctactgtgtttgagaatcaaatttcatttgtattaagctactgatttggggggtttatctccttcagcacccacattagtacaactcatgcagaatggagagttaatgtgaacacatatggcacagactggtgaaacctaggactttaagatgatagatgaatttctgattatactttcctttcccgcaaaaagtttttttcaaattaaatgttgtaatat

SEQ ID NO: 365 - DNA, 5764 bp, Homo sapiens
agttgtggccgcgactgcccgggagtggcgcttgccgcggtccgggcttgcaccccgctgggcaaagtacccggggctgtcacacggcgagctgagccctgggccggcgggtgaggttccccaagcggcgatgcccctggctccctgttccgccattgcgagccgttagggccaagctggagggagggcggcgaggcgcggctgccgaacagcaagccattggagagtcctgagcagagaaaggactgacctgcctcatgttttaaatctggctgccgtattggaagtagattggaggaaaaaaaagtggaagccctgggacccaccatcatgaacaatcggggagaagacaagaggccagcaaaggaatgaacacagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcgggtaagcggcctctttctactctcttctccaacctctctcactatccctcaacctcttttcctttcaatcttggcaccacccttcagtctctcccttctcttaatttcaattcctttcattttctggtagagacaaaggagacacattttatctgtggacccaaaactccggcacaggtcacagactcaggaacacagccttcccttggtgtttaatcattgtggggatgcctgcctgattattcacccacattccgttggtgtctgatctccgtggggatgcctaacttggtcattcacccacattcccttggtggcaagttaattgtagggacaattgctttggctgctcacccacattgcagcccagggctgctcatgtcaccccttctctccgtgtctctaccctctcttttctctccactttcctggggggcaagcaccccccaccccttctctctgtgtctctgccccttttccactttcctggggggcaagaacctcccaccccttctctccgtgtctctgccccttttccattttcctaggggggcaagtaccccccaccccttctctccatgtctctgccccttttccactttcctggggggcaagcacctcccaccccttttccactttcctggggggcaagcacctcccaccccatttccactttcctgcgggggcaagcaccttcttttcaagggcctgtttcccttgcctccataactgttgtgagtattgacagccaggcttctaaacctcttaaaactccccaactctggtgccaacttggacaacattctttaatgaactcctttttagttatcccacctgcccagctcgcttattagttcaaaacattgtaactaaattatctgcttccctgactattcctgggttaaagccacacctcactactgccttttgccccagttcaatgcctcctgcacatcctctccttgtatctccccaccttaatccacaagtgtaggacacctctactccctccttggcgatggatgatgcaccccttaccatcctattaaaatctaatcacccttaccctgctcagtgccaatatcccatcccacagcacgctttaaaaggattaaagcctgttatcacttgcctgttacagcatggccttttaaagcctataaactctccttacaattcccccattttacctgtccaaaaactggacaagtctcacaggttagttcaggatctgcgtttatcaaccaaattgtcttgcctatccaccccatggtgccaaagccatatactctcctatcctcagtacctccctccacaacccctccataacccattattctgttctggatctcaaacatgctttctttactattccttgcacccttcatcccagcctctctttgctttcacttggactgaccctgacacccatcaggctcagcaaattacctgggctgtactgccacaaggcttcacggacagcccccattacttcagtcaagcccaaatttcttcctcatccattacctatctcgacatagttcttcatgaaaacacacgtgctctccctgctgattgtgtctggctaatctcccaaaccccaaccccttctacaaaacaacaactcctttccttcctaggcatggttggatactttcacctttagatacctggttttgccatcctaataaaaccattatataaactcacaaaaccaaacctagctgaccccatagatcctaaatcctttcaccactcctctttctgttccttaaaaacagccctagaagctgcccccacactagctctccctaactcatcccaacccttttcattacacacagccaaagtacagggctgtgcagtcaaaattcttacacaagagctgggactgcaccctgtagcctttctgtccaaacaacttgaccttactctttttggctggcccccacccccatgactgtatctctctgatccacctgacattcactccatttccccgtatttccttctttcatgttcctcaccctgatcacacttggtttattgatggcagttccaccaggcctaaccgccactcaccagcaaaggcaggctatgctatagtatcttccatatctatcactgaggctaccactctgccctcctccactacctctcagcaagccaaattcattgccttaactcgaacactcactcttgcaaaggaattatgcatcaatatttatacagactgtaaatatgccttccatatcctgcaccaccatgctgttatatgggctgaaagaggtttcctcactatgcaagggtcctccatcattaatgcctctttaataaaaactcttctcaaggccgctttacttcccaagaaagctggagtcatacactgcaagggccactaaaagacatcagatcccattgctcagggcaacgcttatgctgataaggtagctaaagaagcacctagtgttccaacttctgtccctcatggccagtttttctccttctaattggtcactcctatttactctcctactgaagtttccacctatcaatctcttcccgcacaaggcaaattgttcttggaccaaggaaaatatctccttccagcctcacatgcccattctattctgttgtcatttcataacctcttccacggtaggttacaagccgttagtctgcctcttcaaacctctcatttcctttccatcgtgaatatctatccccagtcctccactcttgactccctcttggagtggatagatgatctttgctgacaggacacattccaacactttcaccctgatgaagtcctattctttacttttatactcactcttattcttgttcccattcttattgccaccctctacctctccccagctatctccaccacactatcaatttcactcactctctcctagctatttctaatccttctttaacaaacaattgctggctttgcatttctctttcctccaaaatcaccaaggcctcaatttactcactgctgaaaagggaggactctgtatatttttaaatgaagagtgttgtttttaccttaatcaatctggcctggtatatgacaacataaaaaaactcaaggatagagccccaaaactcgtcaactaagaatataattatgctgaacccccttgggcactctctaattggatgtcctgggttctcccaattcttagtcctttaatacttgtttttctccttctcttattcagaagttgtgtctgtcatttagtttctcaattcatacaaaaccacattcaggccatcaccaataattctatatgacaaatgctccttctaacaactccacaatatcaccccttaccccaaaatatttcttcagtttaatctctcccactctaggttctcacaccaccccaatcccacttggagcagccctgagaaacattgcccattatctctccataccaccccaaaaatttttgccacaccaacacttcaccactattttgttttgtttttcttattaatacatgaagacaggaatgtcaggcctctgaacccaagctaagccatcatatcccctgtgacctgcatttatacatccagatggcctgaagcaaatgaagatccacaaaagaagtaaaaatagccttaactgatgacattccaccattgtcatctgccctaccctaactgagaagatatattctcccccgcccttaagaaggtactttgtatgcctatcccaaacctataagaactaatgataatcccagcgccctttgatgactcttttttctgactcagcccacctgtacccaggtgaaataaacagccttgttgctcacacaaagcctgtttggtggtctcttcgcaaggacgcatgagacagcatttactatgctattgagattgcctgttgaacctttctgcctcctccaacagagaataagtttattgaaggcagagaatatttatccttcacgcagaacttgaaaaaacagttataattttttattttttgagacagagtcttgctctgttgcccaggctggagtgcaatggcaccacctcagctcactgcaacctctgcctcccggattcaagcaattttcctgcctcagcctcccaaatatcttggattacaggcacctgccttcatgcccggctgatttttgtatttttgtagagacaagatttcaccgtgttggccaggctggtcttgaagtcctgacctcaggtgattcacctgcctcagcctcctaaagtgttgggattacaggcgtgagccaacacgctcagccagtatttttgaatgaatgagaaaatacattttgggacatgcttgggacatgttgaattgaggtatttatgggacacagaaggcagaagcatctggtaagagcagtggtgtgctggtaaatgtttatcaactggctctcagtggaaaaagttccgatttgcagcatttgttgaattccacaacatcaacactcccaccgttggtattcaagctgccaatgtggcattgctaaatatagagttgagaagagatgtgcactgttggctctcacaagttggtgtgagcaggctccagcacaccactgcctgtgggtaggtggatttaagggtatgaggttcaggagtgcaatgtgggctggagagatggatttggtggtcatcttcgaagtgatggtcattggagctaggggaacagcaagataacccaaggagttggttcagggtcaaaaggagagaacaggaatcgaatttgatgcaaggccaacattttaggtagcatgtggaagaggagcatctttgaaggagaaagacgtgaatgaaaaaatcattcaggagaacaattcaggagaaaacctgaatgattttctcattcagacaggaagacctgaatgagaaaatcaggagagccaggtcagaacagtgtcaaggaagtcagagaataggaattttcaagaagattcttcccatcgtaaaaattatgcagagagatgcagtaatgcaaggtctggaaaatatctattaagtttcaaagttagcaggttattattacttaaccagaatagtaaggagagtggccagagtatagagaggaaagtgagaagagagtgtatatggtcagggatggtggcattttgggtgttgtattagttacctattgctgcatatcaaattactttaaaacttagtagcttaagccgggcccagtggctcacacctgtaa

SEQ ID NO: 366 - DNA, 11304 bp, Homo sapiens
gccctgagcctctctgagcacactttcttgcctttctgccttctgccatgggatgatgcagcagaaagggccctgctggatgtgagacccttgaccctgaacttcccagcctccagaacagtgttacaaacggacttccgtcaaagggatacgtgggtatgaattggaagaatctgagtggaaatgcaacactgatattttggatctccagaatttgcctataagaagagtcatttattcaggaggtcctgaatttgcttataagaagagtcattctctgcagagaatgcaaaagatgagtcaagggatgattctgcaatataattggaggatgtaaagcaattgcaaaaataattctgtctcatggaatactgaatgtctctaggaaataccaaccaatattggagttctgaaaaagtgataatgagcagtatactgtagggaactaggaaagactacttgacaaagatagtatttgagatcatagataagtgctttgggccaaaagaattgttactttctcagtttagttgaaagcaaataatgatactgtgctcatttttatagacaacaatagcacacatgtatgtggatgaaaatgagcgatacagactaattatgagtgaaagaaatccttgcagaactaacaatccagtgttgtccaaaacaaaccaatggacaaagtatttgaaaatgctagtaccatcctaacatcccaattgttttgagcaaattcttattgatagagatctctgggcctgcttatcaaccagtgagtaactccaatagtcaataaacaaatgctgcctccctcattagggatggatatagatggaaatagaatttcagaagagttgacagacaagccaaatattgtcaactttcaaatttgtcatgttgcccctagttcgagcctcactgtccaaatcccagagaaagagatggtgggatgtgaggaatggagataatctgtgtctctttgggatgttttggggtctacttaaggccagcatgacaaacatgtatagtgacaaccctaatcaattgttcatggctgtctgaaagggttggtgaggctacagtgagcaataaaaaattgccatcagtaattggccataattaccttgaacaagtggcaacttgtgataggcaacagtttctatacagtggtaaaacatgtcttatactgttccagagggtatatgatttaatcaacagtacaattgaagctgtattgtattggggcacttaatattagaattttgctaaaatatttgatttctatttagacacacagatctctaaaagatagttttctgtcttgattacatgttcttcacttcattctgaatcagattggaaataataagttgtgctttatatgcttggtagctcattcattcattcacaaattcagccagtcagccactgtcctagttatctattgctgggtaacacatgacttcaaaatttggtggattgaaacaacaacaattatgtcattatctcttccagtttctgtgggtcaggaatcttggaaggactcagctaggtggctcagctcaggttccctttgtggtttcaagtcatatggtggctgggagagtgtggggctgaagcagctgggggctggatgggcagcttactgtcttcatgtagttcctgggcctctgcacatgggttaatctggactccaaaggtaagatgtaccaccttttatgacctagcttttgaagttacgcaatacacgttgagcatccctaatttgaaaatctgaaatccaacatgctcccaagtctgaattttttgactgctgacatgaagccacaagtggagaatttcacacttgaccccatgtgacaggctgcaagtcacagtgcaggagcataacaagcagtttattctgtgcttccaagggaacaaagacccttggagccctcctcagctgtgatgtacatttgttgcacatgttcagattctcccatgcaagcaaccagactgtccacataggtggttgctagtgacatatttaccttctgatggctcagtgtatacaatcttagtttcatgcaaaaaaatatttaaaatatgatatgaaataccttcaggctatgtatataaactgtatataaaccataaatgaattttatgtttaggcttgtgtcccatctccaagatatctcattatgtatatgaaaatattccacactccaaaaaaaacactaaaaatccaaaacacttctgtcccaagaatttcagaatagggatacttagcctgtatcacttctactacacactactgattataagctagttataagactacccacccaggttggagaagaagggaagtagtctgcacctctttatggggatgtgactagggttttagaaaacatatgggataggagatgatgttgctatcttggaaaaatatgatcagctgattagccagagtcacaaacatttgttgggagccttttatgtgctaggctgcacatactctgggaatacagtgaagaggagggacaatgtccttgctcctgagtggcatatattctactgaggatgagtgaggagataaacaagaggtaaatacacaggaaagacaagattgaattgtggtaagtgctatgaagaatgttaaacaaaacagaataactggggtttggagagcttctttagataaggtggtcaggacaggtctctctctctctcttttttttttttgcttcagtgtctattttatttatttatttatttatttatttatttatttatttatttattatactttaagttctggggtacatgtgcagaacatgcaggtttgttatataggtatacatgtgctatgttggtttgctgcacccatcaactcgtcatttacattaggtatttctcctaatgctatccctcttcaaggcccccaccccatgatggccctggtatgtgatgttaccttccctgtgtccatgtgttctcattgttcaactcccacttatgagaacacgtggtgtttgattttgttcatgtgttactttgctgagaatgatggtttccagtttcatccatgtccctgcaaaggacatgaactcatccgtttttatggctgcatagtagtccatggtgtatatgtgcaacattttctttatctagtctatcattgataggcatttggcttggttccaagtctttgctcttgtgaacagtgctgcaataaacatacatgtgcatgcgtctttatagaatgatttataattctttgggtatatacctagtaatgggattgctgggtcaaatggtatttctagttctagatccctgaggagttgccacactgtcttccacaatgattgaactaatttacacttctaccaacagtgtaaaattgttcctatttctccacatcctctccagcatctgttgtttcctgactttttgatgatcgccattctaactggtgtgagatggtatctcattgtggttttgatttgcatttctctaatggataggtcacttttaattaaagaacttaatgagaagaaaacagtcagggaaacaagagttccaggtggatggaagagcaaaaatacagcatgtgagctccagtgcccagaagcctgtctaacaaacacctggcattcacttgagctctgctgaatagagaatgactgaatgaacaccagaccttaagttgccacctgctcatatcccactgcaagctctacatgaactcaaactgtggcaaagacgcaaagccaggagaaattgtctcgacaaccaaaacaatctgtaaacttggatcaagaggacccatcaatgacaagaatacacacgaaaatcttttggccactcttgaaacagatcattctaatcaacaggcaataacagtggggacacctgggccacaataaaccctttcacaactgtgccctttaccttgggccctcatagcccctctgctgggatttgcaagtcctcttcaacaaggagttcccaaaccaagggccaagacacatctggagactgtctcttgggtttgacagttgtacttttaagcattcctgcccttctggtttcttgatcctttggctcatttatgagaagcactgtgtaatcatctgaccctgagccaagaacagaggcctacagaggccctggctaatgtgggaactaagctttcagctttgtgggctgagtctgctgagctaagcagcttcctaggactgtcagaggattggtgctacttaagtgcagttgttctattacactcttttctatgagttggatgagcctttgcggattaaacagttgtttgcacttccccagttccacgctgacttttataacatatcaccaaaaggtgtttcacattgaatggagtgttataaggttccatatggtgaggtatggtttcctcctgcctggagttctgaatcattctgcaatttgtgtgaatctgctttgctatcaggttcttgaagatggggcaaggtactgtcccaacatcagaggaaggatgtccatatccttctggttcctgtgctattcttgatccttactggcctccaagtagaaggcccttgctccaagggtccctcaccatcccattctggcatatggtgaggtatgcctggccctgccagatctttgggatgtggtgctggctgtcactgctgaagtccatggcccctctgccaccttcctctgataccactaaactcagcaaagaagactggagatgtatgttacacatgtgactattgtaatgaattcagatatgcttttcttctgatacagaaaatattttataattaaaagaagatggttccttatatatgtgccttttcaatggccatcaacaattcatagctacagattctgctatgtctgcatagcaacagactcagtctgcttataccttatgaattataaatttactcatggacgagtgtgtgttgttctctcaaaggtttgattatttagattcattaagtgttgtactcgaaagaaataagactggtaactgtattttaataaagtatttaaatacctaaacatgttaatattttaacagatataagagtgtattgtgctgtaggtacaggtatttattattgttgttattgtttttaaatagagtaggacttcgaaaggaaaccacaaggaactttaagtcctgcttttaatcaccgtcaccttattttacaaagaaaaatatatttcattcatgtaagttgctattcatatttagttatatatttctacattatgaagaaagtattcaccctgaggcggggaaaacagaatccccagttagctcctattgaatgcctccatcctggaatactgtacaaccgacacatgcattggaattattcatgctgcttgtataccttgggagatgaacaccttgaagacaaactcagaatttcaacaaacccctcagggtctattcatggaagcctggttgggtctcttcttttggagaactaataaattagtccacacaactgaacttgctgaaggtaaatttggagttggccaacttttgctgtataacaagcagtgtttgtgtacagtgtctgttaggcattttactatccactggctaatatgttcagggcaggaacatccctttctaccccatggctctcccttttctctacatgcaaggaagtatgtaactgggcacagtgctgctttgatctggttttcattatgtgataattgtggactttctaaattgtaaatgtctgtgactttttccccagcagtcagacaatctatgctctgggaaaattaaagggaaaaatctcaggtaacaagaggagcaacatgaagcaatactttgctataatcatcctcttactagctgaggtccaaaatgctgtattgagtgaaataacatgattagagttaaataaataatgacagctaagagagaaatcagctagaaagaagttatttcagcctattaagaaaggagatgagatgttgctcaaaggaaaaaggcccgtatatgaagagtgtcaaaataaaggaatgaaaaaagaaataaatgaagtctgaagagcatgctagaaaaggcagatggataattttaagcaaaatgtgttgcacagtgggattggagctgaatgggaggaggtttgattgtgtaagcagttccaggtttcttgctttataacagggatctgcaacctttttctctaaagggctagatagtaaatattttaggttttgtaggtcagaatatctctcactctactactcaatgctgtcattgtaacatgaaggcaggcatagacaccacctaacaaatgggtgtctctatgttccaataaaactttataaaatctgatggtaagctggatatagcccacaggctgtagttctgtagttctgactcctggtttagatgatcaaagtggtggcagttcctttctccattgaatgggactcatattagtttggtgcaaaagtcattaattttgcaattaccttaattaaaggtgccattacctttaagggaaaagaccacaatgacttttgcaccaaagtttggtgtttgtgaggattaaataacaagtgtgaaaagtcctaacacagtgcttagcacaaggtccacactcaaatgttatctcacccaccgtctttcaagtcagtgatcatactccacagggaagcattcatggcttcagttaatcgtgcatataaattgaagacagaaaaacaggtagaaaagaaagacatgataaatgaaaggtcattattgattttggtttggtttttcaatacatacaactcaggacaaatcattaaaatgcatcttcttgcaaactgaagaaacagagcaaagtacaactacaaaaacaaattatctcaggttgatataattttcattttcatgacaataggctcattttcctcatctttcattgagcttgttaaactttaagaaaatccctacttttaagaaatgattttttttaacagtagaggcagaaatatactgatataggtgaattgtacttaaccaaaattgtaaaatcgtctatttaacattgttaatttcagttaaatggcatctcaattttgactggaagtagaatcactctggttttggtttttcatagactctgagtagcaccactgcaggttctttgaagcatttctaaatgaggtaattttattttacaaggggtttcttgtaaaaactattgtctttctgtacatctaattaaaataaagatgtaataaagaatttactgttttaattagggcatagatcttaaagcaattatcctgtcattaataattccttaacagactttcttgcacaagatgaataaaaagatttttaagctgtgaaaaatcaatacacattactcatttacattaacaaagctacacaaagtaatctgagccttcattaaattatttctcctgtaaaccagagaagtttggagagttattagctatttataacctagtggaacttcacttacaagagagaaatcttacccatgactgggcagttgtatcaatgtcatttaaatgaacagccaaataggattaatatattagtgagtggaaatagattgatatggtccataaggatgactaaatgatgaaagctatcatcatggtgttataatatgaatgattcagcactccatctgaaaattacatgtcttaacagttttttttcagtgttgtaattaaagtccctcccctccatacccccaccatctgccatatacacatttggctgtcttttaggcaatgtagcatctaggagacactaagatcactgagcttaaaatacaatcatgaaggtatctcaagtagtattgccagactttggtattttctataatttcatctaatattataggataatctgggaagggcaaaaccaaaccaaacaaaaactcaaaatgatttttttttgttagaaaaggaaaggctatgttgttatgagaagccattaagaagaagaaaaaatattttgcaatctaaattttagttacattgtccctaattgataatttggaggcagatggaaacccttacatgtgaaagcaaaaggtccaagaccacatattgtccagtttccctgcggaagaattgtctaagaaattaaatgaatcaatccgtaactgcaacagggactttgggtccttgttcctgtctgtgttgtttcctgagcccatcaaggtgacggttaatgggaagaggtattaacacaagttcttgttgggtcatttggtaaagccctcaattagcatggccagattttaatgaatattaagtaatgatgatgaaattaaaagcatccggaaagacagcagtaatcaaaccggtctgtgaacgtatggctgaaaaagctgttctggggtccttgtgagaaatttgctccaggacccttataagaatttagagaggattgctcaccaatttttcattatatatatatgcctgtttcaatatatataaaacaggcttaatggacctcacagttccacatggctgggaggcctcacaatcatggcagaaggtaaaaggcacttcttacatggcagcaggcaacacagaatgagagccaagtgaaagaggaaacccttataaaatcatcagatctcatgaggcttattcactaccacaagaacattataggagaaaccatccccatgattcaattatctcccactgtgttcctcccacaatatgtgggaattatgggagctacagttctaagacgagatttgggtggggacatagccaaaccatatctaccctggcccctcccaaatctcatgtcctcacatttcaaaaccattcatgttgtcccaacagtaccccaaagtcttaactcatttcagcattaactcaaaggtccacagtacaaaatctcatctgagacaaggcaagtcccttccacctatgagcctgtaaaatcaaaagcaagttagttacttcttagatacaatgggggtacaggcattgggtaaatacagccattccaaataagagaaattggccaaaacaaaggggctacaggcccgatgcaaatctgaaatccagtggggcagtcaaatcttaaagctccaatttgatctcctttgactccaggtctcacatccaggtcacgctcatgcaagaggtggacccacagctttgggtatctctgccctgtagctttgcacggtatagccctgctcctggctgctttcatgggctggcgttgagtgtctgtggcttttccaggtgcaaggtgcaagctctcagtggatctaccattctgggttctagaggatggtgggtggccgtcttctcatagctccactaggcagtacctcagtgtggggactctgtgtggggtttcacaccccaaaattcccttctgcactgccctagcagaggctgttcatgagggtcctgcccctgcagcacacctctgtctggacatccaggcatttccatacatcctctgaaatctaggtggaagttcccaaaccccaattcttgacttatttgcacccacaggcccaacaccacatgtaagcctccaaggctcggggctcgaaccctctgaagcaatggcctgaggtctacgttggtctgttgtagccacagctgggatgcagagcaccaagtcccaagactgcacaaagtagcaaggccctgggcctggccaggaagccattttttcctcctaggcctctgggtctgtgatgggaggggctgccatgaagacctctgacatgccctggagacattttccccactgtcttggtgattaacacttggctcctcattacttatgcaaatttctccagccagcttgaatttctcctcagaaaatgggttttccttttctatctcatggttaggttgcaaattttctgcacttttatgctctgcttgctctttaaacctaagttccaattccaaaccatacctttgtgaatgaataaaactgaatgcttttaatagtagccaagtcacatcttgaatgcattgctgattaggaatttctttcaccagatgtcctaaatcatctctctcaagttcaaagttccacagatctctagggcaggggcaaaatgccaccactccttttgctaaaacataacaagagtcacctttgctccagttcccaacaagtttctcatctccatctgagaccacctcaacctggactttattgtccatatcactataagcattttggtgaaaggcattcaacaaatctctaggaagttccaaagtttcctacattttcctgtcttcttctgagccctccaaactgttccaacctctgcctgttatccagttccaaagtcgcgtccacattttcagttatctttacaggagcaccacactcccagtaccaacttactgtattagtctgttttaacactgctgataaagacatacctcagactgggtaatttataaagaaaaagaggtttaatggactcaaagttccacatggctttggaggcctcacaatcatggaggaaggtgaaaggcatgtcttacatggtggcaggcaagagagaatgagagccaagtgaaaagggaaaccccttataaaaatcatcagctcttgtgagacttattcactaccatgagaaaattatgggagaaaccgccccccatgattcaattgtctccaactgggttcctcccacaacatgtgggagttatgggagctaccactcaagatgagatttgggtggggacacagccaaaccataccactccacccctgcccactcccaaatctcatgttttcacatttcaaaaccattacaatcaattattgtgatgcaatcttgaatctatagccaaatttcccacttctcaagatttattggaaaaaattatccctagtgtccctcagaactgtttggttttctttttttaacatttagacctttttcatccatctccaatgaacagcattggagttgtttatctagtagagtatgtatataatttatgacaaagttaatttcaatgatcctcaagtaagcgttttttcagtaccccccatgactattatagtcaactttcttgttctcagaaacacatgaattaatatttcacagatgaagcacaaataatcaataaacttatgaaactgcttagtaacaatatttattaaattagtcaacattaaaaaaaacctcagctgacatgggtatggtgacagataatctctttacccagtgatgtgactgtgaattactttctggaaagcaatttgcctatatgttacaagagcct

SEQ ID NO: 367 - DNA, 2944 bp, Homo sapiens
ggtgcacgcctgtaatctcagctactcgggaggctgaggcatgagaatcagttgaacccaggaggtggaggttgcagtgagctgagatcgcaccactgcactccagcctgggcaacagagtgagaccctgtctcaaaaaagggagggaggaagggagggagggagggagggaaacaaggctggaattcaatgatagaggaagaaaacgatgcaaaatgaagttgtaaagcaactagttgacagatcagtaggtcctgataggtcaaggcaaggaattagatgatgatgatgatgatggtgatgatgatgatgatgatgatgatgattatcattattattttgtagatggagtctcgctgtgtctcccaggctggagtgcagtggcgcaatctcagctcactgcaactcaagtgatctcctgacctcaagtgatcctcctgcctctgcctcccaaagtgctaggattacaggcgtgaggcactgcgcctggccttaggtattattttaagcgcaatgaggggctaggggagcactttaagagaagggtggcatgatttgtcttacattttaaataaatcagtcaggctgttgtgtggagaataggttttagggtggcaagaaaggaagcagaaaattaggaagctattataggactgcaggcaagaaatgacaagtgacttcatctggggtagtaggcgatggacagatctgggatgtgtcttagatatagcatcggcaagacttacactttaacctgagcgcagtggctcacacctgtaatctcagcactttgagaggcagaggcaggaggatggcttgagtccaggagtctagagacctgcctgagcaacacagtgagactctgcatttcttaaaaataaaaaaaaaaaaattagctgaacgtggtggcatgcacctgtggtcccagttactcaggaggctgaggcaggaggctcacttgagcccaagtcaaggctgaagtgagccatgatcacaccactgcactctagcctggacaacagtgaaaccctcaaaataaataaacaaacaaataacttctgtctttcaagtttgttgggaggataaacaagctataggataagtgaaaaacacttagccccagcacctgacacatatcataggcaaaagggtaacagccggcttctcttccctttcacagtcctatggggattttaaaaaaatagcatctcttggtatactgtcagtgtttgtggtgatggactaccacctgtgtagacctctcagcatgtattaataaatacattcctcaaaaacggacatttgggagccgggcatggtggctcacgcctgtaatcccagcactttaggaggccgaggtgagcagatcacctgaggtcaggagttcaagaccagcctggccaacatggtgaaaccttgtctctactaaaatacaaaaaattagtctggtgtggtggcgggcgcctgtaactccagctacgcaggaggctgagacaggagaatcacttgaacctgggaggcacagtttgcagtgagctgagattgtgccaccacacttcagcctggctgacagagtgaatgagactccgtatctcacacacacacacacacacacacacacacacacacacacacacacatgcatttgataagcacttgccaattaaccttatacatccagaaataacatcaccaaattaactaccattattctaaacataaacaattttgggtcttttaactgatacttcaaaatccctacttacttttctcatattccttccaataatttgttaggaggtggacctgtcaataggaaggacaaaaaattattatcaccaatactctcaaagtaatcgtcactttgggtagaaaccccagtacactcggggaattttcagaattcaatcaagcccatccaactgtctccaagttttgacactgcctaaaggactcctcacagttggtttagcccaacccagtaagaaacatttaacaaataattaaaagtgctgtgccagggtggttgtgttgccgagatacggttgttggtagctggggagtggcaggcagatccagccaagaattgtgccctaagccaggagctctgatgatgaaatcacaggatgtttgagtttggggcttgatggtcatcccaggtggtttcctatcgtggaaaacatttgatgtataagagtaaggctcagccaggcgcggtggctcatgcctgtaatcccagcactttgagaggccgtggaaggcggatcacctgaggttgggagttcaaggccagcctgaccaacacggagaaaccccgtctctactataataatggcagttgccctgccagcccggtcacctgtcactccctcctccgacttctcccgcaccgcggccgcaatccagcccggacactctgagggctctctctgagctgggcacggtcctcgctgctcggccgagtgcagccccctcacctcagtgcgactgagacaaagcaagggtcccaccggcccctgtcccctccctaaggcgcgccctcagggcgggagacccacctcagccagccccccagctcagtggtccagaggctcgggtcccgcgctgacgcccagcgcctccctcctccacagccgtcactgaccgctcgctcgcctctagcctggaccccgctgtccagcagtcccggctggcccgcgccgcgctcctcccgctctggcagtcctggcactggtaggacgcccgcagccttccaccctagagggcgccgggcgggcacgcgctgggggcgacgggggtggggcgggggaggcggggcgacgcagcgcggggcggccggcggttggtgctcgcagcccgcgcgcccgccttcccggccacgtgacctttgggccccgcccagatcgggagttccgcgcggactcttggtgcgaccccgtcccac

SEQ ID NO: 368 - DNA, 1732 bp, Homo sapiens
cgctggcgacgggacagggtttttgctgcccggggcctagtctacctcggcacgcttttctctgaaggagacacgcacttgcacgacgtgggcctctgtgcagctctactttgtccttaactcctctgactcaacgttatcgcagtttgactctggagccactcaggtttttcctaagctcaactctagccagctaggttcctggtgctttgggggtaagttgtgtgcagggagggtgttttacaggaggctgtgtggtgtagtggaaaaagctgaattaagtacattaatcctgaaaacggtttgacaagggcagatgacgtccaagttctccaacagctgtttttactcctccattcagaataggagctgtgctaatggtttggagaccgtcaattggcctagcacttggccatcctgcccccaaattcttgtcccagttccgtgccagctgcatgatgccttttgatagtatccttctttcctgtacctcaagcatagtagggtttcagaccacaagttttctgaagcttttcggaattcatgcagcttgatgcgttattagtaggggctgctcgtgggaaaacgcttgtaattacacttcctcaagaagttaatgaaaatgtgtgagaagagagatttccaacaggtgatgaatatgccagccagttattcccttcttccttcaaatatccagcctagactgatttctggataggtattgtagaaataaaaatttcagacaaaacaaacttagattttgaatcggacaacagtcagaaccaaaagaggctcagacacccctgctctagctgcccaggcatcaaactttataggctgaacacgaaagtaaagaaatttgattggctacagctaagcgtttgccttatttgggtatggtcacatgggaggtccctaattatataaccacttggctggttgtctgtttgtgattggttgaaactccattcaaaatcaggtacaaggggccgggcgcggtggctcacacctgtaatcccagcactttgggaggctgaggcaggcggatcccctgaggttaggagttcgagaccagcctagccaacatggcgaagcaccgtctccactaaaaatacaaaaattagccggacgtggtggtaagtgcctgtaatcccagctactcgggaggctgaggcacgagaatgacttgaacccgggaagtggagattgcagtgagcagagatctcgccactgcactccagcctggatgagagaacgagactccatctcaaaaaaacaaaacaaacaaaaggtgcaaggaatacctctaaattttgggttgctttctgggtacaaaaacaactccaaactaatggcctgctacttattttgcattaacagtatcaagtatcaagactccagcaaaagtggcagacagcatgggaatgctaaagagcatacaatatcaatacaggatagtactccagaaaatacgttaccctgcatgtggcgttccctcaatagatgtctcccctccccccaattttttttagctctgtgctttagtggatacaaaaattacttgctttcccaaagcctccttttgaagatagagctagcattaggttgattgctaaattttcagggattttatgagccaggtcataagcacaaccattattagaaatcaaattatataagctacaattaaattatcttaaaaataaaagtaataggccaggcatgttgagtc

SEQ ID NO: 369 - DNA, 4606 bp, Homo sapiens
aactttatatctggaagttctaacacagatagcttaacaagaaatacctcttattttaatgtcagatgtcatgatttttttaaggcttctctgataaaatatcttcttccagtattctaaattcccagcctttttcattctcctctttcttccatcagaggccaccacttccacagaagggactggtacttctggaactggattcaaaactggtgagaagaaacagcccatgatttggcatcataagtattaggtctctcaagcttttctagagagagtttgtgtttgtgttatttagggacattgcaagtgattcaaaatagatttgctagtggaggtacgttttgttttgaaaatccactaattctaaagtggatcattactgcttcatttctgaggatacgatgcacttctccatttatgttccaactctcgctagcagtttaggtggaattcagaaagtttcagtgcatgtgtgtgaaacagaagagctctgtggaaccaggacacatacatttaacgtgtacatttgaacaaaaatgctggctcagtattttctcctacatgtgaagttcaatacattcaaactctttttcctcctctttctatctcacagcaggcatcactgcagcaccagggaagcaagcagctgagcattgggaaaatgcatctagtttctctcttatcaaattttcagttgtgcttgtacttggaaacattgtatctccttttgttatgaattgctgaaagcagacaaatacatcaaattttccacttgcctcgtgctcagagaaagaggattctgttatggcaaataaatacagaaatatagcatataccttttagattcgggtcctcatttgacttactcgttcactgtgatcacctcagtttctttgtgtttcaggcacctcagaggtagctcctgccacaacggttgccccaggaagtttcagcacagcagccacaacttctcctggagcaagtggaatgactggggttacaacaactacaaagaccacaacttccctaggaggaagtggcaccactggagcaaaaataaaattaggtaaagactttggagtatttgtatttattgttgttctttgatcgatttcttagagaaaaatttttaatgagctttttatttgaaaataaatttaaattacagaaaattatcatagataatgcagagaatctttttaatgtggaatgtgggtttaaatttcctttgaggctgtaatatttcaagaaaacagagtttgttcttggatttggacttgtaaactcttgagaccaaaatttctaaagtctttcccttctgagagactaacctcagggttctaggtctctggagaggagacttgcaataatagctctggttttgaaaaggttttccctttgaaaagggcatagtctgtatgccattagtgtactgatttctacaatgtagaaatcaccaagatgtcatattttagtttagagataaaaattcaaaattgtctttcttccttcttgttctttcttgttttctcctcttctttcttctccctttctcttttgattttcagtaggaaccaccactacagcaccagaaagtaggacaggtaaacttggggaaagcctttcatatgaccttcaactttgaacaaatcttggtaataatattcggggcaggaatattagccactgcgttacccttggctttgcaaaagcacacaataaaccggaagcctgttagtcctcatgtcagttataatttcaggaagtgtgctttcttgcttcaaagtcacaaatagacatactgttggccacatttttccaagggtcatgaaagagttcccatatccatctttctcttttcttttctaccttggcacagctggagtgccctctggtacaagagtcacccctgggagctccaactcaggtaaagcaccaggctgggaggaaccactgcttggaaagtgctcctcagtgaggtgtctgcctgggtgaccctaccgtactcttctcagattcttctaatctttgccctcactgccattctttttccctgttttgcagaggccacaacttctgtagaagaaagcagaataacaagagccgaagtaatcacagaggccacaactttctcaggaggcagcggggccacctgagcaggattacccagaggtaccactggagaattttctggaacgaactttatatctggaagttctaacacaggtagcttaacaagaagtaaatttttatttaatgtcagctgtcatatttcttttatggcttctatggtaaagtaatatcccaatatcttcttccagtattctaaattcccagcctttttcattctcctctttcttccatcagaggccaccacttccacagaagggacaggtacttctggaactggattcaaaattggtgagaagaagcaacccatgatgtggcatcataattattaggtctctcaagcttttcttgagagagtttgtgtttattttatttagggacaatgcaagtgattcaaaatagatttgctggtggagatacttttttttaaatctactaattttaaaatggagcattactgttccatttccgaggatgggatggaatttctccatttgtgttacaactattgctagcagtttaggtggaattcagaaagttttcagtgtgtgtatgtgaaacagaaaagagccccatggacccaggacacatgcatttataagtgtatatgtgaacaaaaatgccggctcagtattttctttcttatgtctcaagttttaatacatttaaacccttttttccctcttctttctacctcacagcaggcatcacttctgccccagggaaacaagcaggcacctctggggtatctcttgccacaacagttgcccctggaagcttcagcacagccacaacttcttctggagcaagtggaataactagggctggccccaactcagagaccacaacttccctaggaggaagtggtaccactggagcagaaataaaatcagctgcagtgccctctggtacaacagttgcccctgggagctccaactcagaagccacaacttctgtaggagaaaatggaaaaacaagaggtgaaataatcacagatactactgagggcacctctggcaaagttctggaacctggaagtgcccacacaggtcaggaattctgaacatggccccttaagcaatatcagctttgggaaacccagaatgtcctgtccagtctttatacctccaattcctccctctctcagaggccacaactttcccaggaggcagtgggactacccgagcaggaccaccaggaggtgagcttgtcaggctgaggcctggggctctcatcatctctctatctgggtggctgcagtgaacagtaatgaacagtaatgcagtgaaagtcttttgagggagggtcctgcattttctctgtggccacagtgtgtcatatcaacctggtcagttattctgcttgtgaattcatgacctcagatgtctcagccaggctgccttcagtgtcctggcttatggaaacgatttttttctgatatgaagtatgagcgtatattgcatatattccaactttccaggacttccaactctccttacccagttttcctttccacccacagtttgagacattttctatcatttttctcctttacttacacatgatatttctcccctcctacaaaacttagtgaaaacaactgattattaaaatcctccaagttgtatcaaagagtcctacttataaatatagaagtgtgctttgtttctcccgtaggcacctctgtcacaccagggggctatgctcctggaagggaaataggtcagggtgatttaagccttattcgtcccttccctcatagagaaagggaaacccagtagcaacacacacggcccaggttggcctggaaaatcaagtacttggagactgttcattttccattctctacagggatacagtgtcctcaggaaagggcttccagtactttagggccacacatggatgcttccaagcttaactggggagataatgatctattgctccatttcccttttttggcattttaggtaccactggagaattgtctagaatgaccattatacctggaagttctaacacaggtagcttaacaggaagggaatgcatcttatttaatgtcagatgtcatgatatctcttttagggatgctattataaagtaataccccaatatcctctgtagtattccaattcccagatgtcactattctcctactttttttcctcagaggccacaacttccacaaaagggactggtacttctggaactggcttcaaaactggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcagaaataaaatcaggagccacctccggagtaccgggaagtaagacaggtaaacttggggaaagcctttcaaatgaccttcaacattggcaaaaaaaaaaaaaaaaaa

SEQ ID NO: 370 - DNA, 4587 bp, Homo sapiens
aactttatatctggaagttctaacacagatagcttaacaagaaatacctcttattttaatgtcagatgtcatgatttttttaaggcttctctgataaaatatcttcttccagtattctaaattcccagcctttttcattctcctctttcttccatcagaggccaccacttccacagaagggactggtacttctggaactggattcaaaactggtgagaagaaacagcccatgatttggcatcataagtattaggtctctcaagcttttctagagagagtttgtgtttgtgttatttagggacattgcaagtgattcaaaatagatttgctagtggaggtacgttttgttttgaaaatccactaattctaaagtggatcattactgcttcatttctgaggatacgatgcacttctccatttatgttccaactctcgctagcagtttaggtggaattcagaaagtttcagtgcatgtgtgtgaaacagaagagctctgtggaaccaggacacatacatttaacgtgtacatttgaacaaaaatgctggctcagtattttctcctacatgtgaagttcaatacattcaaactctttttcctcctctttctatctcacagcaggcatcactgcagcaccagggaagcaagcagctgagcattgggaaaatgcatctagtttctctcttatcaaattttcagttgtgcttgtacttggaaacattgtatctccttttgttatgaattgctgaaagcagacaaatacatcaaattttccacttgcctcgtgctcagagaaagaggattctgttatggcaaataaatacagaaatatagcatataccttttagattcgggtcctcatttgacttactcgttcactgtgatcacctcagtttctttgtgtttcaggcacctcagaggtagctcctgccacaacggttgccccaggaagtttcagcacagcagccacaacttctcctggagcaagtggaatgactggggttacaacaactacaaagaccacaacttccctaggaggaagtggcaccactggagcaaaaataaaattaggtaaagactttggagtatttgtatttattgttgttctttgatcgatttcttagagaaaaatttttaatgagctttttatttgaaaataaatttaaattacagaaaattatcatagataatgcagagaatctttttaatgtggaatgtgggtttaaatttcctttgaggctgtaatatttcaagaaaacagagtttgttcttggatttggacttgtaaactcttgagaccaaaatttctaaagtctttcccttctgagagactaacctcagggttctaggtctctggagaggagacttgcaataatagctctggttttgaaaaggttttccctttgaaaagggcatagtctgtatgccattagtgtactgatttctacaatgtagaaatcaccaagatgtcatattttagtttagagataaaaattcaaaattgtctttcttccttcttgttctttcttgttttctcctcttctttcttctccctttctcttttgattttcagtaggaaccaccactacagcaccagaaagtaggacaggtaaacttggggaaagcctttcatatgaccttcaactttgaacaaatcttggtaataatattcggggcaggaatattagccactgcgttacccttggctttgcaaaagcacacaataaaccggaagcctgttagtcctcatgtcagttataatttcaggaagtgtgctttcttgcttcaaagtcacaaatagacatactgttggccacatttttccaagggtcatgaaagagttcccatatccatctttctcttttcttttctaccttggcacagctggagtgccctctggtacaagagtcacccctgggagctccaactcaggtaaagcaccaggctgggaggaaccactgcttggaaagtgctcctcagtgaggtgtctgcctgggtgaccctaccgtactcttctcagattcttctaatctttgccctcactgccattctttttccctgttttgcagaggccacaacttctgtagaagaaagcagaataacaagagccgaagtaatcacagaggccacaactttctcaggaggcagcggggccacctgagcaggattacccagaggtaccactggagaattttctggaacgaactttatatctggaagttctaacacaggtagcttaacaagaagtaaatttttatttaatgtcagctgtcatatttcttttatggcttctatggtaaagtaatatcccaatatcttcttccagtattctaaattcccagcctttttcattctcctctttcttccatcagaggccaccacttccacagaagggacaggtacttctggaactggattcaaaattggtgagaagaagcaacccatgatgtggcatcataattattaggtctctcaagcttttcttgagagagtttgtgtttattttatttagggacaatgcaagtgattcaaaatagatttgctggtggagatacttttttttaaatctactaattttaaaatggagcattactgttccatttccgaggatgggatggaatttctccatttgtgttacaactattgctagcagtttaggtggaattcagaaagttttcagtgtgtgtatgtgaaacagaaaagagccccatggacccaggacacatgcatttataagtgtatatgtgaacaaaaatgccggctcagtattttctttcttatgtctcaagttttaatacatttaaacccttttttccctcttctttctacctcacagcaggcatcacttctgccccagggaaacaagcaggcacctctggggtatctcttgccacaacagttgcccctggaagcttcagcacagccacaacttcttctggagcaagtggaataactagggctggccccaactcagagaccacaacttccctaggaggaagtggtaccactggagcagaaataaaatcagctgcagtgccctctggtacaacagttgcccctgggagctccaactcagaagccacaacttctgtaggagaaaatggaaaaacaagaggtgaaataatcacagatactactgagggcacctctggcaaagttctggaacctggaagtgcccacacaggtcaggaattctgaacatggccccttaagcaatatcagctttgggaaacccagaatgtcctgtccagtctttatacctccaattcctccctctctcagaggccacaactttcccaggaggcagtgggactacccgagcaggaccaccaggaggtgagcttgtcaggctgaggcctggggctctcatcatctctctatctgggtggctgcagtgaacagtaatgaacagtaatgcagtgaaagtcttttgagggagggtcctgcattttctctgtggccacagtgtgtcatatcaacctggtcagttattctgcttgtgaattcatgacctcagatgtctcagccaggctgccttcagtgtcctggcttatggaaacgatttttttctgatatgaagtatgagcgtatattgcatatattccaactttccaggacttccaactctccttacccagttttcctttccacccacagtttgagacattttctatcatttttctcctttacttacacatgatatttctcccctcctacaaaacttagtgaaaacaactgattattaaaatcctccaagttgtatcaaagagtcctacttataaatatagaagtgtgctttgtttctcccgtaggcacctctgtcacaccagggggctatgctcctggaagggaaataggtcagggtgatttaagccttattcgtcccttccctcatagagaaagggaaacccagtagcaacacacacggcccaggttggcctggaaaatcaagtacttggagactgttcattttccattctctacagggatacagtgtcctcaggaaagggcttccagtactttagggccacacatggatgcttccaagcttaactggggagataatgatctattgctccatttcccttttttggcattttaggtaccactggagaattgtctagaatgaccattatacctggaagttctaacacaggtagcttaacaggaagggaatgcatcttatttaatgtcagatgtcatgatatctcttttagggatgctattataaagtaataccccaatatcctctgtagtattccaattcccagatgtcactattctcctactttttttcctcagaggccacaacttccacaaaagggactggtacttctggaactggcttcaaaactggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcagaaataaaatcaggagccacctccggagtaccgggaagtaagacaggtaaacttggggaaagcctttcaaatgaccttcaacattgg

SEQ ID NO: 371 - DNA, 3428 bp, Homo sapiens
agtgtttaatggcaggttgagtggtgtaaactggcagaaaatgagctgtgatatttctactttaagatgagaatgagaaacaacttatcttgataaaagcgtagaaattggtttcttcaggaagccttccctgcttctctagtttgaggtaagtagtcctttcatgtgttcattatgtcttgtgcttcctcttcctatcagtttatgataatataggaaattattagcctgcttaattctatcagaccaggtgccctgtaaattcacttgttgcattctcgggtacctgcatgggatctggtaagttgtgtgtactgcaagttcttgataaatgaataatgtcattcattgtttctaaataagcaggaatagtaaagacttcaagctattggccacttgactcatttagtcatgcttataaacctaagaattccacaaaaacttatggtttgaatgatttatagtttatttcctgaggatacagacatcattgtgcaagactgggacaatttgattcattgaatcttttacaaaagtttatataaattattcctggatgaattagtcatattattagtcagccatacaaaacaattgttttgaattctttaaggactgtatccaaattcattaagttttcatggtagaagcacattaatcaccaataccatcattttctgcactttctttaacttacttttatttctcacgtctccatgtcatattgttgttgcatttgtaataaactttgcagtaaagacaaccaccatacatttgtatctaatggctaatcttatattaggtgaacttgaaaatccttaaggaaaagttttttcttagtgtttgttagaaataaatatttaatggttttaaaggagtcttcctataaagaactctttgaggaactgtatatgtgtgtatatacctttacttaagttttaagttaatgaggcagtgtttttcctgaagagctagggatatggtatagaaagagtgtggctttttcttttcctgggggaagaaggcttgtagtaatattgtcatgatgttgctggtattgagttattgctgaataaagaataggtgtaaagcaagcatggacctgaatgcttgtcttttattaatgaaacagtaaattctttcattttgttgatgctacctgggcatataacccagacataaataatcacaaagcctaattttgagggtctaaacagaattgcatatcccatttgctttggtgcatcgattacaaagccagatgttaagaacagatgtcaatgagctatttttcatatgccatggttcacatttatgaactctccatttatcacctcagatggaaacggttaatttgacagtgagtgttttggttgttagccaatttcaacatgagtctttggtttttgaaatctgatgtacagagatgtgataaaacaattacaatagaagcactgttaacttgattttgtgccttagaatttaccaacatatataaagtaatggaaatgaatgttcccttttatggtgaatcaacataaatctaatgttggctaagaaataatgtaaatgttatgactgaaatacagagtggttaatccaattgtaaattccatataactgtaagtcagatccttgtagtgatgtatggtgtgatggcgtagtgggttttgcttatttcttctatttgattgtaacaatgatactcatcaaaaatatttcaggcaatgtttgtgctaaatatgtttttagaattggcttcaaaattttgctgtactatgggaaaattttcatattggtgaatactgtatttccaattgtctattagctatgttgatataatacatatttaaaagcagccatctactatattctactaggaaacttaaataacggaaaaaaggaaaaataatatttttatttttaaatgtgtggacagttatctggaatattaaactctttagtatatactatatttttatattttttcagcaactttgtgagatatatcactatttttattttattgttcccaagtctggaaagggatagaagtgggacttaaaggttattttttctctctgttttctattctagttttctttctactacatttcattccctctctttgaattcagaactcaaaaaataatagttactttaatccaaagtttaaagaatggattaaattctaacctaggagatctgattatgttgcaaacaatataagctcttttcatatctttaaataaactgatgactttgataagtataacagaagttggcttaaatggtttatgcttaatcaacttctgtattaatggaagccctccattttctctgtaaacaggctgattataaaacatagcaccttgaaacctttgcatctctgctcctaccactttaattgtatgctgaaagtgagtcagtagggtaatttcaaaaccctacacaaattatatctgtgatattaatgaaatttaattgaatattgcatgtatcagtgaaagatgaaagtgaatgagaaaataattatatctatgaaaactgagtgacatagtttgaaagatacagataaaggttaattgaaataatattaactgaaaatgtacaagattgttggaagaggattatgaagtgctaaaaaccttctgcatttaaattgccttgcaattatttttataattcccagtttctctctaaagaaatccaaactgtcaataatagattgtacacattgctcatagacgatgtaagaaaaatgataaaaaatgcaaagagtagctccattcttcaagaaacagccttactcctacaatggaaaatgagcaagaatttctatattttaagttaaaattaaatgtttgtcatggttatatcactttttaaaataatttccagatttgacatccttttacgatgatcttaaccaatgactgatttcaaatgtgtcagatatgagggattctgttgtttttaaataactaatatctgttgcctaatccagtgtccaagtcacagtgaaggttgttcatagggccaatcaaaggctagagatccatcatgtgaaatctgccaactctggaatctgaattgctcatggtgggcaaggaagaggcaggaatataagtgtgatgggaagagacataatagcacctcacagcacatagaaatggtgagtttttcagggatctgaagtagtatcctggttcagagaagttctttctgtgcattgaagtttgagctgtttgttacaggagtggaagaagcaggtaatgcagggacattttagtatgagattccatcctcagaccttaaagggaagtggatggatgtggtgtgcagaaggatgaatggcctcaaagtaattatgccagtggggattccagtttcactcttacaaatgtgtgtgtgtgtgtgtgtgtgtg

SEQ ID NO: 372 - DNA, 2464 bp, Homo sapiens
atttatttcaaatcgtagtcataatatttggctgttgtaaatagacactgattttgtgtgtttgctttttttaaggactaatgttgctggacaggcaggtattagagacagggtggatctgctggacaggcaggtagtatagacagggtggatctgctggccagccaggtagtatagatagcgtggatctactggccaggcaggtagtgtagacagggtggatctgctgggcaggcaggtagtgtagacagggtggacctgctggacaagcaggcagtgtagacagagtggatctgccggccaggcaggtagtgtagatagcatggatctactggccaggcaggtagtgtagacagggtggatctgttgggtaggcaggtagtgtagacaggatggatctgctggacaggcaggtagtatagacagagtggatctgctggacaggccggtagtatagacagggcggatgtgctggccaggcaggtagtatagaaagggcgggtctgctggacaggcaggtagtgtagacagggtggatctgctgggcaggcaggtagtgtagacaaggtggacctgcaggataggcaggtagtatagacagggtgcatctgctcgacagttaggtagtatagacagggtggatctgctggacaggcaggtagtgtagatagtgtggatctactggccaggtaggtagtgtagacagggtggacctgcttgacaggcaggtagtatagacagagtggatctgctggccatacaggtagagtagatagcgtgaatctactggccaggcaggtagtatggacagggtggatctgctgggcaggcaggtagtgtagacagggtggatctgctggccaggcaggtagtacagacagggcggatctgctgggcaggcaggtagtgtagatagggtggacctgctgggcaagcaggtagtgtagacagggtggatctgctcgccaggcaggtagtgtagatagcgtggatctgctggccaggcagttagtatagacagggtggatctgctgagcaggcaggtagtgtagacagggtagatctgctggataggcaggtagtatagacagggtggatctgctggacaggcaggtagtgtagatagggtggacatgctggacaggcagctagtgtagacagggtggatctgctggacaagcaggtagtgtagacatggcgcatcttctgggcaggcaggtagtgtagacagggtggatctgctggccagtcaggtagtatagacagggtggatctgctggccaggcaggtagtatagacagggtggatctgctggccagggaggtagtatagacagggtgggtctactggacagggaggtagtatagacagcgtggatctgctagccaggcaggtagtgtagatagcgtgcattactggcaaggaaggtagtgtagacagggtggatcttctggccaggcaggtagtgtagacagggtggatctactcggcagggaggtagtgtagacagggtggacctgctggatgggcaggtagtatagacagggtggatctgctagacaggcaggtagtatagacagggtggatctgctggataggcaggtagtgtagacagggtggatctgctggacagccaggtagtgtagacagagtggatttgctggacaggcaggtagtgtagacagggtggacctgctggacaagcaggtagagtagacagggtggatctgctcgctaggtaggtagtgaagacagggtggatctgctgggcaggtaggtagtgtagacagggtagatatgctggataggcaggtagtatagacagggtggatcttctggagaggcaggtagtgtagacagggtggacctgctggacaagcatgtagtgtagacagggtggatctggtaagtcaggtagtgtagatagcgtggatctgctggccaggcaggtagagtagagagggtcaatctgccggacaggaaggtagtaaagagagggtggatcagttggataggcaggtagtggagatagcatggatctactggccaggcaggtagtgtagacagcttggatctgctggcaggcacgtagtgtagacagggtggacctgctggacaagcagttagtgtagactgggtgaatctgctggccagggaggtagtgtagataccgtggatctactggccaggcaggtagtgtagacagtgtggatcttctgggcaagcaggtagtgtagacagcgtggacctgctggataggcaggtagtatagacagggtggattggctcgaaaggcaggtagtatagacagggtggctctgctggacaggaagggaatgtagatagcgtggatctactggccaggcaagtagtatagacagggtggatctgctcgacagagggaggtgtcacaccccaggtggggctgagtgggacggcatgagacttcatcaagctactcaga

SEQ ID NO: 373 - DNA, 4900 bp, Homo sapiens
cctcttttcctcctccagtgtcctctcctccactggacccacccatcagtctcaccaagccctctgccctcgccgtcttacctcattttccctctggccactaagggctgtcatcttcacaagcagaaagagcgatgcagagggagaggaaggccacaggtgagagctcctcctcgtggatcgtggctatcggcgccccagagacgccaggcacccccccgggcccagaggatttgctctgtccggaaaggggcgcagtggagaccggcgcagagttctcttccaagtcgggttccaattaactcaacgagtattggatctccggtggtccagggacttggcttcctccatttgcagaaagtccagtgacccagccttaacagtgtgcatccttcgatagctcagctggtagagcggaggactgtagactgcggaaacgtttgtggacatccttaggtcgctggttcaattccggctcgaaggaagcgcctgactcttttgcgcacaatgctgcctggctgcacctgttcctcgtcaaagaccttgcagccttccagtcataactacactttccccaggaaaacccagcaaaatcctgcctttcctgatcacaggcctgggagcctattcattcttcccgaatcctcatagtcttcagctcaaaacagtgccccttgccttgtgacccagccagaccccaattcgtgcccccaccatcctacgcctttccacttgtatttacaaactgcccacccatccccctgtcccagacccgtcaagcttcatctttcctgagctttcacaagtttttatgttgctacagccaagtttggctactgctggaaaagtaaggatatctaatactcagttcaaagtctgcaaaaacacctgcaccaagtgccctgcctacttgggagggtaagggaaagggaaagcgagtaccaaagaagtgcagacttcaaaacagcttcagtgatcctggagagttaggggctattgggtccatggcagggagcagacgtaaagcttgagtgacagctgcctttatacagaggcacgtggatttgcctccttagacaggccactgcctcgtgggtctaagcagttcggagcgtttgctctgggacctagaggcacagttgggttctcctactcccaagaaaaatgtgctgaggcccagtcagagagaatggagtcagaaatggactgggctttatcaatcaagtgaagcttcaactctggggagttggagtgggtttggtggatatgtggcagagaagaaagccaatgagcatcctttggtctcatcacataatcttggaaaaagcttcccgatgtttgatgtaaagatgcaacctatcagagagtactccaaactgaatggcccaggaaagcatggccttctgaagcctgcttaggactggcttgccccatctactacctgctgggtccacatgaactgtttaattgtgcctctcaaactggatactgcacatattactgcacatatctttttcacatggaaagcagctcctggtatcccgccaccgcctattctcccccacgtcaccccgactgtgtcaacctttcttctttggtgtcaccagtgctctgggatgcttctatggctctggaggcacagagagaccccagctccaatgacaccaaaggcaaagaccagctaacaaagagggaccaaaggtagcacctcaggccttcattggatatattcctgatggggcgtggagtcaccagagcccttggaacctttgctcagtgctttggggaaaaaccagagaaacccacagaactttgccctacttcagaaatcagcagcttctgattggaattctcagcctgtttgcagaagagggtatctcacatgtgcctctgcaagcctgggagagatttcctcacctcacttcccagtgcacctcaatgcaccaaaatgtgagcatagactactatgaggagaagggcggggcacctggggaggagggccctgtgtgtgtggtaggggagggagtagagaggccagactattatggaagcgcccattagagacctgcaccagactctgaggttgggttggagttgtcagctgcctatccagcgcccattagggttctcctcttttcctcctccagcgttctctccccgactagacccacccaaccacctcgccaatccctgtgccctcgctgactcaccttctcattttctctcaggccactgggggctgtcatcctcacctgtagaaaggtggatgctcagggagaggaaggctgtcacagatgagagctcctcctcgtggatggtggctatcagagcccgagagacaccaggcatcctcgcccagaggatttgctccgccctgaaaggggtgtggtgtcaagcggcgcagggttctcttccaaggtgggtgccaaccaacccaacgcgtattggacctcaagcattccagggatgtggctccctctgtttgcagaaagtccaatgaaccagctttgatagcatgcatccttcgatagctcagctggtagagcggaggactgtagattgtatagacatttgcggacatccttaggtcgctggttcgattccagctcgaaggaagtgcgtgatgcttttggttaaaagccctgcagcttccaagtagtaaccacactctcccgggcaaaacacccacgaagtctttcctgatcacctagcttcccacgccttgcttctactttgtgaccccactaatccctctattcatgctgaccactacttccccaccctgtgctccttcgcttttcttcacagactgctctcgagcttgagcatctccactggctgtgacaaaaccgctgtgctcacctttgacagagctctcctgaccaggtgggcaaagcctggaaggtcaagttccctggagaacgtcaagcttacttgacaagggtgtaaagtggggataaccgtggtatcttccgtgaaaactcaccctctcactctcatccatctcaggctctttatcactgcattgagatctgacagtctcatgtttgtctctgtctcattctctttctctctttcaccgtttctctgtctctgtatatttctctttgtctctgtgtctctgcctccctatctctcttccctgagccctcagcctgcccctctcattctccttggctggaaatgtatagacctatacaggcgtaaagaaaatgttcattcccactttgctgtgtctactttggggagacagctgtcaccctgagaatttcctaatcctaagaacttccattagcaaggtcaggttgccctttaggttgaggacaaggtgagtctatcccctatccccatagcttttcccaaatccctcaagcctcactttttctgagccttcacaacttttcatgctgctacagcggagtttggcccctgctagaaaagaaaggacctaatattcagttcaaagccagcaaaaacacctgtgttgagtgccctgctacttgagagggtaagggagatggaaggggagtacaaaagtgcaggctggaaaagagcttcagtgatcctggagagttagaggctgttgggtccatggcagggagcagaagtaaagcttgagtgacagctgtcattatacagaggcacacgaattcgctgccttaggccactgcctggtgggtctgagcagtttggagctttgggactagaggcacagttggactctaccctcaccccaaaggaaaaagtgctgaggcctaatcagagagaatgaagtaggaaatggacttaggttttctccaacgaacaggggttacacctccagggagatggagtgggttctgtgggtatggggcagagaagaaagccaacaagcgttccttggtctcatctcaccatctcagaaaaaatctccagagatttgatgcgcacatgcaacctatcacagagagcactccaagccaaatggcccatgggaacgtggccctctgaaaccctctggggactgggacacctgcctccactacctgctgtggccacaagagctgtttcattgcaggtctcaaactgaagactacacaggtctttcttgggaagcagctcctgatctccctccacctccctatttcccccaatgttcccctggctttgtcagcctttcctgcttctcattgctaacagaaggaggccaagctgtggcatcgccagtgcccaggatgattctatggctttggagccacagagagatccctgcctccaatgacaccaaaggcagaggctagcgaacacagacgaaatgtagtacctttgtcccttattggataagttcatgatgggatatagagacccccaggttcttcggaacctctgtttagtgttttggtgggaaaatcagaggtgagccagtgaatgggctttggtggccagcacaagcaaggttgaaacctgggtaccaactcttcctgtttgagccatgacagagtagctgggttctgtgagcatctgacccttgccctcagagatccagacccacttgccataagacagggagtggacttaaactcaatggtggccaggttccttggatgtggcttgctgcacctccagtaggtgttcagctggggggtgggtgtcccagtggtcttggggtagtggtgttgcgggaagtcagggaccccaaacagagggaccggctgaagccatgagagaagaatgtggattgtgaagattttatggacatttattagttccccaaattaatacttttgtaatttcttgtgccttggacacttatcacttccccaatcaatacccttgtgatttcctatgcctctctttactttaatctcttaatcctgtcagttgaggaggatgtatattgtctcaggaccctgtaataatt

SEQ ID NO: 374 - DNA, 15844 bp, Homo sapiens
agcttctgcccgcgcggagataaacaagcaccgcgaccgccgagcagcgccgaacccagcgcgcccagtcagaccccagggcctgtgtaccgagcatgcgcagttcccgcccaagccaggagcagcgtcaacctgagactcccgagacattaagaattcggaagggatgagatggtagaggggctagagctacctccaagctttatcctgaggcggggagtgaaggagagatgcccaaggcccaagaggggccgcgagggcctttgtccgatgccacccagtctgtcagcactcctagagctttggttttatcttgtattagcatgtgaagctttaaggggggggcacctacaggcttctgactgaagttgtgtaaacgcaacaaaatgaagctttggagcgttaggacattgatgggagggtgacgcccccctctagcagcgcgccagaggggcgagtcagaggcggccacacaccacggaagtcgggtccaagcccgctgacgtcgccggggtcccgcccaccaaccctctggacccgcccacatttcttctagacccgcccctttcggtgccgaactgaagtcgagctcttcccacgccctgtcagccacgggtgagttgaaaacctggagagcggaatcccgaacggcagccggaaggccctggactcctcatagcaacagccagctaggggcatctagtgggaagctgggattcattctagccaaccacatcacgtctctgtaccacaaggtaccattcacgaccaataagagagcgcccccataccacgtgcctttactccttcaaccaatcgagaaaaacgctagtcgtaggatccgcaagcccacctcccagtgccttgccaggcggggctcttcgcgcacgctctgccaaccaatcgtaggtgagctggcgagtgacggaagcttcggccaagccaaccagagctcgcgagccccttgccaccgaggccggcgggatggagacagggaccggctgctggggtttgggaggggcagagattgaggagccagttgctgtgccctgttctggcaaaagaacaagatgcgttgcaagccagaatgatgaattccacttttcacgtcgcctccgtggcattctgcctaaatgatgggcatggaaatggtgctgagggatgtgggctgaatcgagaacacagggacttttgtcttcagggtgagaaatgttccggtccttaaggaaacatcgtgcagcagttgcatgggtcttccaggcgttcctcccaaaacattattttttttctttcactattgagttttaaaacttagcgttctgtcgctagcattgcatcttagttacacatcctctcccacccataacgtcaaatttaggagacgatacatccccaagctttcctgcattattttttgcagtaactggttattcagtttactttctttaaactatgtccttctcaaactagtctcacctgttcgttactgtcgcacatttcctgcgaataacacgtttctgtagttctgttgttagagcctggcatacctctccccgttcctctttcccacaaggtcatcatgcagaggggattttggtctgagttaaaagccaggtattctttcaccatcttttctgtcgatagtcaaactactacaaagactactcaaatttagtagtttcttatttccctatagcttcgttatattagaatggataacttatatttgcattaccttgctgtaatgaacacacaccaagttttcatttaaaattatcaaggacaaatgtcctctgaatttaaaaatgtgtatgtagtaaaatataactcagcatttcttgattacatatcattaaaatatgaatggtactatctgagccaccagaatcagcagtgaaggtattatattaataaaaaggactaagaatcaggactgttttaagggaactggaaccgaagaggatctactatttcatcctaggctagttaacatgaaatagtgaattaaaattgaaagagcttacatggatgcttcatatctgagctactttggcagggatgtttcaagaggatgtaggtccctagatgttgagaagctctggattgaagctgtcacaaaaatagtgagtgggctccgtagtcactccatttagcataatacagagtaggacagctttgtgacatttctcaggctatttcccctgacctctcatcaatgctgacgtttttgataagaaggggtatagagactgcagcccttggggtggttacagttcatttatttacaggccttatattgacaggcctcagatttcatgctcagtaccataaaggttgatttttaaccaccaagaggcaaaagaaacatgacaggtcggagcatattttctcacctattctggcttaaatgatggtacttacctgatttgtggttgtaggtgaaatgttgggtgaaagattagctgctataaaaaggatgtcaggacgtgtagagaatttagaggacttgggtgggagatggatgtctattttctaaccccttagtcatgttcattccgatgccagcataaactctattttgagatgattatagaaataacttatatcttcatttgtttgtgggaaataaaaaataaaaatgatataaaagaaatttgaattattcccaagagctgtaaatctgtaagatagtgaaaacttaacgcagtaactgacactgcaggatccctttagtttccaaagtgcattgccaggagaataaaaagaaagaaaatcttcatttctcctctctccactaaatctgaaagggagttatctcacctatagccagataccttcaattatcgcacttgtgttaccgtggaaacccaagtccatcctttctttctgtaaaaggtgttggaaaaggtggtatgaagtgggaaaggtactgtattctgggacttcctgacaccagcaagaagcaaatatgcagataatttaatagaaacaaattagtagaggatgtttgtaatgcgaggggtacttttcgactgtaaaaccctgattcctaatgcttcttattaaagcctgcatgcctctgattaaacataaaggggaagggcatgtcaagtacatttagcacctgtgaaacgctgctggcaagtataaggagagcagacgatggtttcttgacctgtgaggctcctaatacagttgagaatctgcagtatatatgtggagtggaaaggaaggggcaaaataaactttgttcttcctttaaaaaatgtgatatgtctcagtgcttttgaaaagaaaaggaattagaatgcagaaattaagagtatggaaacaactcaataaaagaaacgtatgggtggagagagtagatgtttcaaaaggccattttaatcagaaaaaaaatctgaaagaaaagacgtaatgattaaaatgtaggcagaaaaaagaaaaagcctgaagaatcttaagagctagaggattctgcggaaaacagagcttcagtgtggttcatttaacaaagcagaagagcaggcacagtgttgcttgcgtacccagcagtttccctttatttttgccaaagaagctgggatgaatcaggattggactttaatagcattgctttccctctgcccacggttagtccaaaagtaggcacgtgactcagttcttgtcattggaatggggagaaggctgctagggctggagggatttctaggatattgacaagagtgaggaaatatccccgttttctgatgtcgctctctttgcttcctgctttacacattgaaatatgagaatgtggcctccatttgggggctatgatgcattatgacattatggtgcaatactgtagaaagccagcaacttcggatggccagggaggaggatgggaagaacctaggtcctgcatgacaacattggacagtcaaaccaacattagaactgcccacatttggacttatggctaagtaaacagctggtgtctttcaatttaagtgtgtgttggtaaggttttctgcatcttacagcaaaatacatcccacctgttaacaaaaagtatgagggattccagccaaaatcgggctttaaaaaatcagcaagcatttgtgagcactttcatttcactaatatctgaacgatagttcaaagatactataatattaattgagtaattactgtgtatattttttaggctctggggataaaacaataagcaattagccaaaagagcttgtattctagcaggagagacagatattaagcaaccaattacatgtttatattataaaataatggttatgcttaaaactaataaggaaaaatcaggaattagaaagggtatatagtaattatataaataataaaatattacaaaatatataactaaataactgaatgaaattacaaaaacaaacactttccaagtaaatgagaatgaaatgtatagtttttactgacattcccagaggtcgagagaaacagtaaattggagtaggttagtccaggagagttgtctgaagcaaattaatattgtatcaggttttgaaggaagtggcgaaaggacaggctagatggggcagaagagagcactctagatgtaaggaaccagaagagcaaaggaagaaagcaggaatgaagtaagagtgaatgagggaaataccagaatcacttgattttttaaattccctgtagcaacagcattctaggggcatctctcagagaaaaagacagaaagatgccagaagtctcaaagcaagattatttaaaggtataaaaataatataggagaaaaatacagaagacaaagtaggagtacaagagtgcatttgaaattaaggcgtcattcaaaataatgaataatttataatgtgggcgtcaaaagagttgtcataagaagtaattatggatttaagggcatcaagaaggagggattcaaactttcacaaatagaaatagaaggaaacatgaggagtggcaaaaaatgaagacaggtagaaaaacagtttttgcttgttatttttccatgatagctgttattgacatgcattatgtagaaatgaatggaatttgtttgaaaagaaaaatttcaatagagcagtaatacataaaggtaggctttttggtaaatagtgtaatttaaaatgttttcactagaatgcctttttgtaccttcctgtaggaaaatcttttcaacaaaaaaagctgtaagtcataataagttacagattagcaaagcatttttgaaataaaaaaaaacccatagatgtgccaaatgtaatagtagagcaacaataataaatatttgtaataaaaatcagaacttgttaggcattatgtggtttctggtcaaatatggttgtactaatttttctaatgctattttctgtacaaatataagaattttttaaattaagctatggtaggtatatgaacacatcttgatattactggaggtaggatttaccactcactttttgtgaccccaagtgtaaccctgaacagacttctgtcttaacaccaataacacatgattgcactgtcttctccagtgactggggaaagggacagtgctttgttcatttttgctttaccagcattcagcacatcgcctaaaaacaattgtgggaattcataaaatgtttgtaaataaatgagcaattgagtggactataatgttgcttctaaaaaccctgggttttgaacacagagaagatgagaataaaaggaaaggaataaggattttccccaaatcaaggtgaggttgatgtaaatgtcctccaaagttggtctaatctccaaagaagcttgtatctcaaaaacagtaagtctccaacaggcaaagtcaatggcagtttgtagacctggaatttaggagtgccaggaaagatctgaaaaatcatgtcttctatcaactgactgttgtctgaaattctgcacttaggttttagtcttttgatgtaaaagttatttttttccaattaaaatgtaagtaggagatatacagttaaattgtaccatcagtctgtcaacttcggggcatgcaactatgcttacctggatgaaaaagaaaatgaagaaagtaaaatagaagaacgtagtttaaattgggggataagtcatggcatgagtatgtgcccagagcgagtataagaaggccatggaaatccactgtatttttgtcatacacttattaatttgtttcaataaggttaatcactccacatggtgtaacaagaaaaataacagcctttacaattactagattcttaaacttatttcaaatactttttaatttttatgagattataagaattttttaaactttgaagctgcatgccttgtctgattccttccatttctcttctgcttctcacattattgtgttcagcaatggtttggaggcatcttggggaagacagagcagagttatggtgtaaggaccatccaactcttctcagcagccatccagttatcttgtcaagggaagttactcatcctgctctctagaattatctcctcaaaaatcggtttcctgcttttcacagaacagtacaccatcttttactattatcctaattaatgcttctcacacagccttacaaaatattagtcacttaattattaaccacattcattgggctgcactagttgaaaaagatgtcttgtttacttagtcaaagcgctgtctctgtgcaatggcattgatggtgaaattgatcagagtctacgtttgaatgagagaagctgagggagacatttcagaaatagtaagcctttttatttccttggtgtaccaggtagtcaaggaaagttaaagtatttttttatactttgtcttgattacattcttttggggactggtctctggtgttaggtttttaataaagattttggccattttccatgcaaactaatgtttccaatgaaaagatacaacattgcatgtaaattacctaagaaatattaatctgtcaatgtaattaaattatataagcaacaattagtttcaaagctggaatggattaagtcagttctatactgcacactgacaaagtgaaaggaactaaaatggacaaattgtggtgctgtaaggttatgattcttaagatttttatattaaagttgcagagtttcaaagtgctcagtgctgctctttacattagggctgtagactctcttaagcccgaggattctatctggatatgtgattgatagggtggaggctgggctgaggcttagtaagacatttaaccatgctttgtataatactccttaaatgttggctctcacaaacatagaaatagcgaacattaactagctctctgtttcaatgtctaccatctacctgtcaacttaaaatcatgaaatctataaatttggagaggagagctttatttcttaccaagagttgcagccagcagggtggccatcctaactggctgggaagtgtaacctcaggcagagaccaaaagcaagttattcaagggaggatgagataggaatttatgctgaatggattggccaagtatatttatttaacagattgtaggaggagctatacatatccatgaagagggggcatgtgcatgaatagtaagcaaacatggatgttacatgcatcccttgttcactttggggtgcagacttcacatttaaatgcattccaattaagccctatatgtcaaaaggtgaagcagggacaggaaggcactcagtgctcagcctctgtaaaccagacagaaccagaagatggtcagtggtctcttatcaggagaaagttactgaaatcagtcttttatccaatcaaagctgtagctgtggcttgtggaacagaggggtcagttagtcagcatctggtgctcagtgagctacgattgtttcaatactgcttatcttgaggccagtgcttgtttagctgctagagaataagaaaaacctgtggcaattagagcatagtttattctataagggtaggggtacgtgacttcagctttttctggcatggccttaggtctcatttattatttggtactttattgccacaaggagtctgttccattagtcttatgatctctattttaacatatctattttgtttttttcctccacttgattccagaaggactaaagtacatttcataaatacatacaagataaataaaaataagaaaaccttcaataaaaatgatctatattaatacatttccagttttagggtcaaatagattgtttcaagaaaccttaacattatctattcaaaataagttttttcagaaactgtgttgcacattggtgtacatctctttaaatagatttcaccttggcattcacactttgtctggctctgtgtgtgttagggttggggtagggggagcattgttaatgcccaaatccttcccaagtctcatcagtgaatagtctgggggaaggagggttgggaatgtgtatattgaacaaaatcctctaaatgattctgacttgcctctgggttgaaaatcaatttaacaatactatgtgttttctgaagtaaaagtcacacttaaagtaactggtgatcttggaaatttttaccaaggatactgactaatgagatggcctaccccaaatccagaatttaacttaaattccacctccccctgttttccttaaactaatctctcaccatattttccaaaaatgttatacttttcttctcatatgtactgcaatttgtcttgcattgtatttatctttgtgatttcagctagtatatggactcatggatgtctgatggggaggagggtggagaatctataagttttttcatctttctaatctttattatgctttagtcaatagtatatattcaataaatgctgaatgaattggattaaatataaaacattaaatgttatgaaaagtatgcttaattttcaaattatcaaatgattctctctattgaagggaaatcaatggtgtttttcaactttgaactgaaactctaaactatatgaaatcataacaatgtgaaattttaaacagtattattcttcataaaacagtaatataggctttaattcacaagaactgcaatggggtctcatcctttaagcagtcatttttaatgttctaaccaaatccttatactaaaacagaaacaactgctgaatgtgataaagtaatggaaaatatagaaaaactcccattttctctatctcattgtgtgtgaaatcattcttaaaaagaatcacttccacttctatttgaatcaaaaatagccaatagggcaattctaactggttaaaaaaaaaaaaaaaaccaacgagaataaaacaaatcaccaaggcaaacgagttttaaaagatatgagtcatcaaggttaaaaaaaattagaaaaatatataaaaacttacacatgtccttgatatagttttgtcttgtgtccccttaaaatttcagtagcttttcttgttgcttagaaatcaaggacatctgattggcaggactttgacaagctgcctaaaggaaactatgatgttttcagtccccatattaaagacccccttttacattccagctgagggctggtataggcaggataggaaagcttacagatggtgggaggcacagaaccttcataggggctgaggcaagaatatccagaagacaggagagagaatgaaagatgccagccgcctcattgtgagttcacagtggctgccttggtcgggagcttttggcatggttctcatgaattacacaatctaatctacttctgtacagaagattttagaggcacagttgagtgtgctaaaatggcattactacctactcagaacatgatgcttctgtgtgcccatatgcccaacttattttcaaatgtatttgagaaaaatagaaaataggcattcttagtactagagacatacaataaaaatgcgcatgactctatccatttgtaggtttcttgggagttttatcaggctccaggggacccatgtttgtagcacatgagttctctggtcgtagatcgttgatgtggtcattggcacacggtgcctagctcatgagccagtaagatttgtttcctcctaggaatttagaactggagtccagagggtggggctgggcatttgaactaggaagtaaggaaagccacactgggaaagcctttgatgggctgtgtgtacaactcagcggaaatgccaatatacagagaaatgtcaaagaataaagtcgattcttagagaagtagtgatggctcacttagttcctgagagctttcctactcatgaggagatccaattgcattttctaccattggcattgagatccccgcctctaccccaacattacactaaattttcctttaagttagtatcagtggttttctggttttctattacaaccagaaggttcctgaaaaagacaaaattatcctgttagatcatgttctcttatatctctgttagaagtacattggaaatgaacagcattctattgtcagtttgtcagcattaattataaagtatggcccaataatttttcagaacctaattgcatatagctgatgacagtggcttctggagctgttttatgatagtgttagttagagagtcctgccagattccctggaggagatagtttgtcctttctgtaatgttggaaataatgtctctcgtgcaggtttaataacaagatgcagtgcaaaagctccaggcactagccaggtcatgtgacatgaggcttgggatcagcttatctcacaaacccagacatagaaccccgtgccagccccacaacaagtggacaatccaggaggatttgagtatttcctcagctattcaacaaatacagagaggtggtttgcttcaataacaataaatagttatttattgttgtccttatgcaacaacaattctccagttgtcatctggagaaactgaaaagtaatatgaaatcatctagttcctctttaagacagtacttgggatcctgtgaatgcaaggatttccttattgtcctacctgcagggaggggcattcagggcttctggatcatagcctcggtcacattttaaaacttgacataatgtctaaaatagctgtatttatattttaaattaacttgaaaatgaaactgctagaccatataatttacctactaaatttggacacttttgagagtaaaacgggatgctattaataataaaatgaaagcaggccttggaactgacccaggcaaactggatgatagtattaccctattcttaggttttgcattcttggtttgtgagtaactcacatattgggaagcccaacaatttttggcacggtttttgaccaaatcaaattttagccgccattttggagtatggcccacgatcccaccacgagtcactagctatagaaatgagcttctctagggcttcagcttcttcacctttacaattgaatgggtaactccaaatccctttcagcactgaatagtccgtaatcaatgacacatctatgaaagagttttactttttggagaaatttgtattattttgattcatattcaatataagatacagaatatgaatatccataaaagaatattatgaataaggtttgtacacattataaaatcatactgggcagcatggcgtagcaacaaacacctggactggaatctagccacttatttcctctgtgaatttgccgaggtttccaaaccatcctggatgcctaaactggaatactttcaactgtaaaatgggcgtaagaataacaactttttagtaatgttatgagaattaagtgatatgtagtgtgtgaaggtatcaaatatataccacataaatagatgtatatgatcattaaatactagttcctcttcctattagaaggttagtgtcattattgaatatttaggtcataaatgtgcactgcaccttcttataactaaagtaagaatattgccaatgagtttctctattcccaatattggcttttattgacacagagagcaattacgtcggatggaagcacatccatgattacaggcatcatcaaagtcaaacacacctggacccaaaagccctctttcttcttttagatatatgacattgggaggttacttaggcttacagagtctctcttcccttatctgcaacaatgaatgagataatgtgtatagatcacgtggcacaggtcctagtgtatattcaataatatgcattattgttactcattattgttaatatgggagaagagaaattaaaagtctccatttaaaggtgagagagatgtttccataagaagagcttatagtgcatgtggacttcagaagtgactataagtgaagaataatagttgagaaagcaaacccatgagcatgtcgtgggtttagcattatgctaaacagcagcattgtgctattcccactgagaataatgtctttcatggacattgtggaacgattatggactggtcatgatactatgactcctgagaattctaacaccttcagattcacagtagggctgcagatgtgttttacccatccagggctcctgacagtgaaatcaaaggcttggattgataaactctgcgaacaatgtgtattagtccgttttcacactggtgataaagacatacccaaaactgggcaatttacaaaggagagaagtttaatggacccactgttccacttggctggggaggcctcacaattatggtggaaggtgaaaggcacgtctcacaggtggcagatgagaaaagtgagagccaagtaaaaggggtttcctcttataaaaccattaggtctcatgagacttattcactaccacgagaacagtatgggggaaaccacccccatgattcaattatctctcactgtgtccctcccacaacatgagggaattgtgggaactataattcgagatgagatttgggcggggacacagccaaatcatatcacaatgttaagttgctcttaatcgttttattgatgaagtacaacaggttgattagtaatacaacagttttatctgagcctcacttatctgttttgtaaatgttattttggagaaagccactcctacaatttgtttataagaagtctagcatggagtattggtgatcacatttagagaattataactgtgatattaatgaagactgacaatgtggatgatgacgatccaattcatgtgcatcagaaaaaaaaaaatcacaacttgatttttctacctgctttgtttcaattaatcctaatttttagaaaacagacaaatgcaagacccagacaagggtctttgcttagtaaagatttggaattttctcatgccaagagatccttttctgaggccttttccaattgaatccaaagtttgccatccaattcttccagaggagaggggtctagatttagtagagtattattattattattattttgccaacttctagtctctccttcatgtatttgacagctccttaaagtttctggctatagcccagccctccagctccctgactgagatgggacctatcggaagcatgttggtgttaaaatcccaacttgcctccattcctcaagccctggacttaaattggggtcctctggccctgtggatagccttaacctcactacctaatttccactccaggtttgaatttcttctctgtttctgtatctagtgagttcccattctatcttccaatcccggctttaatgtaattatatttgctatatgttgttcaataattacaagtgtttggaatggggccaagggccctttctcagcagtttagtctccagattttggtataagtgaagattagacttctcctgatcttcacatctttcagaatgccatttctaatttttttcatgaacagaattaacagaggaaaccagagccagtatctaaaatctcaaagtccatcactatatagcagcgccaggatctaaaaatctcagagtccattatatattgtgatatagtccatcacaatattttgggaaaacaaaataaaacagtctcctaccctaaaatacttagtatcttgaattaaaaccaccaaccttaaaccctgatggcagtgaaactgcgaattttaaactttgccaaggagctggggttatttgttttactgggaataatcacaacgggtcaggtagtatttgtggagggttcacttttgagtaggagtacgggggtcaccacaagaagttctgtccacatcaactcaacccttgaaggacatggagcatgcatcaggatgcagatgtatgcttgcctttatggtgtgcaagttcctatcagtgagccacactgttctcagatcctcagtgtccacagtgttttagcacgttttttatttggtaccctgaactataggactgggtaccttcacggtagcttcagtcaagatgtgattggtgtagaggcattcactgacctgtgtagggttttcctggatttgttttcctttgcagttttggatggctggttctcttgggatcagtgatgacaccaggcagtcagagtaaggctgtgctctggcagggactgatgaggcctggaggagcagggatgtgcacgactcacaatatcttttttctttttcctttttggcatttaaaaagcatcagattacattgtgaataaatccatattggaaggttatttaagtcattaagcaccagtctgccaaccacataagctgtatagtagcctctagcaggctgcttaaaggaaagcggcctgaagattgatccaggatgccaggacttgcatcctaaaagtcaggctctttgtattcttctgcctttactactgagggaaaggagtaggggaaaccaaggtagagtttcacgaacctccactttccccctcacatcagctctcagcaccaaagaggcaagttaggaaacaacacaagtgtccatcaacagactaaatggatgaacagaatgtactatatccacatagccgagtttcagccctagagaggaaggcaattctgacacatgctacaacatggatgaaccttgaggacattatgctatggtgaaataaactcatcacaaacaaacaaatactgtatgattccacttatataaaatatctagaacaggcaaattcataaatatagaaagtagaagacaccaggggctagggggagaagggaatgcggaattgttgttgaatgggtataaggattctgcttgagttgatgaaaaagatcaggagagggatgatggtgatggttgcacagcattgtgaatgtatttaatgctgctgaacttaaagccacttaaagtggcttctgtctgtaaaaccacagttcttaaaaaggcaagttgaggggattaccacttctggaaagatggagtggattcacttttctctatttctcactgagcacagctaaaacccctggacatgcatgatatgtagaacaaacagaagagtctaaaaggtggagaaaagaaaacaaagcctccagggaccttgagatccaataaatgacacaaatgtgagtttcctcggttttctttttgcttcatataacccagactgcgtgctgcagaagtctcccgcttggaaacacaccaataattgcaggcaaaaaaaaaaaaaaggccctgagtaaaaggcttgacattgaaggtgctggtttcttatttgttgagggaggggaggaggtggagctacaatagggtgactcgatctctaggcctagggagtagcccccagatcactgtggatgcaaacttgctggaaggatctcaaagacacccattgactcccctaaatttttcctttattcagattatgtaaaacttttgttttactctattcaggttaaat

SEQ ID NO: 375 - DNA, 630 bp, Homo sapiens
ggctttggtcacagtgaccgccaccgttgcccggggatgggtccctgagacttggcgaagtaggagccctgtgtgatcgtgcgtcagagtcggggctgagaccagtcctggccagggcagttaccaggacggtctccggaggccgggatgcgcggaggctccaccagcaggaagaaacgccaggaggaagaaacctgagacagatcgccggggacgcagcgcgggatcccagcctcaggcttgcgcggacggtgtgcggtgaaaatacaatgagaaggcagctgtctgcaagccaggaagaacccttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgggtggagtcaggggaggatccttaccacaaagaaatagtgactgagagagagccc

SEQ ID NO: 376 - DNA, 1513 bp, Homo sapiens
tgaaagaattaaaagtaaaaataaaacttgttagccttacagtcagaacatgtgggtaaataaatatgaaaagagcgaatagttaagctggcttaagaaagagatttaattgatagaaaaattaaacttttataggagagtctgggtaaatttaaccagtaagtaaaaacttaaagtccaatctcaacatatataaaggaatctgtataaactatatttgaaacctggatgtatgtgctcttcaaaaagttattagataagttttagatatcataaatattatcagaccagaaatggtgtatggaactcacagatatctaagaagacaagaggtgggatctcaaaaatcatgctctgatttccctaaaggatcagaagatctcagaatttatggagcagtatctcctcaaatcagaaagtaaaggatgcacacaaagaggaatctggaaaacctcccctttatcactggatggctatataaacgttcttaccaaaaatctgagaagacattcagggagatcagcttcgtctacttcaagcattattaggtggtcttcaaagtcttaggtgcattgaagaaatattttttaacgtattattgaaatggtatttgaatggaatattttgtaaaaataaagcacaaaaaaagcagatagataggagaaatatagaagaagtccaaaattgatttggaagttgatcatatagggtcagatgtctaaatcagaaaatggattggtggcagatttcttggaatagtgtgtaattttgacaaagccacctttcaatgtaatctcctgctaaagttgtcacctttatctctcagtctcttttcttcacattgatcgtaaagcttttgcacatttcttcttttagaagctcgtcttcctgatttatgcatgaattcctcgtttttgtcatttattcacaaataaagattacctcgtgtagaagctgtttcctttccacttgctagaagttattttgccaatcacatatgattattttatcattttttaattaccatcagtgcatgaaattatctttattattcacttgtttttattataatcttataatttcaaataaaatgtaaatctactgtcccttgctttacctccgtgtcttcagtgcctagaacaggactgtcatacacagtgactcaatacacatttacttatgggtgattccctgcctgactgttacaggaagaaggaccaggaatatcagaatctgaagtgtcctctaaagtcataaagactagaaggcattgaataatgtttcttaactatgcaaggacttcagaattagatctcacatagatatatacaactgtgtgtagattcgaaaaacagaattaaatgggtaaaacttttaggaaaatgtacatttttgagttaataaatgtatataaaataattattaatgacttaaaaatatgatcacagtgttaaatgtgtcttttgtaaattatacaaatatgagttttatttattaaagcatttcaaatgtt

SEQ ID NO: 377 - DNA, 1062 bp, Homo sapiens
catcaagaaataaccataaaaatgggcaaccagcagctctcagggctgctctgtctatggagttgccattctcttattcctttactttcctaataagcttgctttcgctttatggacacaccctgagttctttcttgtgcaatatccaagaatcctcacttggcatctggattgggacccctttcctgtagcaaattccctcttctgtctgggttgaggcacaggtggttgggtcacagcttggatttatacattttagggagacatgagacatcaatcattatgtgatgtccataagttgggtccagaaaggcgggacaacttgaggcagggaaggggtttccaggtcataggtaaataagttgcattcctttgagtctctgatgaaccttttactgaatacacaatttacctgtgagaggagggtagaggaatagtcacttatgccttagtctgggttagtgaaaaaatagggcagaggaagcaatcagatgtgcatttgtctcaggtgagcagagggatgagtttgagttctgtctgtcttttgtccaaacgcaatttccttgtgagcaaattgtagcttttttatcgttgtagctatcttatttagcaataaaatggaggcaggtatgcttgactcagttcactgtttgacttccttttgccttagtgattttgggggcccaagatttcttttccttttgcaaagtgtagaatgaaatcccgaaatatttttttcttggtgacctttctctcctcaggagtggagatctggtctactgtaaacaaagggtatcgaaacaatggaacaaacgttaatttcaggaaacaaaagaccagaagttcaaacgttgaagaatgatttcactacgtgaccactgaacaatcacagatatacattaattccagaattttctaggttttttcataccagagcatcaatacccctaaaaaccttttcttgctggccttgaccacccttcgtactaggatgtagtgttgatgttttactctgcctcccaagtagctgggattacaggcatgcaacatcacacttggcta

SEQ ID NO: 378 - DNA, 2364 bp, Homo sapiens
agaatgctggctgtgcgagtctcccaaggtgcgagctttctttctctctgaattaggaggtgaaaccatttggaagagccattgtaaaggggagggctttgggctgtgcatactcctcatatccaggtgagttcatttttcttgtgaacttttcacctaggccccaattagtatcctattaacctccttaaatatggaattgctaagatcttagaatactccagaatggactattagccagcccatttcctggctccatcagatgaaaatgccaaagtaggtcatacaacagaattatcttgattaatttcagctctcttgcatgggccatgatgtcatgcaagttaaaggagattcaaatttaatgcatcatttcaatgactgattaaacatgggattttctgaaaaacatttacaattccaggtttataaggattctccttctttaatatgacaaacatttcaaatgtgctaaattgatcaattatacaaatgataaattcccttgaatatactttttcatgttcatgttctccagggcctaatatggaaaaaggtttattatccccagtaactactatgttagatgaaaagctctcagcattgtgcccctttcctatccatggatgcaggctattaaaaaacaaaacaaaacaaaaaaacactatgaagatgccacatctactccagaagcctactcagaatggcatttccaaatataaatggctttgctaaggctaaaaaaagcatcaaactttacatcctttatcatacattcctaaaggactcccttgaaaaaagcacttaaaaacattgtatcttggaacatctcatatattggtgcaatttatttacaagagtcagatttaatttgttttcatgtataaagcagctttagggacttattagcaatttcaaatgttacaggaaaatatgctgaatctaaagttcattatcacaagtaagcttatttaagtgagattatttgtttcttaaaatgtacaagatagctagttctttaaaaggcttctgttgcatcatttcacttagaaataaagcttttggatgcagctgttatgctctaaagtcagggttgtgtctgttttgtgtttataagtaacatggacacagcctgctactataaacactgaacccggcttaacatgttcctgtcttttccagatgaaaatgcaacttactttcgtgatttaggttatgaaactttaaaaccatgtcacattttaatatgcaggggttccttcctgtaataacctgcaatgtatattcatgtttgcaatttctagcaagaagtaaaataactgatagcttttatgaagcatctttgaactttgcaagttccacttgtctgaatcagagcttcacagacacccacttagcacagactgggttgtgccagggctagagtaactgcctgccaaagggatcctggccacccctcctcttctttctgatcagtccactgatcactaagaaaccagtggtgagctgcttaccttttagaatatgaataaataaagagcttgccatgatcaaagagactgaaagcttcagatggatgtttatgctactgagccaaatgtaatgttcacaaaaattagggagcttcaggaccccgtatctctactctctgaaattcaacttttctcagatttaaaacagagggattcagcttttctagaatctatgtgtcaaagtggacttatctgtcatcagagaaattccatcctcatattctaacatcagattattccaatacatgttctattcatcggtcgccttagttagaaaattaggcaaaattctaaggcatctttatgcggtgacataaaaaaaaatgtattttggtagtagttgctagaaaaatatcatacttcaggactttagtcacttttttctccatctgagaatttatgagagtccctttaactcacttatgtatgtttgaagtatctttatttatttatacactttccaagcaatgtaacttatgtgttgtatgattaaaatgtagaaatgaaaactcaggctgggcacggtggctcacgcctgtaattgcagcactctgggaggcagaggtaggtggatcacctgaggtcaggagttcgagaccagcctggccaacatggcgaaaccccatctctactaaaaacacaaaaaatagtcgggcatgttggtgagcgcctgtaatcccagctactccagaggctgaggcaggagtattacttgaacttgggaggcggaggttgcagtgagccgagattggccactgcacttcagcctgcgtgacagagggagacattgtctcaaaaaaaaaaagaaaaagaaaaagaaaaaaagaaagaa

SEQ ID NO: 379 - DNA, 2766 bp, Homo sapiens
agcaattggctggggtgtttttccgctctgtgggagatttgttctttcgctttttgggtccacgctgcgtttgtgagctgtaacaccgtgaaggtctgcagcttcactcctgaagtcaggcgagaagactacgaacccacctggaggaacgaacaactccagactcgccgcattaagagcggtaacaccgcgaaggtctgcagcttcactcctgagccagcgagatcacgaacccaccggaaggctgtaacatatctgaacatcagaaggaacaaactccggacaggccgccttcaggaactgtaacactcaccgcgagggtccgtagcttcattcttgaagtcagtgagaccaagagcccaccaattccggacacaacaggacacactgcggcttctcctggctttttcaaagttcagcccaagaggaagagagacctaattaatacccaggagatggtggtgtttattttttccagctgggacaactaaggccccgagaggagaaagggactatccggggtacagaggccactgagtcagagctaggaccaacatatcaccagctctccctcttcagcgcagaccccaactcaccagcggtggcttcctgaagagctgggttaaggaggattctgaggtgcagcagagctcgctaagaggctgacgggtaaggggtgctgcgctgtgagcacaggagccaggtgggtgttgcctgccatcccctctacctctccctcttctctctgccacctcggtttttctccatcctttcactcacccccgacccgccattgtttcacctgcccttcgttgagagtaaggatagggcctctgctgtgcccaggccacgtttctgggcctcttttttcctctcccaggtctgaaggggcctcagtttggggttcttaagggcccagagacctgtgaacagttgctccctcccctacttagtggcccacgtggaactcaagagtatcccgctccgtggctgttcagaaatgcagcagcacagcccccaggcagcaatcgttcaggagcgctgggaagcccacagccagcctgagccctccgagatgcctctagactctgggcccgggatcaatacttgggagggggagagcagatgtgaatgcgatgcgggcacacgcacagcgtgctgctggaggcccagctcagaggagctgggccagcctcccccgccctctcctttctccttgccttgcgggggccaagagggctgtggagggctctgctggagtctgccatctgctgctgaaaacatctgcgcttgctgccttccacgcagacgagctgtccgtccttcctcctccccctcttccgccaaggctattcagacgggcgtgcaggctgcgggcagaggtcaggaagctccccggcctgtccaggcacgagacagcaggcactgcctctttggtacctaggcagctgtgtctgcgagtccctggctctctcccaggtgccctgctttaagaaaatccaataggaacaaagtcctgtttgcaaagtggacacctgcgggcaatgtatgtctctgtctgcattgcacagagatcatcctgagcgattcaatgattttttctctctgtgggttctaagttcttaaccagaaaaggagatgttaattgaatcacctgggaggtttttcaacatgcacccggccagtccccatgtttcccactctcagacaaaacaggtttggggagaagagtttgttgaaagaggtccctagcacccagtgttgctgacagatcccctccccacctctccctgctctgctacccttgcgcatttcagcttttatttaaaagtcagtaactacctacagtggaggagggggctttaaagctgaactgttctatctcactatgaattaaagatcagttagaaatgaaatttcaacacccaagaaaagaataggtacatttattagaaaatgggagtgctgtatatttaaatttttaaaatgtatacagattaggtccataattcattgtttctataaaatcatatctgtggcaagcccctgcctccacagaaacaattttatttcatagagcaatctatttgtaagcatggaaggaccattatagatcctaacagtgtcctttaagaatgaggacacagagttgacccacttctcctagtatatgttggaattccaaattctatcggtttatttactcatttattgagacggaatgttgctctgtcgccaagcctggagtgcagtggcgcaatctctgctcactgcaacctttacctcccaagttcaagcgattcttccacctcagcctcccgagtagctgggactacaagtgcgtacgtcatcgtgcccagccaatttcttttgtatttttagtagagacaggttttcaccatgttggccaggctggtctcgaactcctgacctcaagtgatccacccgcctcagcctcccaaagtgctgggattacaggcgtgagccaccgcacccggtctctatcaagtttatttgtttgtatccacatggaaaaggtaagcccccttctgctcacaggtactatgtctgctttgctcactgctatatccccagtgcccagaatggtgtttgttgaatgaatgaatgagcacatagacaggtctactggtggctgttgcattgcagggatctgtgagaatgcactgatgcgtacatctgtgtcattttaatatgtccacttctgtgcatgtctgcattactaatgcatgtttttatggatcgagc

SEQ ID NO: 380 - DNA, 2362 bp, Homo sapiens
atcctttaaattctttcactatgaggaatcagaatgttatgctgcatctattcctattaagttaaattgcaagaacactcacttaaaaatgagaaagtagcatcttactatttccctgtgcttttctcctttgaaatgtttttggaacactcttgggacagtagacacatttttcattttgctgtggacttccattacctcatctacacaaaaaagaaggtgtaaaatacattcatatgtttaaaagtggcaccaaactaacactctagttagtactgttttataaacaaaaatatagggaacaaaacaaaatattagaaatataagaacacactgaagcagccaagatggccgaataggaacattctaacataccacttttaatttggatagtgaaattaattctacacatgagcacattacataaatcaaattattaaagaaattattagtatcttcacagggaagatttttaccagcatataaatgttgcaataattctcaaattaaaaagaaaagatgtggaacagagattggaaatccaattaatattctcattttctatttctcctttgtgcaatcaatgctacatttatcatattttaattcatgggaaaggcaaaccttataaatgagcacgtactcacgagattgagcacagaaaaaatatatactatgtcttattcctactttatgtagtaaataaattctttgtcctttgagagcaacttattcaaaatttgtatgctacagctcctcttccactaataatgtaaggctgctagagtcttttcctctttattgacttgaaagtgtgcatatgtaagaagcagttatttggcctaggatataaaaagctaaaataaatttcctattttctcaattttttcctgatgaaaaatatttaaatgctagctgcattataaccttcaaaaacactcaataccagcccttgaagtgttattaaatgactgaattcaagtaaatgctaaaggactttaggttaaaagccaaacaaaatggcatctatttatttactttctgacaacagaagcatttaaaccctgctcttctgaaatccaaaatatacaaatttacaaatcttagccccataattgatgagaaacatgctaacaaatctctaatgctgagccattagttaatagtcatttttctcaacattctgaatcagataggctattaagatatttactttaaaaattttatttgtgggggaatgggcaaaggagagagagggctggttacagctgtctaaaattttatttatacatataaataaaatttatatataaatttatatgtaaatttttagtgtgtgtatatatatatatatatatagatagatagatagatagatagatagatagagagagagagagagagagagagaactacataaatatcccaggaatgaagggccttcaagaaggtaaaacatttcataaggcatctgcccttaattgtacttaaaatataaaagtaacataatttctttgtaactagcatcttctatcaaaaaaattaggattacatacaaatgtgttgcgtgtattaaaatattaaatactttaagtaaatttttataaatatttaaacattcctagggatagatattacagaacagaacttcaatttgtcctgatggttattcacaactgcctccaagaaaaactatttttacctagtctgttctctgtgtaaacatagcatatatgcttagatttattccccgaatacgttttccaatatttgtaaattgatattagcgtcaaacataacattaaactttttggacaattttctgaatttagccaaaatagtttaaaggtataacgcagtaaaatatgattagatatttgaatgaattcacattttggatgactcagacactttctaagtatcaactcaagttttccactaaaataaattcagcttcttcgtaaattaattattttagaatcctattctttttacatctttacatcagtcatcacttgtgctagcttaatgtatctatatctttttaagatataattatccaaaaactgaactgtaactggcatataatcaaattataaaaatattttctagatcaaatgagtattaacatttctacatcttttaaataacagtttggatatgtgactcatggtaagtttttcaacattagttgttcccaggcagttctacaattgagtcattcaagatgacttgcaaatgtccctggtaaacctcatacactgtgacttgtctaggaattttggatggtattactgttttcttacttataacatatactgtagttttatataaaaataaaatgaaaagttttttcattaat

SEQ ID NO: 381 - DNA, 1782 bp, Homo sapiens
gagaggtgttaactgagttgagcgttaaagaatgggtggcagttttgcaggagtgaaagcagaagctcagagaacctggtgtgtttgagaggaaggtgaaaggatttttaatgcacctgtgagccaatttttggtttctgaagaggaggaaggatgcagagtaaaaggaaatgtaaaagtgttgtacaccagctctcagtaaccttagaagatttatatgatgctgcaacaagaaaacaggctctgcaaaataatgtgctttgtgacaggtgtgaagacagaggtggggaaaaaaaaaaggaacagtacagtgctgtcataattgccaaggtattggaatgcaaataagaattcatcagatagaacccggaatagctcagcaaattcaagctgtgtgcatggagacccagggccatggggaacagatcagtcctcaagatagatgtaaaagctgcaacagaaagaagatagttttgggagaagacgattctagaaattcatattgacaaaagcatgaaagatggccagaaaataacatctcatgatgaaagagaccaaaaaccaggactggagccaggagatattatcattgcattagatcagaaggaccatgctgtttttacttgacaaagaaaagaccttttcatatgtatggatatacagctggttgtagtattgcatggcttctgaaaaccaatatccactcttgacaactgaaccatagtcatcatctctcatccaggtcaaactgtcaagcatggagccatcaagcatgtgttaaatgaaggcaggccaatttattgtagaccacatgaagagtcacttaatcattgaatttaaggtaaactttcttgataatggctttcccttttttgacaaactccttgctggaaaaactcctacaaaagagtaaagaagtagaagagactgatgagatgaatcaagtagaatttgtggactttgattcaaatcaggaaagatgatgctgatgccactacagtgcagaagcaaatgtgggaccattacaatggaaaagcatgaggatgataaacatcatttcagaggtgttcagtgtcaaacatcttaatgggaccagtgataatactcgctgctggcattttatgggcagtagtgaatgagcaaaggactgtaatcctaatatgctcactacttgctattgttttggttttactattcaactagagtagtgttttaaaaattaaaggaagaataaatacaatttttttaaaagttgacaaggatgagcatggccaacaaacctctctccactttggcaacaaatagttttaaatttggtttccagagtaagttaatagaaggtataacacagagaaccagaaatacaaagtgctctattagtgagatatcagaagtgattattgctgattattatctgatattttataaaacaatctcttttgagatattaaatatatactgagattcataaaacggtagatacctaaattatctcatttagtaaatcagtggggctatttaatccagataatttaaaccctaagaataattttattttccagtagattgacttttacttattttatttattttcttttacataaactcagagggaattacactttttaagaccatgtcatttaatatttccagttttaaagagaaatagagtatttggcataatgaatgcctattttactatttgtctttatgtcatatgtaatttttcctcttaaattttattttaaatgtgtttcaaagtccaataaagggaacactaat

SEQ ID NO: 382 - DNA, 1746 bp, Homo sapiens
atacttcatttactcccatgtggcttgtgcctgattccaactagatttagtcatctctacatacgttttgaaatctttggattctaactttttctagtttcactaaggatatatttggttctttttttctctgaagtcacagggcgggagagtaaaggagtagaattttcaacctaagtttatatgattctaaaattttccactaccatgctgctaaaagagattactcaactagttcttcctgttcaggtaagtcagttcagactttgctaattctgaataaagaggacagaagttatgatgctgtaactatttgacatagactgtgttagattagagatgagaggcaaaaacttgaccctagtatatttgctttcattgattccaatgtcatctttaggtttttgtatatttctttctgattttaacatatgatcctttattttcttcttactttcctcccttcatcctttctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgtgctagctatttacccaattgacccaccatatcttttatataaacaaataaattaacaagttatgtaaataatttatattcaaatattcagaagtgtcttagacatgtttaatatgctacaggtaaactccttttaggaggagaccacatgcagctttagaatagaaaatagaagaaaggaaaaaaataaacaaatgaaggtttttctctgcagtctttatgcaagcaacgacttatttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatatacaaaacagaagcacaatcacgatccagcagttctggagctgctaactttttctgcctttttctaaatgtccaataataaggttctaacggagactgaagatccatcacctgctccacatctccagggggcccatgtgtgcatcgcagtgcaggtcatacatgcttctttcccctcccatggcaaggggaataccgaatgatgacaactcacatgtgtaacccaagggctttgctacagtttactgaggactagtgcacgatacattctttgagtgttataataacattaagtcaatgcacgaattataatccctatttcacaagtacaaaaacacattcaaagaaattaaattccttgctcaccaaacagttattgacaaaaaatacaacatttatgtttcttttgaaaaatattataaagattctcaaattgtctaaccaatcatattatccgtagttgtctcttctcaagctgctaataaagacatacccaagactgggacatttataaaggaaaaaggtttaattgactcacagttcggcatggctgtggaggcctcaggaaacttacaatcatggcagaaggggaagcaaatatgtccttcacatggcggcagcaaagagaggtgggaaaaaggagggaaaagccccttataaaaccatcagatctcatgaaaactcacttactatcaggagaacagcgtggaggtaactgttcccatga

SEQ ID NO: 383 - DNA, 2170 bp, Homo sapiens
acgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggaaacatggcagtgaagaagaagaaagaagaaaaaattcttcaggaaaagaaaaaaactgaacttagagaagagggtgttcttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacaaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgagatttttgttttgaaaattgaccaagttgaaatgggagatggatccaaagtctactgtatataattggtgtccttcaagaagagaaaatatttaaaactataatccaagaaaactttctggaagtgaaaagagatctgaatctataccacagaagttcataccagaaggcacactcaaagatatttcctagtaaagctgtatgactgtaaagatgcaaagaattctcagggtctccaggcaaagacgtgacatagaggcaagagaattagaccagtgtcagatttctcaaaagcaacataacaaagcaagacagtggagcagcatgaggaaagtgactgctagccaaggattttatatccagctaactgttgtccaggtattagggctgcagaacaacagtttgaacatgcaggaactcagggaatactgtactcgtttacccctcctgaggacactcgaaaaggatgactttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaacccc

SEQ ID NO: 384 - DNA, 2172 bp, Homo sapiens
acgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggaaacatggcagtgaagaagaagaaagaagaaaaaattcttcaggaaaagaaaaaaactgaacttagagaagagggtgttcttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacaaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgagatttttgttttgaaaattgaccaagttgaaatgggagatggatccaaagtctactgtatataattggtgtccttcaagaagagaaaatatttaaaactataatccaagaaaactttctggaagtgaaaagagatctgaatctataccacagaagttcataccagaaggcacactcaaagatatttcctagtaaagctgtatgactgtaaagatgcaaagaattctcagggtctccaggcaaagacgtgacatagaggcaagagaattagaccagtgtcagatttctcaaaagcaacataacaaagcaagacagtggagcagcatgaggaaagtgactgctagccaaggattttatatccagctaactgttgtccaggtattagggctgcagaacaacagtttgaacatgcaggaactcagggaatactgtactcgtttacccctcctgaggacactcgaaaaggatgactttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaaccccaa

SEQ ID NO: 385 - DNA, 4969 bp, Homo sapiens
ctgcctggtgggaggaaaaggaaagagagctggcaggcagaggcctggaactctcaacccctctccgggaaatgcctcagacatatttcagcctctggtgtctgggcagtcggggatttatgggccagccatctcccacgatgatctcggtggtgctgaactgtgtgtcacccccagctggcactgtggctgccctcccagtggggaggcctcctgcagcctgggccacatctggagcctcgcccagtgtggagaaactgaggcccacagagacatggggccatgccagctagtggaggcatagccaatggagctgggctctccagggctgtgctaacagagccacagctctcccaccccagcttgcatgtggagcccactaaggcccgaaggggctggcctgcccaagttcacggctctgccgcaagcttgctgcagatcaccatctcctccattcctggccccaactccccttgcatatggagcaaggaaagatcttttgaatgctgaacgggcctgagacaccttcctgaaggaaagctgtccttggatccaggcattgtgaccttgttacttcatttggccttcatgaccacctgtctagggccttcatcaacctcttttacagatgagccctcttggatgataagtaaatggcagcatttggatgtgaccctggtctctctgagcttagctctggactcccctccctcgtgcccctctcaaacaagcaagaagaaggcaggagagtaagttctaatcctggctgtgccactgactccctatgtggtcacaatgaagtcttttccctctcagcacctctgttgctatacctgcacaacgaggagctttgcttggccaggaagagggcacaataggtacagagtgcaggtatttctgggcccatagacaaggaagggtgggaggaggggagcaatggtggaccctcttggttgacaaatctaaacaataatatggagcctgagaaagccaaataccagctccccagcttcctctgcagccaggcatggccatctgactgagttcaaactgatgggacattttgtaaaagtcttatgagaggttctagagatgcttttgctttcttgataaagagccatttgcagctggcacttcccctgtcccctccagtcttgaacatggatgcgatgcctggagctatggcagccatcttgcagctgtgaggctcagagagtcccagagataacatttggaacagtgttgagcccctggaccaatacagcagctgcctagctccaggcttcctgttgagtgaggaaaaacaagcaccatgttttcaatgagtagttctgaatgatacaagcagggctggtagacatccccacagttataccaatttttttgccataaacaatattaccatattttgtctatttcccctggatacaggggaccaataacaacacaagaggggccaggggcccagggggaaggaaccagatggggaggggtgaggactcacgaagttagaagctggggaaggaggctctgcaatagtggaaacaagcgggagccgtaccgtccagtcttaggggtcccgagagtgggcaagggtgtagccaatggagaaggagctggagaagaccattcatggggggggcaggacaaactggtgggatggaggaaggagactgcaaagactgaggctgcaaagcctccccttcgccctcagtggacccactcccacagcccagctgacctccgatgtaggccacagagaagcccctgcgggtggtgctgcggtctgtgtgcagcagaagcagaagctggttgtggcttgaggtcacgggtggtggcaggtggtgtccacaccaattccccagcaggggtgcctcctcgctggccccatcgaaggccgccagatggtcaaagtcacaggtcttggtcaggctgttgggctcctccaggtccaggtccaggaagaacaccttgacctggtagcccgggggcaggcggatggtccagtggcagcggatgttgttggggtaggagctggggtactgtgggctggagaagttgccccgcatggccatgtatacctcctggcattctcctggatgggggatggggaggtggaaggagcaacagtgaggggagaggagaagtcactctctgcagttacagcttaggcagcaggtgccacagtggtccaaaaaccaccagcaggttgtgggcaccatggctagcacaccagacaattgatcccaactatctgaaagttgggatgcttgatcccaaagcttgttttaaactgcaactagctgaaagctgggacttgcattccagttgacagtccccttcacaggtgtaggccctgttaggaattcaataataatacacaatacctgtcctcagagttacctctgaactccctggcttgacagatgatgtggttcatgcctggcctttccccttttctcactgccccatttggtatgtactatgagcataccaaacactctctgccctccaggcctttgcacatgctgttcctcctgcttggaatgcccttcccttctgcttccgtctaactccttcagggtactgctcaattctcttctccacgaagtcatccatgattcttactgatggatagcacagatcataatggcttgcgctgtctgtttccttataatctctctaactagactgtaaagttcccacgacttcatccattcatttgtacgaaaattgagtacctactatgtgccaggtacaaagataagcccataagggactcagtcagacaggggagattgacatgcaaaccacacacagaagtgacaaatgttagatcatagtgtaaaaaacttatataaggagttgaaaaaaggattaattctggtaaaacagtaagtcttcgcagaggtgacatgcttatgtcttggcataggccaagggtatgctagagcattccaggcagagagagtgcagaaagctcaaggctgcggggggcagaaaggtgtgacccctgcaagtgtaatggggagacaggagcccagtaggcacaggaggattcagggtggagcgccagcccctcctacctgagaagtagtaggccttgaagccacggcctccgatgttgaagtcggacttgaagaccacctgcagttcgtggcccagagacacgagggtggggggcctggtgctgccacagtagtggtgcccacgggtggggccaggccccccaagcacagccacgtagtcataggtgcactcttcattgccctccacctggaagtccacgaacaccagcttgacgtgggcagggccagcggcccggatcacccagtggcactccatgctgttcgggtagttgttgggatactcaggactggtgaggacccctgacaggccagtcaggacgccgccacacacatctgcaagggagcccacttgagctgacctttctttctccttgtggctcccagtttcctcccttgggaacaagacactccaacatgctgcccccacaggtatctcattagggcctcattaccatccagcaagcacctgctacccaagtagcaagtgtagcacgtgctcaggcccagcatttggcacctatgctgcctgttcaaatcctcagagtagccgcacaaggactgtgctgcagtttctctgattttataattaagaaaagggaggcaaagacaagttcagtagcttacttgagtttgagttcacccaggcagaccttgagataaggatttgagtgcaaggagtttacttgggagatccaggggcccccaggtggggagggagggagaggacagagaaggggaggtgtgttcaagtcagctgctgaccttggggggaactctggggacggggtaaagcacatacttcagagttctgtcaatctaggagcaagggagctgcggcatttacatgccaactccccagagtgcaggcagagggctgctgtgggctgggagtgccctactgagacttcagaaaaaagccctccagcatagaactgtggaggttggcagaagcacatcgacgtggcagggcccagggaatgtggtcagggccctgagagcaggtcacccgactggtaactgggaaagtgggatttgaacccaggaagactaactatggatcctgtgcacttgacccttgtgaccttcactgtccactcctacgaggccagtggggcacagaggctgaggtgcctgagctcaggaatgtgatcaaacctccctaatggatgaggaaaccaagacttagagagaggacctgatgaagtagagcttggtttgacatctgaagacaagtagtctcccatctctgccttttattagctgtgtgactctagggaagtaacccagcctctctgagcctcattggaacattagaaatcataagactgaaccagcttgatccactgggctcagacttgagcacagtctgaaaatatgctgctggaaactctcaggaagccagcttggccagtacaactacacggcaagtgtgggtgaatgctgcgacttgctggaggtcaccagcagggaggacatacgtgggatgtgtttcctgagactccagcatctcgccctatggcacggctgtgtgaccagggctctggatggggcatctaaggacttggcgtcttttcccagtgctggcccagccatgtaactttaggaaggccctctcagggactcagattttgtgaaatgagagggcaggtttagatagcctgtgagatcccttccaacactaacaaccttcgcggagacttcccaactgtgccctggggctccccagcagccccctggagcacctgctggcacctggtgcaaatttcattcttatgctgtatttcaagctctcttttaatgtaatgaaaagatagcacccacagactttaatatctttaacaagatattaaaatttaaatattctacatttaaaaatttaa

SEQ ID NO: 386 - DNA, 5204 bp, Homo sapiens
agtagctcccgagcacgccggaggcctggcctgtggatgagattgttccttatttccccagcttcagcaccacagaagagaccagagtctaccttgccagctcctctagcaccgaccacgtgccaattcatgtcctgaatgctcacttcacttcttcaccttgcttcacttcacttactgcacgggaacagaaaagcctagagaggatggattacctgtgcggttgcctccctctgcagagtgggcgtgtctcaggagcttctcttcttctccagcccagtgcggcctcgtgtcatccataggacccaccggcagagggcagggcctgcgagtggggccagcctcctggtgactctcgcctcctcttttccagcggacgctaccagaggacgaaggtctgactctggccaacggcccagaatttctggcccagttttgcctgaggaagccaactgtgcaggaggtcaggatcccggtagggtgagagtgggaaagttaacattcccaagagactccaagcaacaggatttcctgacctgggactattacctttctcacattacatggccagatttacttcctgctattattaaaagtacgaaaaagatgaagatatgtgtttaatggaaacaagggcaagagtttgcctgactggactttgaggaggctgtaggatcatggcgctaacggcatttggagggctgggaagggactctagccctggctttacctgcctttgtcatcagctggagcaagcaactccgcaacctcggagcctcagtttccttttctgtaaaaggcggggagggtgggtggtaagtgcaatgctgaatcagaactcatagagctgctgggtggacatgtgaagtaaaagaggagacagcttttgctcctgaaggatgccatttgcgttttcctcatcagtttgatctcctccaatcatccagcacctccatctgaccttctcagctgagaggtcctcagtgtttctgtggcctccaggagaaaggtccccctccccggctgaggccaggctgatggcaggctgcacggccagccttccacagtcacctgaaggatacagaaaaggaagagctggaggcttctagcaagctgccgaactgtgtcctccagctgcgcccagccccctggagcttctgcctccccagcagagagggaccttcccagagaagatgtcttgcgcctcacctgatcttgttctgagagtaggagactggaagagaagcgttcaactccccaaacacagctgggtttgtttcgtttaatctcccagcctgtttttctgctgtcctcctgaagaatgtttaatctcacagttaaaaccaccaaaagcgacttttttccccctcaactgctcagtaacacatgaccgtgcaaattcgtttggccccagcgccacaagtcataaaaggcatctagtgggcggcatgagtcaatcaggcctttggacggtgacgtaaccacagcttgtcagtttccccatccaggcagccccaatcccccagtgcagacatctggagccagggattgacaagtggattccaggattgggccctgcctcccgccctgttcagttccagcccagccacggccgccgccaacgaggacacgcactgtctttctgcacattcccacgtacacacacccccgcagccccctctccactcattcctgcatttccggcaatgtgaattctgacagctcgggcagtgtcagcctctccggtgcattcctcaccacaccacctcactgctcccgagcctgctgacagcactccccgccatacctaccaagccgaaggtgcaaggaacctcttgatccccactgtgtctttgtcccagggccacagcaaaatagcacccccctcccccacacaccctctagcctaatttattagacttttaaacacatttatttactgtgatatctacaccacaccaaacatctggagggaaaccgggagacaatccaccaggaatttaaatgtttgttctgcaatgtaactttgaaaaccgaaccaggaaaacttgacatctttagccaattgcttggtggtgagtagacttaagccaatatataatctgtaaaggttgtccctctttgccctctctctatccatgaaacgcattcaccaaacagcccagaaatatttctttcttctcctctcagaggtatgtgaaaccaacctgaatcaacaacatagttgttcaaccagcctcactgagaacgaaggcatttcagagctggaaagacgctagggtctggggtcttatcttccacatttatctgccttattataatccatccagtcatcctctttgcccttgccagatctcatcgcttacactaccactaccgaaggagcataacgtctgtgacttttctttttttttttttttttttttgagatggagtcttgctcggtaaccgggctgaagtgcagtggcaggatcttggcttactgcaacctctgcttcctgggttcaagtgattctcctgcctcagccttctgagtagctgggactccaggcatgcgccaccacgcccagttaatttttgtatttttagtagagatggggtttcactatgttggccaggttggtctcgaactcctgacctcgtgatccatctgcctcggcctcccaaagtgctgggatgacaggtgtgagccaccgcacccggccacgtctgtgacttttctaaagctttaagatgatgtcacccataggcagaaaggcccactcatttcgtgcatctgcagtcactcttctgacgaggtgcggctctcttttgttctatcaaagagaaagccagtctaaattaatgggaaactagagaattaggtcatttttcaagatgaaattgctggtagcttaaggaatcagctacttgaatcccatgctaaaaaagtgtaactcctgaggagtgagctcttctttcttccttccataatgtcaggcactaagggaggttcagaaacacagagcagcatctactcctttctcaacgagcgtggggtccagtgcagttggccctcatttaacaaataattacacccatgcgtgaaaggtccagtggggaaacagtgcggggagcctcaggcagagctgattcaggcctggggaggcacgggagccacatgttcagggtccacaggcccagcggagtgatacggaagtttccaagatggtaagcctctctcctggcccatgctcaccaacgggaccccattcctaaccaggctttccctctctctcttttaagtgttccaggaatgttcctacccctgcgtctttgctgaagcccctcttgcctgggatgccctctgtcctctctttctgcccacacacatcctgccagtccttcagacagggccagcctcacgggcataggacctgagcagtttcacagggccctatgcacagaaggatcccaagctcggttgattgctccgatcttgccatcttgaaactctttgataattttatcttttatcttgtgttttgggagtgaaatccaatgggatattggggcctgcaaaggagaagaggagatccgcacaaacccgttcctggctgctgcattcacctccagcgtttgtgatgccccagagcacagaactccagggagcccacgatgcaggagagttcagcgacattcactgagtacaagagaagtgagttactcctgcagctgagcacggggggcgctggcaactgcgaaaggtctcgctttccattccaaccagaacttgctcctagcgcagacagaaggccgtggcattctgagaaacacacatgatgaaggagccctgtcatatcctctcttccttgcatcgcttccccgtgtgagcaaccacttgtgctggaaatgatgacaaggaaggaccgggaaagacagggccacccgcagttccttttccttgacgtctttccttcctcatcagcgagctgaggtggagagcgttggtagaatgtgtgcataataagaagtgaaataaaaacagtcgagttagtattctactgtttccactgttctggtgagaacaaaacacatatgctgtatatgctttgaaatacaaagtgtgtaattttagtgattctgcataggagttaaatgtttttatatttgcatttaaaactgccattgtatactataaagataaagagtaaaatgtattctaatagtttaactttactaataatttagtttttacttttatttacctagagtaacattaaatagcaaacaaacaaaacaaacatcacaagttgagagagaaaccacaaaagaaagaaaaaagctttatatgttagtaccttgagaggcactttttcctgctttttgagtagggattcatgttttcccgttgcactgggcctcacaaataatgtagccagccctgccttcaaagtgcattcaagtgactcccccttcataatcacttaagcctggagccacggccttgcccctgaacacgtagaacagtcatggccgtaccaaccgtgagccattcttgcctctctctcttttgtcttattctcttgtcatctgtccacctcgcaggactgttgggaggcaccaatggactttgcaactggagatctcccaactggaccatgtcactgttatgtttaatttgcactgtgcacagtaggtacccagtcaacgtttgtcgaattccatggactgggccttatacctccgaggatttttcacagcagtagcatgtgcacatgcacagaacgagaacacaaccaatgcttgtttgctggtgaagacctggtctcagtattttgcccaggaaaccctttcttcatggacagcatgaggcaagctatggcccttgctgtggtctcagtggttcagcacggaagatgaagatgacgggcagtctcagaatattagctttagaagggactttggatccttttgattttggtaggtgaaatactttttaaaaataaagaaaacggactttggacaaatgctctcattttgtaaatgaaaaagtagagacaggaagagtaactgatttgtccaaaatcaaacaaagtaaattgtgttgcatcctctccatccgtaaccaccttcgccttccctaactgctccatgtggcctgggaaagtccacttcacctcgtcttagaggtgggcttctgattctagctaagccaaccccca

SEQ ID NO: 387 - DNA, 6037 bp, Homo sapiens
gcctcttcccccagcacaaggtgctctcggggcacatagtctggcacgcgagggccccggcggggctgttagaggctcgtggtcatcctgaccatgtggtccagggcgccccggtcctctgggccccgcatggagcgcggcgtcagcgcggacagctcgcagtccctgagcctctgcaggcagttcttggagccctcgggcttttgcggcctctcggggagcggcggcagctcaagctggtactttttccccaacagctcccggcaggggcgctccaggagcctctgcatgaggcggacgtataagtggccactcctctggcgacatcccacggcgggggccctcgcgtggacacccgcccctgctagctcagggctccgatgcgatccgttcgaccctgcatggcggctttcaacccgaacgcgtccctccttcaagatcaagaccctgaacgtagttcaacaagtagttggtgatgatagcgtgccctgactgggccaggatagcctctttagtaaaacagccacgaaagtcatgaaacagatgctcagctcctttcttcattttcactttaattcggtgatgcctctgtgtctgtctgacgacatctctcctggggtctgtgattctgctgatggtcttcagtgcctactgagaagggttcctggacatcatcaggtatgaaaacctcaaagctctcggtcctcaacgtgagaaccctgggccagcggcatcagcctcaccaggaaacctgttcttctgctcattcttgggccccaccccaggcctattcaaagaaagactccaggggcagggcctggcagcctgtgtttccaccagatctgtgttaaagctcaaatgaaccagcccacgtgatgctgaccaggaagcacaaggctgagagccagtgtccaaggcaacggtgcccatggggccagaggcagctcctgcctgtgcagctgtatttagggctgcgttcccctccctgtcctgccagttgacgtcagtgtggggttactcagctaaggccaccacggtatatccacaaagccgtggtagcaggcgacattaaggctggtccagccattgtggtcagtctcctgcgccttctcaacgctcacccctcgccgcaccagcgtccgcagcagccccatgcctcctggacgccctcctccgggacgctctccaagccctcgacgccgtgctcctcctcgtcctggaaagggtacagagtcgtcccaggctatgctgcaggtgtggggccctggaactctttgtagtcagcgcggtcctcctcgacctgtgcgcctaggagtggggacggcggtggcggggtcatgcagcgctcccagccaccctgcggccgggtcccagccagcagcaccatgccagcggccggaggcgtgggctgggggccggggcaccgtcccggaaaaccgggcgcgccccaaggtccctgcttctcgcttccgcgtccccagagaagccgtagctcccgcccccagcccggcagaaacctcctttctttacattattaagtttgttttcattttaattttcttaggacattgataaaatcactttcggatttttgagattaaaaattaaataattttcatctttaccctttttaaatttttcacactttattttaatgcttttattcttttgtaaattttaattattgtaatttatatcttcaattattatggaagaattttagaaaagtcttttcacataataaagactaattaatgaactattatttattctctcctctatctcaaatacggactttaaacttttagaacactttttgttttgagactcttgttacttatgtgacattttaactattcactcttctagtgaatttttaatgtcattcaaagggtacatctttctacactgagaattaaacaaagttctcaaaaatattctcagataatttagaatttcaccttccactggcatgttaagtatgttctccttcccttctaatgcatattttcctcacacgtcctcatgttatactccttattcaccctccatgcaagaggtgattttatttatttatttatttattgagacagagtctcagtctgtcaccgaggctagagtgcagtggcatgatctcggttcactgctatctttgcctccttggttcaagtgattatcctgcctcagcctccatagtagctgggattgcaggtgtgcaccaccatgccccgctaatttttgtattttaggtaaagacaaagttttaccatgttgaacaggccagtcttgaactcttgacctaaagtgatccacctgccttggcctccaaaaatgctgagattacaaaaacagcaactaaacgctggaatgatgactgggaacttgtctagagtctccagtgattatcctccttataacaaggcagaaagccttcctcagaattatctggactgacatcactcattgtccagacctgttaacagcaacaagtgctgtgagtctcaaatgtgctccttcaataatgcagtagaaggcctgagtttccacataatagtatccttgaatgcctggagacttaaggcacaagaatgtattgatcctatgaactttatgttttgtaaaatttcagattatgtgaggtgtttggacaaattaagtttcagggtgatatccactattgagacagaaaattagtttaaagaattaagacctcaaagtccagaatgagaaaaaattgtttttcttagagcctccttataactgtcttatttgttttatagatgtaagtactagaggacaagctctacctgatatagctggcctagacatatgcagatttattaattgtagaagaaataattatacctttcaggtaaaatggctatgcaaaataattagttgctgtttttgagacaagttctcactctgtcacccaggctggagtgcaatagcacaatcagaactcactgcagtctcaaactcccagctggtctcaagcaatcctcccaactcagcctcctgagtagctgggacaacaggtgcacaccaccactcaaggctaattttctttttatttttggtagagataaggtcttactatgttgcccaggctgatctcaaactcctggcctcaagtgatttttctgccttggcctcccaaagcactgggattataagtatggccactgttaccagccttagatcattttttttaatacagatagcttcccaactaaaaatattttattagaattctctgaattcagcaaagcaatgttattactgacccagtcttcacttattttcagctgacatggaagaacaaaattacctttatttttaaatttattttattttatattttcaaggtgcaaagtatgttgttttgagacacatatacataatgaaatgattactataatgaagaaaattaacaaatctatcatatcacttagctgtgcttcttttttatgataagaacaccaaaaatctagtccctcagaatatttcccaaaaacaatacattatcaaatatgcctacaggttgtacatcagattcacttattctactacgcctttacaacttttgcccttcatttacctatttccttcccaccaatgtaaccaccttttttaatgtattgaacttttaaaaatagatttcaaatatgagtggaaccatgaaggatttttctctgtgtgtctgtcttatttcacttaggaaacgtgccatttacatgcctcctaaatttagtacagaaatagagtgctagtcaagaatgtgtctcagtgttgttatattaattttttccaagttatcctctttatcaatttttactttttgtactatagaaaagtcaaaattattgtattaaaaaatctgtaacaaggctattgataaataacttcttttagggatagaaaactcaggaagttcaagatttctggattaatgattgacaatgttcttagtggtccctctttgatttatttcaattgtaagtaattcttggtgatattctaacataaattctgacaggtgaagagaataaataaattaagtatctctaggagaatcaatagaataagattatcttggttaaatagctaagaaagtatgctaaatagacacaaaaactttttcatcttccaaaatcagagttaaatagtaaataatcgtaaagtagctaattctgtctttctgcaaaagtgaatctgagctaaattagaagaatgtcaggaataaatttttccttgaaaactaggaacaaataatgtaattaaattatgaggcactgactgttgcatacagttttatgttgcatagagttttagcatcaacagaaaagcttacaaaacataggtgaaaatcaaaaaggagtgctgggttggagccctaaggtgaataattttatcatctcagatcacttggaaaaaggcagcgagtccaaaagaagctggtgataagctttctctctgctaacccctaatgttctgcatgaaatatgtggaggcagaagagagacagtttattatagagtctacgtggtatagagcgaaggaataagaacatttctgataagtattttcaaaatttgaagaatcattcctatataaatcattcatttaagagactaaaatacaagtaagatgtttcttgccacataaccctcagcttagccaggctctaaaaaggacaacactggacaccttgacagtggtaaaaagcagggtttactcactcttgaatactaagatctggtgctaaccttaggcagcaacttgtctatttggttgaggttcagctcaaatctcttgggttattttcagttgtgccagtcatttaatttattttctgaatcaaataataagaatggatatggttttgagtgtaaacagcattcccagatatatcttacaacttggtgtgccatctgcctaattttgaacctataggacgggaataactgcattgtgaaaaataccaggtgatttccttaaagccaaatactcttgtccctcctacttttcttttggctttcctgctgcatgggacgtggcaataaatggcagttttctgcacacagagataaaattcacttgttgaggatgtcaatcttcttgacaactcctatattggtacaaacatgtgagagcaatgcaccttctgaatcatttcaaatttgtggtctttgttagagcaggtaagccggtgccctaggagacatagctattaacgttctattatagaattttccattctgtatcatctggattcttatttaaaatgtagactaattttgttctttctactgcataagaaggtttataccactttatgcttagtaaataattaaatttatatgtcagtttaaataaggacagtctccattgttttaagtccttttcctgttccccatcatcttatataggaaacttcctctttcaatggtttatattaaaaaacctaagacaattgaaatcaaccctataaaaattatgctacaattattttaaaccctaacataatagtattatctttgatatgaatctgaaaatcaatttatttcttatcttttgatagatattcattagtatgttctatcctattttgttacttatattttggaaaagtttcttaacgttagaataatatttatacgtattaactcctctacttatccatttattcatcttatttattgtgtaatctattctaaaaatttcactggataatggtaatatcttagcaaagaagacaaatactgccattgcttccttggaattttcaatctggtagtaataagtataagagttttctgaatattataatctgatataatatactcagagaagatgttatagcagagcaacccagcactgaaaaactgttgtatgagctgaaatgtgattaataactaagatgttgagaaataataaagtctgtgaggtcaacttaacttggtcagacttaaaaagaaaataagcactcttctttattctttataagataaggtatccactacttcatttttct

SEQ ID NO: 388 - DNA, 2459 bp, Homo sapiens
gtggagagtcgggttgtgcctcccgggccttatcgggccaccaagctgtggaatgaagttaccacatcttttcgagcaggaatgcctctaagaaaacacagacaacactttaaaaaatatggcaattgtttcacagcaggagaagcaggggattggctttatgacctattaagaaataatagcaattttggtcctgaagttacaaggcaacaactgttgaggaaatttcttaagaatcgtataattgaagatatcaaagggaggtggggatcagaaaatgttgatgataacaaccagctcttcagatttcctgcaacgttgccacttaaaactctaccacgaaggcatccagaattgagaaaaaacagcatagagaacttttccaaagataaagatagtatttttaaattacaaaacttatctcgtagaactgctgaaaagcatggattacatttatctcaggaaaatgccgagaaaataaaacatgaaataataaatgaagatcaagaaaatgcagttgatgatagagaactaagccaggaagacgttgaagaagtttggagatattttattctgatctacctgcaaactattttaggtgtgccatccctagaagaagtcataaatccaaaacaagtaattccccaatatataatggggccaatacaagtaaacatggagtagttatactacaaaacaaatcagatgacctccctcactgggtattatctgccatgaagtgcctagcaaattggccaagaagcaatgatatgaataatccaacttatgttggatttgaatgacatgtattcagaacaatcacagattattttctagatctccctgaacctctacttacttttgaatattacgaattacttgtgaacattttggttgcatcttcatttttgtttcatttcgtggtagttgtttgtggctacataacagtttcagatagatccagtgggatacataaaatccaagatgatccccagtcttcaaaattccttcacttaaacaatttgagttccttcaaatcaactgagtgccgccttctcagtctgcttcgtagagaaaaaaaaataaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtagtatgcgtgatctatcctctaacagcaaaccaaggtgctattctttggaaggaattgtagatgtgtcagggaattcaagtaaagaggcatccagtgtcttccatcaatcttttccgaacatagaaggacaaaataataaactgtttttagagtctaagcccaaacaggaattcctgttgaatcttcattcagaggaaaatattcaaaagccattcagtgctggttttaagagaacctctactttgattgttcaagaccaagaggagttgtgtaatgggaaatgcaagtcagaacagctttgaaggtctcagagtttgcttttaacaagtagtacaagaaggaatagttattatcaatacaccagtggctgaaattaccatgaaaccaaatgttggacaaggcagcacaagtgtgcaaacagctatggaaagtgaacttggagagtctagtgccacaatcaataaaagactctgcaaaagtacaatagaactttcagaagactctttacttccagcttcttctgtgttgactggcacacaaagtttgctgcaacctcatttagagagggttgccatcgatgctctacagttatgttgtttgttatttcccccaccaaatcatagaaagcttcaacttttaatgcgtatgatttcccgaatgagtcaaaatgttgatatgcccaaacttcatgatgcaatgggtgcgagatcactgttgatacataccgtttctcaatgtgtgttatgctgtgctgaagaagtggaccttgatgagcttcttgctggaagattagtttctttcttaatggatcatgatcaggaaattcttcaagtaccctcttacttgcagactgcagtggaaaaacatcttgactacttaaaaaggggacatattgaaagtcctggagatggactatttgctcctttgccaacttactcatacggtaagcagattagtgctcaggagtttgatgagcaaaaaatttctacctctcaagctgcaattgcagaacttttagaaaatattgttaaaaacaggactttacctctaaaggagaaaagaaaaaaactaaaatagtttcagaaggaatatcctttgatatatcagaaaagatttccaaccatggagagtgaagcagcactttttggtgacaaacctacaatcaagcaaccaatgctgattttaagaaaaccaaagttctgtagtctaagatactag

SEQ ID NO: 389 - DNA, 3826 bp, Homo sapiens
ctaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaa

SEQ ID NO: 390 - DNA, 4233 bp, Homo sapiens
ggggctccagggacctgttgatcgcaggtgtcactggcctgactggtccctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagatgcttgggatttgctttacattctaagtggatttggagaagagacaataaagaataagcagtcaattctataatatatttagaaggagaaaagtgccaaggaggaatgaaaaagtagaacaaggtaagaggaatttggaaagcgtggtagagattgtgatggtttgcaattttaaataagtgtaggcctcatttaagtgacttttttggcaaagcaattatgaagggagggagggcaaagccatgtgggcgttatggggggaatgtattccaggcaggggaatggccagtgcaaacaatatagagaacagaagtttgtatagtgtgcaggaatgagaaggaggctgatgtggctggaatgggaaagccaaaggtcaagtagttagatgaggggctgggcagatagtgacattatgatttaattttagaaagatctctgtctgctctccagaatagacttatatgttactgtgtaaagggtagaagccaggagacaagctgctatttttttaatccacacaagatgtgatgatggccaagactagaattgttgaagtggaggtggtgaaaagtggtcagatcctgaaatatgacagaaaaaggagtcaaagatgacatcaagatatttgttctcagcaactggaaagataaagttgccattggctgagatggggaggaaggtatagataaagtaagagttcagtctggggctttgtcaaggcaaataaatgttaggttattgctggcttgacataattttcttctggagatcatgtcttaaaagtagactgctgtaagccattttctttaatgaccatgtcctatattctggatacatgtgtatgcttgtcttttgctagttagttactagtggaaactagtgaataggtaaaagcaacatgaaatatagcacggttttttgttagacacaaagaaatagagcaaaaaagtggaaacattgaaaattacttaaaacttactgtttttttgttggcagtattatagtcttttttcttattaattttattttctgtgttttataaattttctactgtagtcttctctaattcctccatttctagagtgacaatggttttacacatcaaagaatatttattcttcaattataccttccttactataatcctttagctttataaacacagttacttctgtaatgaaagatatattttttcttttttctgacactatctacttgaagatgaagagtttttttgtattacttcaacttggtataactcttctgtttgctatctagttatctaaaataaaatcttaaatacttctagtaagatgagcagttgtagcatatcatcagaaagtcctcagtgtatctttgaggtgctatattgttagtgaaaagatgttaatatgaagttttactttacagtttgatggctaggactgtgtactattaagaacatatttgcagtgattctgtgctaatatggaattatggatatttctaattttctttatgtagtatttctgtggtatttcagaaatctaatgaacaagtactgtttgataatcaaaaaaatccatacacataaaagaacaaagagtctcatggctttatcaactattatattagtttcctagggctgttgtaacaaagaaccacaaactgggtggcttaaatgacagaaatttattctctcacagttctggaactagaagtccaaaatccaggtgtcagcaggattggttccaactgagggctctgaatagaatctttccttgccccttcctaacttctggcagtggctgttcatctttggtgttccttgacttgcagcttcatccttccagcctctgcctctgtcatcattctctctctttctcttcttataatgactgctaccagtcacattggattagggtccaccccagtgacctcatcttaatctgataacattttcaaataccctgttgccaaatacattgacattcataggtctgggacttggacatatgtttttgggagacacaattcaacccataataggtataatgaatcaggtttaagatgccattatcatttacccagaccattctagtagcctgataaagttattggatgttagaatttgaacaaattccatatagtgtcatccccttttgggggaaaacacctgttaaataatttatatagcatggtgaagattacctaactaattatgtattgggcttaagttttggaaggagaaaagatagtttgatagtcttgtctagggtaatgaaggagagtggccctggaatcttgccttttaggataaaattattgctggtaaagcactgactcataagaaaacagcagtgacttatttcctttcttttcttttctttctgtctctctctctttctcaaaacttctggttcattttaaagttcaaatttaagttttttattttaaaatattttattggaaagtattaataactgatattaagcacttaataaagttaaacattttgttttttcttatttaagccttacagaaattttaataacagtaaatgttgtaattatccttattttacaggcaaatgtggatatatgtttataactgcacaaatgaattctgaagggacgcataagacattggtattggttgcctatggggaatataattgatatgggggagacttggttttccttgtatgctcttctatatggtttaaaaaattatttatgaaaattaaatatatactaaaaaagagggaaattgctgagtttttccttttagctgcactattaactcttttaggaaaaagcagtgatctatcaaattgtattgagatattcagtagatctgctactgaagtacttatttacattggagttaaaaacacaaatgcagtttgacaaatataaattcttagaaaaagtaagttctactcttttatttggggatataatattttacttatttcatatttgcagtgttgtagggtaatgcagttgcttttaacaagccataagtgaacttctgagaatttcattcaaagtaaacagttaggagaatataagatcctttgaagtgattctgccagttttctaatttttttctttaagaatttcttaagcattgtgaaatatatttatgtatttaaacttttagaaatttatgctgttaaggaaaaaattattcatgacaattgttaaagatggtaaggaagacacttgttacagataggtacagggagcactgcaatggagtcttgcagttggggagagagattgggctctactctatatactacaagtaaaagcgggaatttatagacaaggatgtgggtgtggttggtggatggaaaattactagggggcaacattaggaataagagaggattctggccaaactgacctaacaggattcttgttgaaggcaggccagggtgatcagacatcacctggaggatggtgaaggatgaggaacctaatcagatatgaggatgatcagataaggagaatggctgacttgacttagtaggactcttgctaaaattggacaacgtagagacaaacaaggaagtccaaaagttgaggaatagttgaaaaagaacatggaatagctcgagtggagtttgatcaatgagagaatctttgtcaatattttctgacacctgtatctgaaaatatcaaatagttacttatattaggcccatttagaaaatcaaaactgttgtattacattagaattagtattagtggcaggggcacagtggctcatacctgtaatatcagcactttgagaggctgaggcaggaggatcgcttgagcccaggaggtcaaggttgcagtgagtcatgatcaggccactacactccagcctgggtgacagagtgagaccccagctcaaaaaaaaaaattagtactagtattgaattagaaaatttaatataagaaaaaaatttaaaaa

SEQ ID NO: 391 - DNA, 1263 bp, Homo sapiens
gaagccagagggcctgcgttcgaaccctcaccctgctgcttattagctgtatattattggaaaatgcactcaatctttcggtgcctccgtttcccaatctgtaaaataacaagagttcttatctcataggggtaaggaggaaatgagtaaatatgtatgagtgaagcactaggaacagcgcgtggccctgcggataacagaatattgaagaactgataccacacaggttacagccagctaacaaagttaacaaccagtgctgcagctgcagcccagcccacccagcaccattagcactctggcagaaaccacatctactctgtcctcaccactgccaccccgcttcccagcacaatgcctgacacttcgtgggaggccaaaaactatttgttgaaagagcaaataaatgaaggaatcaagtgtaaccctcttagagcctggccatttcgcctcctccttgaagtcaacctcagcatgagtcacattcacagaaacattcatctcatacccagagatcatcaaaagaccagctgaaggcttttctgcagtccttgagagaatgccaaaaggtggggttgcattcaccgctcaggaaacagctcaaaatccttccactctcgctcttgcctgctccagcctctcgggaaaagggccagtctgctactccaagagaacacgcggactgaagtgctgtccacgcggtgttcagatggggctctggaggccatgccatgtgatccctcggtgaggaaaggattccctggccagccatggggaatatgaactcctgaagatgaacaagagctctcagccccctcccccaggcccacccagctgtcctgaggtccccttggaagagaccaaaagagaagaagcaacagggggccagagacccccaggcccccaaccaccatataccacataaaccaactgatgaggaaagaaggtcctaatacaggcacttcccctttcattcttgataaactcagagtccaaacagccctcacagaatgactgcaatgtcagggaactgaaaaagaagagcttactctctcccttcaataagtttcttcccttctctgagcctcagttttctccatctgtaaaagggctgctaaacttccttccagctggaaaccaagatggcggtcttggcaaacctggcacagcaagaaaaattggcctagggcataggcaggaggagttagagagacagccaagtcttcctttgagtcagtcagaaagacaagaaggctttttttt

SEQ ID NO: 392 - DNA, 6454 bp, Homo sapiens
agtgaagaaggccaggaagagcagaggatggtgccaggaggatgatgtcgggggacacaggcagctcatgcctggatcaggcagtgactggtgtgtgtgtgtgtgttatgaagagagagggatggaaattgtgaccagagagttggagttgggacccctgtcttgatcacttgagcatcagcagctccagggaagaacacattctgaaggaggaactctccagctaggatttcatcctgtcctagaggacacgaagaggtggagaccacccccacaactaaacttgaggattactaaggcaatggggactgcctaggaatatttttgagggggtaaaagcaccccataattgtgctaagtaacaaaagacagaacaagcagccttaaaacattctacatgatacactggtattagaataataagatcttaaagaccatccacttgaaaactggatttgcccctggtcatatgggcagacccatggcagacaaagaactagaagttcctcctaactcccaactcaatgtcctttccttaaagaataactgttctttattataaataggccaagcttttattatttagtatagaactcaggctgatatttttattgatggattaaaatttgaattatttctgtagcatagtatttaaaagttttcttctacatatttgttatcattttctagcaaatatcctcaaaattgaaaactgcaacgtcaatgaaatcagtgagcacactaccatccttctaatgggaggtctaatttatcattcatgcatagtaaaaaaaaaaagcataatatttaaatgtgtactctgtgattgtttataaaactatttaagtataaatattccaaacaaagcacttagcttataaatgaacttaaatcctcaaagttaggatttaagtcactcgtttggaatttgttacatatttttcctttgtaatagttggtgaccatattcttaaggcagcccacaaaagtctagtaaattccctactgtggctccagtgtttacatttgtaatggaaacgtgttgaaaatgaatactaatgtagtgctagtcatggaaagtatttaaaacacaaagtaaaaggattggacacatgagttttcaagtcgctaggaagggagaaggtaatgggttaatattaggtcatagagttctatgtctggatgctaggtggcgctattgaaccagaacagctcggttatttgccaagtcaagggtttatagagggatgctcatatgactgttcctattacacatattcacatgttccttgtctttcatgtgcttatttattttggcccttaccaccactgagattttagctcctaaaaattatgactagaaaaatactgatggctcacagcatgtctttaagagttaaggagaaaaagtgttcagaaatacattaatattcactgctcagaaatatgtgagtcttgccccttacttacacatttttgtggatgactatggatcattctctcaacttctctgggctggcttcagtttctcatttttacttttattttatttttgaaacaaggtcttgctctgtcacctaggctagagtgcaatgggtgcgatcatcatagctcactgcagcctcgacctccccaaggctcaggtgatcctcccacttcagcctgcccagtagctgggaccacaggcacatgccatcaggcctgttttttttttttttttttttagatggagtctcacactgtcacctaggctggagtgcagtggtgcaatctctgctcactgcaacctctgcctcccaggttcaagcaattctcctgtctcagcctccagagtagctgggattacaggcacctgccaccatgcccagttgattttttgtatttttagtagagatggggtttcactatgttggccaggctggtcttgaactcctgacctcgtgatccacccaccttggcctcccaaagtgctgggattacaggtgtgagccaccacgcctggacttttttttttgtatttttagtagagacgagcttttgctatgttgctcaggctagtctcaaactcctagcctcaagtgatctgtctgccttggcttcccaaaatggtaggattacaggtgcaagtcactatacctggcctcagtttctcatttttaaaaggtgataagtaataaacaaacataataaggattaatcaataaaaaataattatgtataagatgacatatgtgatcatatgtaataattatgtatatgttcaaccagtgaggttgcttctaccgagtaaacctgctggggccttggtgctccctaattcaaactcatggtcaggattgagcagtgttttctgaatgcccactccacagtacttgtcctaatatcagcagctgcgcaccggctggaagaaataccaagcatattctcttggttatccatcttgctaaaactctaatttttatttcatctcaagtacttactatcctaagcttctgagatactctattctgtctccataaaatgcaaatattaacataaaatgactgtttaaaaaaagttctaaaggctaagtttctccaatatttttggtaggagacaaatttacttgatgtcagcatatatttctacaagaaaggaacagaagaaaagacagttacgctgttattgagaaaggttattaacctgtctaaatggtgagttattgggacaggtagtattgatttgaaagaatcaatgaatatcatttcaatctgaaataagtgacaacccatatgactaacagacattacgatttttactagctctccaaagagtcattgctattagtgttttttcttctgtaatgagactggtatacatatttttagtattgctagagaggagttaccagaagtcagcaaactcctatttttttttttgtttttgtttttcaataacaggacaaacaccaaagaaaaatggccagtggtgtttttgcatcttaattcagctcttcagatggttagttaatctacaatgagttaagggtcactagatcccttaaatcagtatcttagattttagcttttcttctctctgttctctaatctactcagttatcaaactcttcaataaagggaaagagtaatgattttagtatgccctaagacatgaacttagactaaaaatacaaagatgagatggtgaagtaactagaaacttgcagctattctttctttaacctacttgacaccaactcagttgtggtgatgagaaaacaatatgggtgctaagtcttccctgaggctaaaatatattgagaaactggccaggagtgtgtgttgatctcttgtcctctgcctcaggggacacggaaacttgttgggatagaggaactgtggactagcttggtcttcaatgttaccatagaaacatatcacaagaagatgcccaagagaacacaaaacacagtagaagttactgaagcaacaactcaaaggttcattttattgggcatataatgtgtggcagctgagagagttatgctagggtgatatttaaagtatttgacaaccagctccactcaagaactgaactcagaacagtcactgagtgtgacactggcccggggtcctgaagatccctcttgtgccatgaattagtccttccgttacatcactgttggaaaaggcgggggtaacaaggacgggcagccaggctggcaggtgcaccctgaaggccgtatagaagtgtttcactgttttaaccgctagtccagctggaccacgtggactggccaagtggcctggcttatggaaacctttcatcccactacacaggaaaaccagatgtcctttattctctttgagatatttactatgccaaactctgagggaaaaataatctttaatttataggtggaaagatcatggctgaaggtaaaagagttaatagtaacttggttttcagaaatcttttctccttgaattaacgaactttcagatcacggaataaaggcccataatttctgagaagacacatatttaaatggagaaaataggaagtcaatatgatataccacgacaagagccactaagtgggtcctctgggctaagctttttataggtggtttatctgtattcaaaagcatgaagataaaaataccctcatctaggttctcaggtccacaacccctgtgctgggttttgcatcctgtgaatggtgtgtgttccagacctcaggatggatggtgatgtaactggaagaggactctcacgttggctcctcctcccaaatgctgggacaagagagtgctcattaaaataaacaatattaataaaataaaaacacatacatttatttcgtacactggctctgagggtcagaaattcaggggtagcttagttgggtggtcctggcttgggatctctcatgagacagccattaacatgttggttggggctgcagttatctgaaggcttgactggggtcatagtagctgctcccaagatggctcacacacgtggctcttggtctgaggtctcagttcctcactatgtgaacctctcttcatccatagcagctgatctctctcagagcaaatgactgagcagacagtaacaaagttggaagccataatatcttttatggagagtgttcatcttatgtgtcaccaggatttagtttgccctttatctcagactgtgtattagacacacacacaccacacaccacaccacaccacacacacacacacacacacacacacacacacacacacacacacacaccatagaacaagataaagccaaaaggagaaaatgattaacataaacctttcttcttcaaaggagtctaatttaggataagacctctccttgcacaaagaacggagtttatgttgtcttctagaaataaaaatcagtcacatcaaactctttacattaaaattctataaactctttaaatggcttgttgttgaaaagacaaaggaaatcctagtttcacaaccccactcaggtaaatgggatttgaactctaatgagagctgggaggctaaggcagcctccaccaactatccaccttccttcagcaagtccctgatggtggtagggccaccttgaccttgtgcaacgggatccagggctctctgggcaaagaccagtttccctgggccttgggacctaccagtgatgcaggtggggttcgggaaccctgtggaatgtgaggcagcagactgcatttggggagctttcatctgctgcttccttctttctttctttcttttttttgagatgaagtttcgctcttgtcgcctaggctggagtgcagtggcgcgatcttggctcactgcaacctccacctcccaggttcaagcgattctcctgcctcagcctcccgagtagctggaattacaggctcccaccaacacacctggctaattgttgtatttttagtagagacagggtttctccgtgttggccaggctggtctcgaactcctgacgtcaggtgatccacctgcctcggcctcccaaaatgctgggattataggcatgagccaccgcaccgggcctatctgctgcttatttctacagggcagaatgccttcttccatctcaggacaacaaaacagaacaataaacagatcactgaatgtgtattcaaggcttgttgtcacagcagtagattaaggagaataggaaaaaacaaacaacgttgtttgtctttctctttggataaaatgacaatgaaaaaataaatgatggatttctgaaagtaattatacttacgatgataccacaggcagcccttgtaattgctttgccacattctatttcttgctgctatttggggaccactcggtttgttaggataaaatcataattgtattttcaatttgctgctctatctattccactgtcaggatttgatacactagagtgcttttatcaaatggaagttgggccagagagaattcatcacaaggatggctctttcatactcacgcatgtttccatcaatggagtccaggtgcacacacacggattcatttgtacccaccccaacaacatgctcaagacaaggctgatggaaaatgttgccagtttcagtttccagcaacatgctcaagacaaggctgatggagaatgttgccaatttcagtttccatagggagaaatggagccattaagcctttggaacatggtgcttttatgtctgaacatgaagctcaagattttggcatctgcagctcctggttctaactttcctttgcaagcccagggaactaactgccctttgtcatcagaagagatcatttcactcctttatttcctgaggccttttcaaggtgagtagccctggacacagacctctcatggagaagagcttgcttacaaatgaagttacctgggtctttgtagatactgagcacgcccttgaagtaatgaggtaaaaatctttccagtaacagc

SEQ ID NO: 393 - DNA, 23792 bp, Homo sapiens
ccggctattcacagacatcctcttgatataattctgtcccggagtggagttgaggaggctataaaatgtgtgggaaaacctcagaaatctttagctgcattcttttactgcactgacagtgcacgtattatgatagttgaatgtagggtgctctcctaataacaggatatgccgtctcgagcttcccagacttagcgtgctgctgctgggccttagagaatttagttaaataaaaagtgtcaccgcctattcctgtttctgccctgtcaatgaaattttagtctttataacctttccaagtaggctggagtttaacatcccaacaattcaggagactgattttctccattgtaaattctgtggaagttctggagaataatttcatcactaccacccagcagtatgcaatctagaaatttcagctttccctatacttaaaagagatgtgtgtgcaacatttttctccgtcctcttagccccccacttcctgttcccctcaccctgagtgatattacagctcctaatcagaactctcctctaagaaaaactgcaagacgtcaagccactaagcctgtttacatttgctaatgggtatgcatgtctttttatattaatatttttcctaagtattttcagattgttgctttcagatttattgcttcctccttaaaatatagctgccctgaaagcagctgtattgtatctattttttgtgtttccccacagatctgaataatccagggcttttctcacagatgacactcagtgtggactaattgataatgtataattttatagcaactattttctgagttttaaaaaattgttattttatttctgttagtctttcagacactggaaaacatttctattttattggcatttttcttttcaataaagcattggtttttttaaatcatttatttttattaaactgctaaacatactatgttaggttccatacatgattaaaccaccaaaagataaaggtcttgccaatctaatgtatttacatgcttattttctttgattagattataagctttctgaggtcagagacattaaatcttgataattctattttttcctgttataaacagcaagtaaagcaccttgcatgtatagtactttagtaatgattttatattatcttattgcagcagtgtctactgttgcctcttatcttttatccagatgagcaaatgacagttttggtcataatgtagttaccccagatgtatttgtgctacagcttttattttttaaatgctcttttgttagagtagtagtttataagacttatttggggatgggggtcagttgcttcagactcaggtggctttccaacttgtaaatacaattttcaggctggatgattagcatgcatcaagcatcccttcctatgaactctaaataaagcagatttattgcatattctgtggccctctgttttagcacattggaaaccttagactcaaatagcagtgaaaggatagttattgctgagctcagaagtcttccctgccaaaggtagaatgtaatgtgttctgtggtaataggattattttgtttgaccaggtgacactgtttatttcttatgaaaaattttgatatactgctttaaaatttagtaagatggatgcataatttatgcagtgaaatttgaaaggtttttcaaaatgataaggccaaacctaagctaaatgagggggtaggcattctttataataaagctgttatactctgcccagctaggccagttatccctagatgctacagattaatggggcaatctgtgttatgtaacatttgttctatattattctgcctctaatgaggtgaatcaaagacgatgtcagttttaattctggatgcccttgcttcagtatagtataatacataggtacagccttttttagtagttttcagatggcttctttatgtttttatattgaagaaccactaacttcccattggcctataaggttagcaattgattatttatagcaaatggcttgaaatgttagatcatcagtatttgtcaataagcctgtaataacttgtttccctagcccttaacttagtgttgaagaaaaaaattgtggtattcattgataggacttagaaagcacagaaattacttattatttaagatttgttctaccaattgatatttaaagtaaaacatttttagttactgaacaccattctgtaaatgacagtattttatcctgagtatatggtctgaaatgacttagggacaactttttaaagcaaataactaattacaaaattgggtcttccaatttatttcaaattagatgcttttgtacaaatattcttggttagaaatagtcatataaatacactgttggacttgttctcattgatctccacacctcagttccttctacatgagtcatgggcttgaggttacccagaaatggactgtgaacctataaaccccagcatgcatgtggtattgcgtcgagcatgttctgtgattcccttctactcttgttacagctttattcattggatcaatgtgcattatttgctgtgtgtgctcaggtaatatttttgtttcttttttttagtttgaatatcagtttgggcttagttactttttaaaataaggctgtttcagatagtctctgccacactttgcctagcctggttaattgtgggtggacccatgctacatgttttggcattgcctttttcttatctgtaccatattacaaacttcctagtaatttgacattcactgctgtctttgctttagctttccaacaggtttggtgaaacagtccattgctgttcaatatcagcttgcatcagaattacttggagggcttattgattaaaacacagattgctgggccctgcaaaaaaagtttctgattcagtaggtctggggtggaacataagaatgtgcttttccccccacagttcccaagtactgctgatgctgctcctctaggcccatgctttcagaatcacagagctcatcttacattcttttcctgctagatattatgcccaattaatacatgaagtaaaacagaaaaatccttaacttaaaaacatgtattaatccagaagtttgattataaaaaggtttgttgaaaatgtgagaccattttttctcccagagaaaaagtatattaattgtctagctgggaggggcctatttgaatgtgttttcagagaaaagcagaagaaaaaaatacggttgtaatagaagtagttaaaacagaaaagcagtatggttgtagagtggggtggcggggaggtatatgtgtatttaatcttgagaaccaatgcttttggaaaacagcccgaagggacaagagactaggtagagactggcgaggttcctgaaagtcctgggttacctgtgaaatgccaaagatttttaaagtttgctggcagtggttattatatgtagttttacttccaaatttgaagatttcctcttctttgatgcaagtgtgttggtaggaccactgataatagttagtggagatatttgtgggaatatatttttaatcagaaagaatgcaaaaagagggggagacatttctttgagacaccttaatgacactgggaacagtagaaggtggaaagagatcagagtgtgggaaagatgtgcctgagatgaaattatctgaattctgaatgtgggggagaagatgaggagagggttgagggggaggagagatgactaagctcctcacagtgtttcattaactgtcttttacctaaaggaggaatcttcttaatgaagattggttgatgcatcatactggtcatcaagtaagttcttataaatgcaagtttgattgttttgaagggaaggatataggaaggctggataatcagctacatttagatatggaacactacaggatgtcggcatttattgttgtaaattcctttggtgaaaaacgttatcacttgtttgtgactagcctgggcaatatagtgagaccttgtctctaaaaaaaattttattaataagaaaaattagccgggcatagtagcgtgcctgtagtgccccccactgccctggacacgcccccacttccaaaaaaacaaacacccaactcacttctgccttttccttggattctacactttctctcaggatatctttccgattgagtcttgcctcatttatgtgaatgctgtgcctgttctttttttcaacagagtcttacgtaaagaaccgtacaaacttagtaaagagtttaagtcctgctttaaaccaagtttcagttcatgtaaacatcctacactcagctgtaatacatggattggctgggaggtggatgtttacttcagctgacttggaatgtcaaccaattaacattgataaaagatttggcaagaatagtatacagaggcttgaatttttaatgtaattaatgtaattaaaggtttgttggaaatgtgagaccattttgttctcccagagaaaaagtgtgttaattgtctagctggcagggatctacttgaatatgtttgcagagaaaagcagaagaaagcatggttgcagtaggagtagttaaaacagaaaaacagtatgcttatagaggaaaaattactctaaatttattaaaattcctttaaatttgttactcaatttaaatttttattgtatcttttcaattttgctatagcactaacatgacataaggctctgggtattgggacaaaagaatgcccttgtttggtagttggggtcgggtttgtagtattgcagtgtgctttaacaagcatgggctttgacatcagacatttgttgccatctggactccacaagtgaatttgctacgggatttggaggagggaaaggcactgtttccatacctcagtggttttctcatctgtaaaataagtatgtgattgcatggattgacttacatgatgaatataaagttgttcattagtacagtacctgtcatattaagtactcaataaatgctagttattattaatgctgtgttgtaggtgttcagtaaatagttgccataatgcttaaagcagacataacttgtttttatttttgcaataaagatgatgccaactttttggtttaatggaaatgctttgaatctttgatattgttgtaatatagtggcaaagaattttgaatcccagcttctggagctcatatcttgattctgcgagttacttcgctatgttactttgggggaagttattaatctctctgtgcctcagtttcctcagtcgactaaattgaaattataatagcacctacctgataggattgttgagactaaatgaggtaacaatttaaaaataagctaatacctgataattagttctatatatgtactgattggtctaaacgttatttccattttcatgtctttacttaaaatactgaaaattaattttttatagctttgtttttcagttccatgaaatcagcctgccttttctttttttggtgatacatccacattctgtataggtgaaaagcaaaacaaacaagtataaaacgaaaattatgtaagaagtacacacatcctagcagcttggcaagtgtctgtatgctcttgcctgtgcctaaatccagaattagaattcatgcttggtgctcctgtggaagatgtctaaatgttatgagaaatacatgattaaataaaaatgtgaaatgaaagcatggagacttgttgaaggtgagtgctgtttttctaattatatattttatttgtttaatgaataatttgttaattttctttgtcattacgagagagctgttttattctgtacttaggtgcatagcatactatgttttagtgagctccacatgttaatttgaaacttgccaaatttttacattattttataatttatagtactttgagaaacatattgcaatgcattacaaagcatataatgtaaaggtagttttatgaagtgtttttctcccaaattaagcatatttgggaattgcccatcaatttgtttttgaacctcagtgcataaaatatagaatttttctttcatatgctagatgtgaaaaatactcagcatatgcatgtggtttaggctacaaaatagcctgtaggttaaattcctaattctagtgtttaattcattgccttttttcttcttgtttaatggccatatgtttatatctttatattacatacattcctgattatgtaataaggtctttgatcatgtgggctatcagatttgcctcactttgtctcttagaagaagctatacatgaaactatgttgtacttaagtgaaaatttgagtatttttcttgtttgaattaatgcagtgaaacattctacttacagttagctgtctcccacccttacaggaaggtacatgccttcattttttaaaacactgtatatttattagaattgttacagaattttagtaaatatattctaatcacatattttctgattaatgtgtgcttatcagttttaaatgttatgaaatctggatatatgttaaaatgtctcagttttcccctcttgtttaccatattgccatttggtattaatagataacataatgtaaaattggatgtctttgataattttgggatatgttctgaaattaaacttgaacttttttctgtgaattttgaagatttggtatcttataattatttggtgagcatttggcatgaattatttagcttctcccctgtttatgatttatttctcttgtcatcgatttccaataggaaaatgttatggttctaaatgtctcctgtagacttcagtaattgaaaaatgtcagtcaagatggggggaatctgtaatatataatagagtttatcttttagttatgttcatttccactttttttaatgtgttttttttttagtaaatgtcaaaagtgttactcagtgcaacatattatgcaatattataatcaactaacctcttcattgataatgacttcatattgagaggttttttaaatctagaaatattcttgttttaaattccaggttaaaatgtaaaggtatttttatttttttaattttaattcttctcaaagctactagtacattataaaacaacaatttcacatttagaatttttatatgtatataaattaggattattttttaatattagccttaactttctttaacttttatgaaaaacaactagtcccaagggtatttttactatttaatatacattattcctgtgattcaaaatcttagcagtagaacctgttgagctacttaactttctgtcttgggactatccaggtgcagttataactggtttcaaagttgtgaccttttccttgcttgtttcaaaatcattccttaaaaaatgttcagtatttttcttttgtcaaaaaataaaaacaggatttgtgggttgttctgttttttaaaattagtttgagaaacttcctttgccacttgttttctgtgcaaatgttgtaagagctcaaattccctgggggtagggaggacttttataaggtttttttggttgaagggtataaaaggcacttaaaaggtatacagttacttttatttcgatatcccagtcattttgacattatgataagctttccccactttataggttatctgaaaatttggtggggggcgggtattttatttatacttaatataacaaaattattttcctatgtgtagtcaatagcacatacaaaaaattatctcctgtttgtagtcagtagcacagtcagtattcaccaaaatactgagttatttttcaagtaaaggtataagtatgaatgagaaacagtttgtgggttgggtattgtcagtccttctttttcagataactttctaaatggtcattcaatctgtaatcttaaacttttttaatgttataaattcttcaaatcagtatttgtattaaatgcagtgaccagactatgtcactgatacaatgtcatgattagatgtgcagaagactatgttacatggatgataaatgaacttttaacatatagaaattaatatcagattaaactaaaacattaagcaaagttaatacatgcttgcatacatatatatatttatttattaatgatatgtggagaatctttgtgcttcatagtcactagacctaaagtagaagcagttgtcaagaatgtccaactgctattcatctttgtggccaaagtaaatttcagattttttttttgtaatggttttctttagtctctttattaacccatcatcatgacaagtctgtcaagtgacacatgtgaaaagcagatgtcctttcttattcctggtgcttcctaaggaggcagtgcaatgcaggagaaggaacattattagagataaaggaaaaaaccagaagtgctttctcctctcacattccactcaacacttctctcaccaaatgtgtgtggggatttctctccaccaacaaccagcagttctttactgcagattctccagtggataccagccaggtgtcctctaattcagttcaattctgacattatctactgggagatagtgtcagatcccgcaagtggagggctcagtcctacaagactaccccttacttcagatgtcagtcacaagcagttagcggtttgtgattctgaccaactggctagaggtccccctcctcaagtgtgattaatttgctagagcagctcacagaattcagggaaacactttatttacatttacccatttattataaaggatattatgaaggatacacatgaactgccagaaagacaaggagcataggcaagatactgagaagggtcacggagcttctgtgccttctccaggtgcaccaccctctgggaatagtcagttcatgtgttcagctgtctcgaagctcattcgaaccctgtccttctgagtttctgtggaggcttcattacgttaaggttcagaaatcaataccccaaaatatggggctttgacatgctgaattaaagaagcagcctcaaggcctcttggccttctccagctctcctcacccaaatcctgtctctcccaaagcacaagatgaggctgttcaccaaagttcccttatttacctagaaactggaccttaaagaggaacacagttgcctgcgattccatccctgtaattttattaaccagagattaaaacttatatcacagaggaagagactaaaaattaaacaccacacctggagcccagatgacctgtcccaatctattatctgttctccagtcccatttagttcccaaagggaatcatttacaaaccattgtctgatcttccggcccatttatttacagctccccctctttccccaatgaaaatgatacttaagtgtcagccatctatcggctctttgagttttcacattttgtatgactcctgtgcacacacatgcatgtaataactgttatacttgttaactttttttcattataggggtatccaccatgattatatatgatggggaggaaagggattactccatttctgcccctgcagtctgtaggcatgattgattacatcattggtcgccggtgattaactcagtctccaagccctgtcgtgtccctggaggttggagggtggcactgaaagctccaaccatctcatcatgctttgatctttccgatgaccagaccccaccctgaagctatctacgggtccccagcaacattcatttcgttatcatacaaatgacattcttacaatttcagagattccaagggctttaggaaatggagatgaagagcaaatatatatttcacaatatcacaaacatacccttgggaattagacctctgatctaatctaggctccctcacttgccatttttgtgaccttgaacaagttgttcatcttttctggatagttctctgttaaaaaaattaaaataaaaaaatggtggctatcaggttgttaggaggactagataagagaactatgtgaaggaccctgcacagtgctagcaacaaagttgtttagtaagtgctatttcaatttattttgcttccaagctcatgtgagctccctcagtgtgtaccaccaaatcacatgatgtgtatcccagtcaaatcttaaaggtcatccaccttgaatctttaagttaattaacgtgtgtttttaaaactgcattataagaacgttagggtttttgttttgatcctatggaagttaaattttttacacaagcattcaactgtttagcttcaaactgaacagataaatagtctgtattatttcattatgtattaaaaaatgattaagcctgcctcaggcagttcaggcaaagcaggtaaaagattatcaaggagtaacattagaaaacactaatcagagtgcctaaaaagctttatgcggtccaggttgtacagggatgttggaacagtaaaacaaacaaaacattacaaggtatgaagcgttcgagataggtagaatagagcaggttatattagagaagtctcttctaaaattgtgttggctagcctgggatttgaacttataccgtgtatgtatgtccatgtgtaacaggttgaacatgcaagaagcagtgttcataaaaggtggcaaacttgttttacttgtttctcagtcttttcagatcagtacttataaaacactgatatttacagtaaatatcttatattaaatattagctaaccctattaaattgtgtgtccttgtgctgcagtcatttaatgacctcattctttggtaagttggcatgtgatttgagatagctctaagtgctaatggattgtttgaaggagttaaaggcaaaaccaggaagagaaaactatttttaggaaaaagcgatcatacaacaggccttaaatagaagaaatgagatatctctatctttactatgtaacctttaattccttacacattttgacttcatattttttgtatgtaaatgagaatgttatagtcttgtaaattccttttcctctgtgactacattcagttatttattttattgtgtgtttgtgcatgtcggtagagcacagtatttagtagaatgagttattggttaaaccacctggattcatttgtaaaatggggccacctgtctcttaaattgtaatgaggatttgattagataatctagataaatcacttagcacaagagtctccagcccccggactcttgactggtactggtctgtggcctgttaggcactgggctgcacagcaggaggtgagcagggagcaagctagcactagggcccaagctccgcctcctgtcggatcagtggcagcattagatactcataggagcacagaccctgttgtgaactgtgcgtgtgagggatctaggtttcgtgctccttacaagaatctaattaatgcccgatgagttgaggtggaacagtttcttcccaaaaccgtctcaggaaacctgtccctggtgccaaaatttgggggacctctgacgtagcacactatctggcacataccaagcactcagaaaatatcccatttctcaaaactcagttccagtgtcaagtcttaatagtatattgatcttggaactccaaggtagttggtcctctctttgtgccataaatgtgccttgtactcagtagtgctaaattgctatcaactagtgctaaatgtactactaattcatctgtgtgtccacttcccttcttagattgtgagccccttgaggacagagatgggtttactcatatttataaattcattggcatgataaatatttgctgaaagaataaaattgtattcttatgttttaagcagggtcccctccacctctgagtggaagatggtctgggagcaaaggtgacaggtcttctaaaaaatctggccacattctcaacccaccacacccccgcttttttaaacagctatttaattgccattgtaatcctaaggattggatcaatttttcacttccctttttcacacttttttccttttactaagaaaataaagtaataaagtgactgccaaatggagaaaactgtccactaaatatgaattaataagtgctattatcagaaattgtgtaaaagcaacataatggcactataaaaaggtattatcttagaatcaaaaaccttgggtttatattatagccctgctactttctagtcatatgacagtgatcaagctatattacctctttggcttgacaaaataggggtcatctctatttctggcttgttatgattgatgtgaaatattcatacaaactaccactgtgcctggtaagtagaagacactcaaatatgtcttggagttacagttaatactgtatcgtttaaatttgagaaaaaccaactttaaaaaatcacatagatacagttgtttactgctagaaattttatttaaattagttgatactcttggttaggtaatgaaaaacaatggttttatctccattatgctgtgatagggaagagtaacacagttcaaatggcaaaggcatacctgacaattaaaatgcatagttaaaggctaatacttcctgaacacaagaagacaagtctctacttgatactactctccacagttaaatcattgatactttgtgccatacagtgaaaacagaaccatctaggtgttcacggattgtatttttccttatgaaaggtagaaggttagagaaaattattcccaatacaattaatacaaataaaattggttattaggtgccttttaattaggcagtaagggcatatgaagcttcattacctatgagaattttgtcaaaattatttcccagttaccatgttttaaaacagcctctcagaattccccacttctaatttctcctttctattctaccaattttactccatacctttttgctaaataaacattttcttccaactctgagtttggtgtttttttcatttgatctgctcttcaaagtgtatcagctagtgattgaattaggctatggtgtaacagagaactctaagacagtagcttaaacaagattttttttttaacccctgagtcttgctgcctttttcacaaagacaaagctttttcagaaactcccagcttatgtctcatttgccacaactgcgtaacatggctatcttttagctgtaagagatgctgagaaacatagtttttttgctgggcatattgtcactgagcaaaatcaaagttttatttggattattgtacttacaattcaccttttatggcaatttaagtagtcatttgtcatagattggaggatttcctggaagggtgaagaacttctatataggttacttattctgactaacataaattatcctaccaccacaatcccataactctaaacttacagagatgtcatagaaaacaacaaatatacacacagctaaccacaaaagaaaaaggaaatcccagctgccagaagtgaagaaaaaacagccagaatagtgaactcagcagctgaaggtacactgacctaggtggatgatagtgttggctgtgggtctcaccaatggaccctgagactttaacagcaagagatatggcctgactatacagggaagctgggactgagacctacacaaagccaagaccttagaaggtgctccagcctcaggaaggaggatgagcaaacttctacacaataacccagggaagctacaaagttgtctgaacccaagactttagggtggagaaagaggaaggtgtctgtgagaaagagttgaagtttacatttcagttttgctttcagaatatccatgcttagcttaaaaatgtgaggcacattaagttactggctttaataaaggaatgaatgaaatgtacagaagtatgtgttctcggggcctcttttaaagtcattaggggaaagaattggcatatattcagacgcatttgaagaaattatatatttttggagatggagtcttgctctatcgcatggcatgatcatggcttactgcagcctcaatttcctgggctcaagtgatcctcccatgtaagcctcccgagtaggtgggaccacaggcatgtaccaccttgcctggctagtttttaaaatttttgtagagatggagtctcactgtgttgcccgagctggtctcgaactcctgggctcaagtgatcctcccaccttggcctcccaaagtgttacgattacagtcatgagccaccatgcctggcctgaaggaaaattttaaaacagaaggaataagctagaatgcagcacagaagaggtagaaaattgaaagtaattcatggaagatccaatatacatatatattttaggagtttaaggagaaaacagaaggtgtgaggcagttgtgaactaacagaatgtgtagtatacaactcttggtagagaaatggtacgcactgaagtttttgaggcgtgggggacaggtagcttccttctctcatgcatactcctgctgccaaattaccccctaacggctacgttataatgaaaacagtttcatgccagcttctgttatattaaccgagcaagaaaactgatcttagcatgttctgcaggctaaaggaaattgctcttggcccatttaggtgctctaaccaccatcttgcctgaaaggttcctttaagaagcagaattctattactttaacaaaaggtgtgttcatggctggacaagagccttttagggggttagactaggacatcatcccaaaatataagggctacaggccatgctggattcttatggcctcttcttgcaatggtggtatgtgttactctgctattagtcagtctgaaaacctttaatctcaccatcggaggcccatttaaaaaattactttagcaggtcactaataaaaatttctaccatttagtatgaaaattaagacattgtatgttgatcaagatgcagtcaacaatacctagaatagcttccactagagtatgcattctctgattagaacactagttcatcttcctagtgaactgttctatcaggatggtagcaagacttaagcgatgactttacataagttatgtgtaccacactgtgtatactggagtatttccatgtaaattacagacaacagctatactggaagcaataaatggccaagaaatttccagagttgaccaaagacatcaggaatgatacttgcttccagaaaaagaaccaatgtaacattggcttaaactgttgtgcttttgcttttctttcagatgtaggctgtccaggtgtccggtactataactccacaagatcagtagggccccaggctttttctgttctttatgatccactctctaccatgtagcatttgtcttcaagatcaaaaaatggtggctgtagtgctcacattccagataaggaagaatgggcaagaaacaaaagatccactccaaatgtgatggcaaaattaagacttttgagtgaaaaatggaaatttgtcttcagtacatacacactgaaagaaatgttgaagagagttcttcaggcagaagcaaaatcattccaagggaaatcctggaatgcaggaataaatgaagagcaatggaaatggtaaatatgtgggtaaatttgaaggaatattggctgtattctgtggtttaaaatatctgtggaattaaaatgcacctacaataacgagacaggagaagtttgtactggagtttgtcctcaggttctagcattaggtaggtaaatggtaagattactttttttagactatgaagacaagggtgcatgttgtaatctcttaagcactaaaaggctaatagaatgtatacctaacaatttaatggagacaaaagcatttaaaagaaggcaagaatagaaaagggacataaaacaaatgggtcaaatttaaagttgcaaaatagaaacccaaatactttaaatgagtcattagttgaattaagtttaaaaatttatcaggctgaaaattccctactacatgttgcttacaagaggcatactttaaatacaaggccacacaaaaaggttgaatgtaaatggcatagggaaaaaaaaacacagcaaaccaaataaaaacagtttgaatgtggtattgtcaggcaatgagatttaaggcaaaaagcattaccagagataaagagggacattttataatgatgaaggaattaattcacccaaaacacataaagatcctaaatctgtatgtgttgaaaacagatttgaaatacataaagcacgaatgacatataagaagagaaataggtaagtgtctaaccatagctggaggcttatgcagctttttccatagctgatagactatccggaccctacccccaaaaaatcagatgcagaggatctgaactttacatatatgaatacttgatttaaaaaacataattcacattttcttcaagtaaatttatcaaaatttaccctattttgagtcataaagcaaaccaataatctcaaaagatcaaaagcattcatcttacattctctaacacagtggaattaaactagaaaacagtaaaaaagatgattagagaaacccgcaactactctgaaattatgtaatagatttcttgatagtccctgggtcaaagaataaaacaaatttaaaaatattttcaagtgaataatatgacataccaaaaagtgtgttgcagctgaagcagtgcgtggaggaaaatttatagatttacatgcatacattagaaaagaagcaaggctgaaagtcaattacctaaactattttcaagtagctggaaaaagaagagcaacgaaataataaaagacaaaaagtcagtgaaataacacacaatagagaaagccaaaatgttggttctttgaagtctaaaaacaataataacctctactgtttaacatatttgagatattagccaataacgtaaggcctgaagtaaaaagatagaacgtttagaaagaagaaaataataccatttatagacaactggttgtgtgcatagaaatttgaaaagactcaacaaacaaaataacttatcaaggtcactgaatacaaactatacagaaattgtatttctatatatcagaaacaaatagaaattgataaaatgataccatttacactagtgtaaaataaatacaagaaattttccaatcatttaagcattttttttttaattctaaatatatggatataccatgttcatgacttggaagtcaattttgtaaattaatctgtaacttcaatatatgatattatcaaaatcccaacagtatgttggagaaattaacaaactgaagaaatgcaaaggaccgagaatatccaagataaacttgagcaataaaactgaaaaatgttcaccaacagacataagacctgtgattataaaagtgtagttgtaattaacactgttgttggctggcataaggatagacaaatagaccaaagtaacagactagagcaaagtagactagaacaaaatagaacaaagtaacagaattctgtatacgtggtgatccacacatttaggtcatctgtgatttatgagaaagagaaactattgtaatggtacagtcaattagatagctgtattggggaaaaaagtagaccccttccttgataccatatatatagaaaaatcaattccatgtggaatatggtttaaatgcgaaaggaaataatgaaacaggagagtgtcttcatgttttggggtaggcaactatttaaaggacataaagcataaaggaacattttaaactaatttgtggtgatagaatcagggtagaggttatcactcgcctggcaaaattaatcaataagaaaagataacttagccagacacagtggctcatgcctgtaatcctagcactgggaggctgaggcatgaggatagcttaagaccaggagttcaagactagcctgggcaacatagtgagaccttgtctctacaaaaattttaaaaattaactgggtgcagtggcatgcacttgtagtcccagttacttggcaggctggggcaggaggatcatctgagcccaggagtttgagcctgcagtgaactataattgtgtcactacactccagcctgggcaacagagcaagaccctgcctgtctaaaattaaaaaaaaaaaaaaaaagcttgatatcaggaaagaaataaggcatgaaaacggataaaattaaaattatttgatttagaaagtgattgtgaatttatgtgaataaatttgaaattttagatattttttgattagtgttgccaaatatgtattagtaaataagtctcaatctgttttttaaaatctactctgaataatgcacaagctctggatgatttattaaaatacattcattgtgaccaagtaaggattatttccatatgggagaatgatttaacactgtaaaatcttttcacatagtatataccatgttaataggttaaagagaaaaggcatgttactatctcagtgaatgcagggagttggagggggagaaccagcaaaatgcaagttatattcacttaggattttaaaaataaaacatcctcttaatagatgaataaacgtattagtacgataaatgatagcttaccaaaacccatagttattgttacaagttaatggtacaactttagagatgttccttaatgtcagcaatagtacaggaatgggatattgtattaatacatctgttccatgttgcactggagatcttggccagtgcagtgagactagaagaataaataataggcataaagactggaaagagagaatcaattattgttaatgggcaagatcattgtttatttgaaagtccaaggaaaactacaaagtagcaaaactaatgtgagtgttgagagattttggatataagagcaatctgcaagaattagtagtgttcttttccacttcagtgtgtttgaaagtgtattatttgaaagaatttcattcacaattaaaactctaaggggacctaataatacatccaataaaaatatgcaagattttgtagaagtagactaaaatgaatggagcagtattctatgttagagaatgggaaaaatcagtgcattaaagtaccagttctctccaaatctataaattcactgaagttccaatcaaattctcaacaaaactttttatggaatttaatcaacctaacctgaatgtggaaagacaaagctgagattttttttttttaaacaggaaaaataggggagtacctatcataaaagacagtagggcttataaaactatagtgataacacagcccttgtgatgccaggatagacatgtaaatctatggtacagaaacagatacatgagaacttgatacgtgacacagtggagaaattagtaacttttcaataaatggcactaggacaattgcatgtctgtatgtgaaaaaattatatacccttctcacaccatatttttaaaaactggtagattaaagacctaaatgtggcggaggggggagggggcgggaataccattttaaatattttagaaggtaatacaggaaaatttgaaccaatgtaaggaaggagttgttggatgtgactcaaagtgggaaccatgaagaaaaagagtcacacatctgactatattaaaactagaaacttaagtatgacaaaagacactgaatattagagggccagccacagacgtggaaggtacttaccttgcaattatctaccaggaactgacaaaggaagtgtccaaattacataaaggactacttaaggggggaataaatgagtgatatatgagagagaaccaaaaggtcaattaacagaaaaatgttttagctcactaggagtcaaggaaatgccagtcagcacagttagataccatttcacatccagtcagataatatcagggattggcaaacatgttgagaaaataattcatactttagtaaagttgaaattacatattgcttataacagcagttcaacatctgtctttttataagactaaagttttgcatcatatttaggtacagaaattgtcagaacacttaaagcttgtaggcatttgttgctgggagaagactgaattgcttttttcaaaaactggaaatcacattgatgtgttgtaaaagagaaccttagatttagagagggaaaaaaaactacagtattttgttaaatttatctacatttaaagatactaataaatgcagtttatgaactaccagtctcctatattggtcatattttgacaagtaaagctttttttttcataacgtcaatattcacacagaggttacagttcagattaggagaacatatgtatgataaaacaattagactaaaaaggtcctttctttttatatgaaatggcagaaaagcaacagcagtttattgcttatgacagaatacatatgatactcgaatatttcttgagatctttgcttaaatctagtatctatacaaaatttttatgttcgctagattgtaaattcagttttcttactaagaaagactgaaatttattaataattttggggttctagtgattagcattagagactgatttgcttttaaagagaatcgcatattttatatatttccaattttacatacttctgaaagaacataactttgtcattaatatatggcatatgtatacaatgaaaaatgtacaaggatgtttcttacagcagttattgaaatagcaggaagaaaaaggtaacttaaaagacacttagcactagagtctccagtcacatctactccctggcccatgaactaagaacgtttttaacgtgtgtatgaaaggagtgacttaatagatctggcgtgttgaaacctgcacctttcaaagaaaggtctagccctcaacttgctcctgggagatcacagcgctaagcccctggaatatcctgcctgatgcaaggcctttgtttacctggggccttggatcacaccagatagtttatgctacagatttatggtgagggcattgcaccttgcagtatcaatttaatcgccgggggaggtggaaactgaataacatctgccatttctgttctccatgcctatgtgactaacacccaataaaaaccttggacaccaagtctcagcttccctggttgataatatttcataaatgacccacactcattcagagaggattaagtgctgtgcatgcatctcctgtcagatgggacaactggaagcctgtcctgctctcttctgaactctttcctatctgccttttaaaactgtactgattttaaactgtacttttgctctaataaactaattgtcaacgtaacttttctgagttctgtgagtcattgaactggacagtggtcttggggaccctgccataactgtttaaagaactgttttttaaaaataatatttgatagagactgtatgttctgcaaatcctaaaatatttgctatttggtcacttacagcaacagtccccaacctttttggcaccaggaaccggttttgtggaagacagtttttccatggacaggggtaaggggggaggtgtcgggatgaaactgttccacctcagatcatcaggcgttagattctcataaggagtgtgcaacctagatcccttgcatgtgcagttcacagagaccactgctgatctgacaggagatggagctcaggcggtaatgctcacttggccatcagtcacctgctgtgctgcttgattcctaacgggcatggaccgatactggtcctcggcccaggggatggggacccttgacttacggaatacttttgccaaccccagcagaaatataatgaaaaaataagtttgtttcatacattgaaaacagctaaaatggatgaaatctcaaacttttaactggagaaaaaagtaacagaaggttgatatagtgtattatttatgtgacttaaaaacaaaacaattactaaagatgtatatgcattaagaaaatcacaaaggtttttattttcaacatatgttgaaaataaatgtgtgtgtgtgtatatatatatatatttacatatttgctcataacaatagtttgaggatgtccgcaaacttaaagcttggggtagggggtggaaatggaatggatgataaaacttacttgtctcatttttgtttcttaaaaagagatgcagggtgtattagtccattttcatgctactgataaagacatacccgagactgggtaatttataaagaaaaagaggtttaatggactcatagttccacgtggctggggaggcctcataatcatggcagaaggcaaaaggcacatcttgcatggcagcagacaagagaatgaaaatcaagcaaagggggtttcccttataaaactatcagatcttgtgatacttattcactaccatgagaacagtatgagggaaatcacccccatgattccgttatctgccaccgggttcatatctcagggaaaaaacagaccttgtaaaacaaataaggtagttattttaattaatattttcatgtatttccttaaatcaacttagcttagaactatggaaagtcagaaacaggccttggtaggtaaattgcccaagtcgtggtgaattcttaaagacagcattctataggaaatattttagtgctggcagatttagttattttgaatggtggaaacttgaaatttgatctttgaaatataaaggaataaagatataaggactgtactgtacattttagagacatcaagttctcttaattttgtgactctacgttgagaagaacattgagagattacatgagtaacaagaaagagaaactttctgagaatgcacagctacctcttttacaaataacaaagcattgcctttgcaggggttagttttctttaggcttggggcaagacattaaatccacccctggtttataatggaggcaatatacagttgacctttgaacaccattggagttggagtaccaatcctaaccccaccctgccaccccctgaaaatctgagtgtaacttttgactgctctcaaacttaactactgctattgactggaagccttactgataacaaatagtctattaacacatacttggtatgctatatgtattatatactctattctttaagctagggaaaagaatgttaataagaaaattgcaaggtagagaaaatatatttacacttcattaagtgaaagtggatcatcataaaggtcttcatcctcctcacgttcacgttgagtaggctgaggagggggaggaagaggggggttgatctagctgtctcagatgtagtagaggcagaagaggtagaaaaggaggcaggagaagcaaggcacggttggtgtaacttttattttccaaaatccacatataagtagacctgtgcatttcaaacccgtggtgttcaagcatgcactgtaaccaattggtattttcttaaaaataaaaaaatcttggttatttgtagctgccacaaaacacagatcacaccaagtttagtgtccactgatatctggaagactttaagggtattacattttaagtgctattaggatcttgagtaatcatcaaataagaaaatgggtattaaaatgctttgtaaactgtaagttaagataaaagtggtattcctgatgttaaccactctcaactgagcttagatttctagtatataccagcttgggtgacatagtgagacctggtctctacaaaaaaaaattaaaaaattaagcatggtggcacatctcagtagtccgagttactctggaggctgaggtgggaagattgcttgagcacaggagattgagactgcagtgagccacagtcatgcgactgcactctagcctgggcaacagagcaagaccctgtctcaaaaataagtaaataataagaagatttctagtatataaagtttaatgataccttcccta

SEQ ID NO: 394 - DNA, 6661 bp, Homo sapiens
gcaatcaggctgcagctggagaggacaagggcggcttccgggtgttggcgggggcatttgtctcctgccgcagctggggctgcagatctagtcttcagttcacagagaactgccccccaactgctcccccgtactctgctcctacaggcccagctgctgtggctgtgcgacctgcagggactggcagacccgtagctaagacgccaggatttcctggaagcagagaaatggccgatttcactactagatctcaagtgactcttgaagaaaggcaagttggatcttgctgtgttctcatttcacccaagacctttggctagatcagaacataaaaaattcatttcaaaaagtgatactgagaagatatgagaaatctagacatgagaatttacaaataagaaaaggctgtaaaagtttgaatgcatctaagttgcaggaaggaggttataatggacttaaccaatgtttgtcggttactcagagcaaaatacttcaatgtaatacatgtgtgaaagtctttaggaaattttcaaattcaaatagacttaggagaagacatactggagagaaacctttcaaatgtaaagaatgtggccaattctttcacaggttctcacacctaagacaacatgagataattcatactgaagagaaaccctaccaacatgaagaatgtggcaaagattttaagcagtcttcaggtcttactatacatgagagaattcatactaaagagagaccctacaagtgtgaagaatgtgacaaagcctttaaacaatcttcaaaactgaataaacataagaaaatttatactggagatacaacctacaaatgtgaagaatgtggcaaagccttttcctattcctcaaccgttactcaacataacatagttcatactgaagacaaaccctacaaatgtgaagactgtggcaaagctttgaagtagtcttcaaacctgactatgcgtaagattattcatatgggagagaaaccctacaaatgtgatgaatgtggcaaagcctttagaatatcctcaaaactgaaagaacataaaagaattcatacttgagagaaaccctataaatatgaagaatgtggcaaagctttttactgttcctcaggccttactcaacataacatagttcatactggagacaaaccctacaaatataaagattgtggcaaaatttttaagtggttttcagaccttactatacatcagagaattcatagtggagagaaaccctagaaatgtgaagaatgtggcaaagcctttaaacaatcctcaaaactgaatgaacatatgagaactcatactggagagaaatcctacaaatgcgaagaatgtagcaaagcttttaagcaaccttcaggccttactctacataagagaattcatactggagagaacccttacaaattcgaagaatgtggtaaagccttttattggttgttaagctttactaaacataattgataggggagagaaaccctacaaatgtcaagaatgtggcaaagcttttaagtggtcttcaaaccttactatacacaagagaattcatacgggagagaaaccctgcaaatgtgaagaatgtggcaaagcttgtaagcagtctttgggccttactatacaaaagagaattcataatgaagagaaaccctacaaatgtgaagaatgtgataaagccttttactggtccttaagctttactaaacgtaagatagttcatactggagagaagcactacaaatgtcaagaatacgtcaaagcttttaagcgtcttcaaaccttactatacataagagaattcatactggagagaaaccctacaattgtgaaaaatgtggcaaagccttttactgttcctcacaccttattcaacataacatagttcatactgaagagaaacactacaaatgtcaagaatgtggcaaagcttttaagaagtctttagaccttaatgtacataagataattcatagtggagagaaaccctacagatatgaagaatgtggcagtctttaaacaatcctcaaacctgaatgaacgtaagataactcatagtggagaggaatcctacaaatgtgaagaatgtggcaaaggctttaaacaatcctcaaacctgaatgaacataagataactcatagtggagaggaatcttacaaatgtgaagaatgtggcaaaggcttttactgttcctcaagccttactaagcataagatagttcatactgaagagaaaccatacaaatgtgaagaatgtggcaaagcttttaagtggtcctctgaacttactatacatcagagaattcatactgaagagaaaccctgtaaatgtgaagaatgtatcagagtctttaaacactcctcaaaaccgaatgaacataagagaaatcatactggagagaaaccctacaaatgtgaagcatgcggcaaagctttttaagcagtcttcaggccttactatacataagagaattcatactggagaggaatccagaaatgtgaagaatgttgcaaaaccttttactggtctttaagctttactaaacataagagagttcatattggagagataccctacaaatgtcaagaatgtggcaaaactttttcttgttcctcaagtttactcaacataagagagttcatactgaagagaaatcccacaaatgtaaagaatgtgggaaagcctttaaccagtccttaagccttactaaacttatgagaattcatactggaaaaaaatcatacaaattggaagactgtggcaaaatcttttaagtattgctcaaatatatccagccataattcatactaaagattatgcctatgaacctaaggaagtttggcaaagcttatgaatacacctcaaactttcctaagccttggagaaatatcagtgagaaacctcagaaaactgaacaatgtggcaagccctttaaatggttgtcacatcttactgtaggtaaaataattgatagtggagaaaatctctacaaacaaagaatgtgtcaaaacttctaacatgctcatactttatggcacataaaagcgtttatacttgaaaaattatacagagtgtggaaaagccatttctatctgctcacatcatagtcaacatcaggaagttcatacttaataaaattattataaatgtaattactgttcaaagaccttggaaaatataaacccttaaaataaaaaagagtattctggagacaaacattacaaatataaagagggttgtaatacctttacttgccctatataatgtacagattttacactagaagaaaactctaaaggaattactcaaacttgtttggcatcagagaatttatgttgaaggaaaccgtacaaatgtaataagtgtggaaaaacatttgttcagaaactacagcttacaaaacaccacacagtttataataaaaaatatttttgcagatggaatacatatgtaaaaatatttagtcaaaattaagtctttgtaaactttagaaaattcacggtagggagaactaaggcactggcacttaagacgttacactaaatcagaatgttctgtaaagaaagtaatccaaagctaaaactgttggataatttatttgtatataagtttaagaggagtggaaggttattttttggagagttaaaattacattcaaggtatacgtttttccttgaaaaaagtgtaagttttttgaaaagcaagtaggtaattcaactgtaaaattgcttcatgctgttccttttttcctgttgtttgtgtaaaagcatgtcatcaatttctgttgcatcagaaatctgagagattcctttcttattaggtaggcatcattcattaatttttccatggaagagtaaggatattaaaatgtaagatgataatgaaaatctgattggagaggctctttatggctgacttttaacattgttcatgtgatgcatgagttatgtgtttagagtaatattctgcattatagtgagaggaaaactttgagttttagtagtaaattgttttaccaattgtacttttatgtaataaaatgtagggaattttaaaattcttttataagactgtgataacttaacttttaaattaaacgaaatggttttaaactttttaagacgtgcatttagtaaagtgttatgtcaccaactttaacgtatcccactgtattaaagatgtagataaaagatggtaacatagtagaatgacctctctagcaatctcttttgcctgtggcattaaactgaaaagtttaacagtattgtttcaatgggtaaaatgtacatttgtttaactttttaaatttttgtaggaacataatattgtttacctatttatggcatatatagaatattttcatacaggcatacaatttgtaatcacatcagagtaaatgaggtattcattacctaatgcattttttttgtattacagacaatccatttaaacatttttagttatctaaaaatgtacaagtaaattattacttgctacagaggttttttatcgtcttgataataattacatagtagtataataaatctcacatttctaagtcctgaatgaatatttttaaaaatttgtcatatatattttgaacaagtggactctctgcctgtaaactcatgcagactgttagtttttacttacatgatgctaaatatacaaatatattactcttaagataaacattaggtgtaagaaaattgtggggcaagtaattgtgtgtgagagtacctattttcagaagacaagcaatattggaacaaaatatcactttaataaagtggacaaatcatttactagaaaaccagaaacctcagtgattttgaataatatctgtattctctgcattttatttaattaattactgtgaagtcttatggactgtgtttccgaatctttccatgcaaattctttctttcatttgcctggtactcatggtagactgattttttttttcatattttttgtgtttataatttattaagtattcattatgtgagttgctcagatattctaagaatttttataaaatttagtaatgcatgcaaaataatttttcaatgttatttcacaatgagtgtattaacttatatttcttttgttgctttcttttttcttttttttttttttgagatggtgtcttgctctgtcacccaggctagagtgcaatggtgggatctcagctcactacaccctccacctgctgggttcaagcaattctctagcctcagcctcctaagtagctgggactacaggcatgtgccaccatgcccagctaatgtttttgtatttttagtagagactgtgtttcactatactggccagagtggccttgaactcctgacctcgtggtccacacacctcatcctcccaaggtgctgggattacaggcgtgagccactgcatctgaccaacttatatttcatttagttagaacatcccattttgttattttaattggagaaacctgtgtaagctaagtttccttattgttccttttactctttataattgacataggtgaatttattcattcagccaatttgtttaagtaaatactggggaggcttcataagtcacaaagatattttgatatgtaaatgtagcaaacacaatgcttgctgtaatagaggcaccattattggccataaatatttctgctggagttagtttgtagctccaagtaaagataaagaaatatgcgtggtgaagaaataaaatcgattctgtatgtggagaggacgttgttcttatgctgcaaaactgactctttctgaatttaaagagacattcttcttattttctgattatctttagttttgtttttgtgtctacttatgtttatcccaactgtgtatgcatcacagcccttctttttcttctttgtgttatggctacatttttattgctgtttgttttgtgccatgtcatttcacacagtactttgtaggttctgatgagaagtttgtcaatgtaactttcagatccgttaattgagataaaaggcatccggtgttcacaggtgagaggaataaatcagtcagaatttcttgtctttgtaaaaccaaacttttattaaattttaacacagtctgtgtgtggtggctcacgcctgtaatcccagcactttgggaggctgaggtgggagaatcactaagtcaagagattgagaccttcctggccaatatggtgaaaccccatctctactaaaaatacaaaaattagctgggcatggtggcatgcacctgttgacctagccattcaggaggctgaggcaggagaatcgcttgaacccaggaggcagaggttgcagtgagctgagatcgcaccactgcattccagcctgatgacagagcgagacttcatctcaaaaaaaaacaaaattaacacaatgtgtggaaaatataaaattagttagaagatatgtcttagaaattaaacttttagaagagttaatggtaagtggagaatgttaaattttttattacatacttacagctcaacttaagttttcattcagaatcttttattttggtgtgaatgttaaatattcaaaaataatagaatgacacctgtggatttcacatgtgaagtaatctttttcatattaacattaaaatcttgaggaatttctcacacttgta

SEQ ID NO: 395 - DNA, 1597 bp, Homo sapiens
ccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggagagagttagaaaataaacgtttgcgggaagaggaaaaaagaagaaaagaagaaagatgcaaaaaaaaaaaaaaagagagagagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgctcccggtgcagtcgtaaaagccaggcccgtggaaggctcgctgaaggagccccaggagacgtcacacagcggcagtgataaagagcacagggatgtggagagatctcaagaacaagaatctgaatcacaaagacaccatgtggatgacggcaggaggcacagagctcaccacgagcctgaccggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcacttccgagcgcgagagtgtggcggaaacaggaggatctgcaaggcagaaggttcggggactggtcctgagaagagggaagaggcagagtgagtcactgcacgcacctggcctccatggacgagcgagggcatcccagaaacgtgtaaatgaccccgagtgtgactgggaaggagaacttattccttaccaggaaactggaagctaaaaatacagagggtgacatagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtca

SEQ ID NO: 396 - DNA, 2693 bp, Homo sapiens
ctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgccccaaagtgctgggattacaagcatgagccattgagcccggtcgaatgtggcaaagtttttaataagttatcaaatcatactggagagaagctctacaaacctaaaagacatgacagtgctcttgagaacaccttaaacttttctaaacataaaagaaatcatagtgtcaagaagccctagatgtgagtcatgtcacaaagcctttaaatggttgtcacacttgagtataagctaatttatcctagagaaaactatgaagaatgtggcaaaatatttaaccaatactcacaccttatcgcataggaaagcatttatacttgaaaaaaaatgtacacctatgaagaatgtggaaaagccattaatatctgctcacatcttaacatcacagagtttatacttaaaacaaatattaaaaatgcaattactgtgagaatatcttttagaaaatataaaccttagaatggtgaagagtatttcttttgatgacaaacattacaaatataaagacggttgtagtactatatttgtatcacagatcttattgtgcatattttgtgctagagaaaaaccctaaagttgctcaaactttgttcaatatcagggaatgtataatagagaaaaaaacctgcaaatgtaataaatttggaaaaaagtttataaactacagcttagaaaacagagtaagttttttttgtagatgcagtaaatatgaaaaatattcaatccaaaattaactctgtaaatgtcagagaattcacagtagaaatgataaggcactggcacttcagactacactaaatcagagtgttgagtaaaaaaaataatttcaatctaaaatttagataagttatttgcatataacttaaaaaagaggaggtgattttttggagaattataattacatttgaagtatactttttgtatacttcaaatatcaaaaaaattaacatcacaatattgaaaaaaattacagactctgaaaagcaaataaggatgtaattcaactctcaagttacttcatgctcttcattcctactttatttacatgtgaaagcatgcgatcaattgttgctgcatcagagatatgaaagattcttttttattagatgggcattatttatgacctttttcataaaagagaaaggatattaaaatataaaatgcatgataaaaatctaaatggagaggctttttgtggttaacttaaaatattgagtgatgtatgaggtaggtgttctgaggaatatatttttgtgcattatagtgagaaaaacattttaaaattttagttaaaattaaaattaaattagtgatgtattatattagttgtgcttttatgtaatgtagtacattcataaatttttagattatatgtaaacttaattttttaaacattttttgacatgttaagtctgttgtacattcaatgaagtgttattatgccactcgctttaacctatcccaccttactcaagggtgtaggtaagagatggcaacagtttactatttggtaagagtggaataacatctctagtaatctctttttttcagtggctttaacctgcaaataaattaaagaatattgttctcgtaggttacatttttatacttttaatcttatttaaacttctttttttttttgccttgacaaatttaaacttatttttcttaacttttatgggtacatagtgtgtagatatatttctgccatatatagcatattttgataccagcataaaatatgtaataatcacgtcagggtaaatgagggattcttcaccttcaacatttattccttgaattacaagcaatccaaatctacacttttagtcactttgaaatataaaactaaattgttatctttattatagcgtcatttttgtggtcataataaaaatcatataggaatgtaaataaaatctatacatatctgg

SEQ ID NO: 397 - DNA, 5259 bp, Homo sapiens
gattcctcaaggatctagaactagaaatactgtttgacccagccatcccattactgggtatattcccaatggattataaatcatgctactataaagacacatgctcaagtatgtttattgcagcactattcactatagcaaagacttggaagcaacccaaatgtccatcaatcatagactggtttaagaaaatgtggcacatatacaccatggaatactatgcagccatataaaaggatgagttcgtgtcctttgtagggacctctatgaagctggaaaccatcattctgagcagactatcacaaggacagaaaaccaaacaccgcatattctcactcataggtgggtattggaaaataagaacacttggagacaggttggggaacatcacacaacagggcctgtcgggtggggttggggggagtgatagcatttggataaatacctaatgtaaatgactagttaatgagtgcagcaaaccaacatggcacatgtatacctatgtaacaaacctgcacattgtgcacacgtaccctaaaatttaaagtataataaaaataaaataaaaaaaaagaaagtgggcttgataagattttgacttggtagaattttaactaccggctatacaattcttgacttaggaaattaaagccttaagtcttctgaaaagccctttaattcagttatttcattaattttgatagttttgcaccatcatctgctgagaaacctatcctagattgtaagaagtttgagagtgaagactgccttatacatctttttttttttttactttagcacatcttgcacaaagtattcattcattcaagaaatattaatcagctctatgcctggccctgggaatacagtggtaaatatgagacagctacagcttatggcttcatgggtgatatatttagtagacaacaggacaatattaaataagaaaaataacttaggctacaagaattccagagagatgtgagggcatctactttagtctgggagtcagccgtactctcctgtggagagaaggttagtggaaatttgaagcaattggtctggggaaatggttgcagaagactcacttcaggcagaaagaatgtgtgtgcttaggaacacatgagcaagagcctggagactgggaaaaactgaaaggatctcataatgtacaatgcaggaaagagaatggccaaaaatattctataagtttcctctaaactaacaagtattttaccctatcagtcatgaaacacttcttggatgcagctcatggcataagcagccctgtctgttctctccaagtccaggacagcttaggtctaacccagctgtgctggccacatacatctcagaccccctacttcatggaggacagatgttattgatcaccggccataacttcgaagccacctactgcatatttgcactgaagccattcttcccagtggctcttagccagtgactgggcacagcacagacactcagacagactcattcctgggatatgagagctcttctaatgagcagctttagctgaaagatccctcttcggccttgcagaagagcacagtagtctagactcttcctacacagccttccttcctttcccctcttctcacagggtgagacctgcgggcagttccatgattccttctgcctcctccagctcctccccatttttcttcacaggcatttcccccagtaaaatgctcacacatctaatcctgtcacagcatctgcttctcagaggacccaaactaacaattccagacaaccacgtatcttatcctgtagggggagatggcacagttacagatattttttttctgttagttaggcatagacatggaatcccaaagagtatttaatgaagttttttcttaaagtagaagaaataatcatgggctgagtggtagaggatttgtaatcaaagaaatagcaagagagaaagagagagaaaagaagaaataggtgaaggtgaaaggggggaaatgagagggaggctgtggttggggaggcaaacttcaaagaatgttgctggaagagggggaaggaaaaatataatgtgctcactaattctgttggaataacaatctcttattcttggaagacccagtcttctctttaagaaccaggttccatcactctaatggaagggtactcatataatcacaagtctaagacagacagagaaacttttagcaaaattacttatagaagacaggctatatatatcatacagatttgtaaattccaagagtctaactttgggagttcaaaatatctgattttttttttttgcaggtatttctttggaggccaagtcacatgggaacctctttgtccaccttccctctcagggcccaaatatccctctccaaagattcagaagcaaaatgggaggaagttgacaatgatgacaatctatgcctgacttcagccccaaggaaggtttgacctagagaggtgtgaagatgtcaaacctacactgtccaatatggtagccagtagcacatgtgactctttacattgacttttaaatggactacaattaaataaaatttaaaaatccatttcacgggcataccagccacatttcaagtatgtcgtagctgcatgtaactaatggctactataccggaaagcacacacagaaaatgtttcatcatcacataaaattctgttgaacaaatctgtgttgaataacaacacacttaggactgtgttcaatcctaagttgaacacaatccttaggatcttgctgaatggacagagctgcagtgggaaaggagaagagtgaggctctaggaaaatcctgccctctaaaaaatgaagggctcgttctatggttggcctccatgccatgaccaaagatcatggacaggttaaatcgattaggaaagcacttctcacatatctaacctgccctgccatgggttcaatttacgtagtacactggacaatgtagcttgaatcctaaattcaaatgtgttaaatattcttagtattccgtctgtatactaacaaagaaaaaaatgttaagtgactgtgccacgctctccttccagagcagtgtttcttaatttcagcactactgacattttgggccagataagtctttgctgtgggggcttgtcccacgcactgcaggatgtttggcagcacccctggcctccaccctctagatgctgggagcactctccacctccacccccattgtaacaactaaaaatgttgccagacgttacccagtgtacgctggagggaaaaatcactccagggtgagggccactgatctagaatatgatacatggcatctgtgatatgagaaaatgaccttgggcctggtcgtaaaagaatgtgccacctcctcacctgaaacacaaccaagcagtggcccgtgactgacttggcaaaataacactttgttcagaggaagctcataaaacagttttggccgggaggatgagctaacctcataataggtacttgagagaagccaccccgctaatgcatgctgtgtaccatgattaggattgacttaactagggtgaagaaatcatataatttgctgtgtctacagatatgtaagtaatccaaatgtgtgtttcttttttaagtatcaaaggataattctagaataaaattcatagtcacagtcatattaaaaaacgtccacattttcaaaagtctaactacatttttcactctcctctaaaaatggagacacaacactgtgttctaacctgaagatttgcatactcaattctaactcaaaactttatctgctgacatccgtgcttcataaataattcccatgtgataattatgtatcttgagcagaattaccaatgcatttgtcttgaatgcttaatatatttaatgggaaatgtctcgggaattttcagttctgtcactgccaagaggaggaagtattaaccattcagaataagatactcacattagattttgtgcattaagaaagtcacaactgaggctgtaggacttaaatagatgtttctccagagaaacaatagtcactactacactccctttcctcccttaaaaggctgtccattcctaaagggtagggactatatgttcttccagtacctctactagtgttctgtgcatattaggcatttaatacaatttttgtgcatgaacagacagactcagaacaaagcctctgagtatattgccatccagcttggatgaggatataagtctcttaatccccaacttatcttgttttctaacacaagcaatatatggggaattatgcttaagaggctgtgccactttgtatttaaaaacccaactctgttttttagactccttgttccttaagttggttatgtgttaggtgaccttgctagttccctaatttttccaagtttccattttctcaccaataaatcgagactaattaataatgacacattaatttgaggtctaaatgagaaaatctacacaaggcttttagcacactgcctgacacatagaaagtgttttctaaatgctagctattatttttatggcataattctgtcatagatccaaaaagacttttttatttttaaaaaatcatagtcgcatttttttaattattacttttcttctctttgaagtcaatcctctcaacacagcttgagaattgcaatgaatttggggatctgagaaacaatcttttctaaatatttgtatgttatttggaaacaattacagtggcaaaagagaacaagaggctaccttttagtatcaatctatctgtacacttaaaaaaaaaaaaaaaaagaaaaaagcagcccatgacaagtacatgctgatttttaagaagaggtgaggtaaaagtggtacagctttattaagtacaagaacttaacaatcccttttattaaacagaacttgaatttgtattacactgaatttatagatcaatttgaggaggattgatatgggtatgatatggagtcttgttatttaataatgtggtttctcacttaggattgtcttatatctttcaataattttagaattcttttttaaaagttcttgcatatcatttctcaggtttgctttaaacggctgtacagatttttgaatggggtattattaattgttcgaattggttaaagcaagaatgctattgtttttgtatattgatcctctatccaaaaaatgtactgaattctctaactactgctagtttgcagattttcctggatttgcaaagttaaaaatcatatgcaaata

SEQ ID NO: 398 - DNA, 2433 bp, Homo sapiens
aaagagtaaccagccacccgggcttgtaactcccgttctcgcactccagataaggcggagaccacttgaagtggctcttgtccccgccgagcccgtccttgcgccgccagctgtggcccaggccccggggcccctgattggggccgcggcggtgtaagtggggcctccacttgcgccggaggccgtggaaccactcggtctccagagtggcgttggccaggtggggtgcggaggaggacaggtcttggagcaggatgcggctctcctcgcgcgtggcctggaggaagacctgtggggccggtgcggacagcgaatcggtgctgaaggtgatggccgcccgggagatgctgggctcgccctccagaaggctccacaccagcgcctggtaccaatccaggtcgtcctgcaagttctgctcccgcgacttattgctctgcagcatcacgttgaggaagttggtggcgtgtgtcagtgtgtccagcgcccggtgcaaggaggggtgcgcgctggccagggctggccacttccccggcaggcccgccaactcgtagcggccggagcagttggctcgcttcagctggtgggagtccccggtgtagagcactattcctaggcctccaaggtgtctcctcaaagactggctgacccactttccagatggagccaacatcatcctctgtctcatccataaatcatgaacagaaggcccaggaaatgagaagcggagtccccactgggagagtagcagagcttccagcatgaggcccacaacgagatcacagaagcacagcagaattctccagaaagccagttgtgatcaatggcagcacagcctggtcccacaggaaatgttcctggattttaaaacacaaataaacagtaatgcagaaattagagaagatgtatcatttaccaaatttaatctggcacatttaataatacattatgataattatggcacctgaaagctagatataaatactcattcatttgcaattcattggcaataatagttatttctgagattccctcagaccaatgatggtaaagagaaaagataaagttaatgagcttctcctctgagagaaggaggtcacaggccactcttccggtcgtcattccctataaaggattaaaggtatgagctcagggaaggatgacttcccccagtactttcttgaagttcttttggaagaagaaatagttagataccctagagagtctgattttggtgttcatttagaagtcaaaggcatgaggtcagaccttggtctcataatagattagcagcaagagaaattattactgtgggttttgtttttgtatttatttatttatttagacatcaagaaactgtgaaactgagcagcccttcagtaggagctggtaggaaaggcagcttgatatgtaagcaatctagaaaaacagctgtactttcagtaattaataaaatttagtccaagtatttgcctaagacttttgctttttagtactcatactttttactactcattccaagtaaattaagaattgaagtcggaagggccagatcacagaatgtctcttaaatataggcaaatgattctagattttatacagtaattccttgatcactaataagtttgtctctaatattgacccaaaggtgaggaaaagagtagttctcagacaaaaaaatgcccaggaataggtgtcaacatagccgaatgacttgtgaattagtgaattcctacaagccaggacagagcttttgaaaattataataaagttattttcctctccagttttttggcattgtattacaatgtctaggaaggaagctaggtttccccaccctcacatatactcccttctatgaagaaggcagatataggacaaggaccaggacagtactggaccatagcactaaggggtaggcttttaggcattaagagtgcggaagataaaatttaaaaatcaatccatcttaatcaataaaacatcttacctctgcatagtatacctacctgaattccttttttggaatctttttccttatttaaacttgtcatttgagcagctgaagtaaaaatatgggccaggaccctcttcttagtgagaaaatcacttcctaccttcaccccaacaacatcgtcactaaaacaaatcaataaaaacagcctccaatcaaaggtcaaaggaaaccagagggagctaagggaaaatgcaccattaagtgggcagttcagcctggtcattctagctcttccttctaagagctttagttttaattcataaattatctcttcctggtttggtttggcttttgtgttttttttcttgccataaaagtgataaggcatgaaattccaagtttagggtgtgagcctgggggaaaaattgccaagaaaactatttggttgccttcaggctaggcttctaagtcttaggggc

SEQ ID NO: 399 - DNA, 1125 bp, Homo sapiens
ctcaagcgctcttgttgtcttcctgggcaggtggtgccaataggatgtactgacagatcagaagtggtcgtgagagaaggagcaagtagccagaagagtgaagtgtgcactggctgagatgtgggagcaggtgttgttggtttccccggagtaagttaccttgagtgagttaaggttaagatatcccaggggtgaggttgagcaggcagttgtgtatgtgaccctggggaaagtctagctgaagatacaaagatgggatgagatcaccaaggagtaagtgtctttagcaaagagaagagaccaaggactgaatctggatacctcaacatttggagtcagagcctgaaaaggatccctcaaaagtgcccaagaagcagcagaatgaggaaagacagcccagggagtgtggcacagctgctcctcaccacttcaggctcccctggagtccaatgcactggggcctcattcctgggtattataattgcctcctaagtggcctctggcttatgtctcctaccccagttgatgttcatcacatcagccagagtggctctgttaacacccaagccagttcctgcccatctgctgagaatcttcaagggctttcacctcactctgagtcgaagccaatatcttcacaatggcctggccctttgccaactgctgtggtttaaatgtttgtacccttcaaaacttaggttgaaatttgcttggcaacatggtggtggcaggaggtggaacctttgggatgtgatagggccaagggctctgccctcaggggtaggattaatgctgttacaaaagagcaagtttgactttcttttgcctctttgcccttctaccttccttcctgggaggatgcagcaagaaggccctcgccagatatcaaggccttaagcttggacttcccagcctccagaactgtgagtcaataaatttgtttattaaaaatcacccagtctcaagcagcacaggtggactaagacaccacctctctgaatttacctccagctactctggtgtttactgagtccagcaatacaaaacatgatcctccctcagggcattcacaaatgctgttctccctgcatggaatgctcatcccccaaaacatttgcacagctt

SEQ ID NO: 400 - DNA, 3609 bp, Homo sapiens
ggcaacgctgatgaaaggcaaattcctgagagaaaaatcacccagatttttcagtgccttctctagctttctagaagttgttatgagtggacctgactacctagagagagtaatacagaagctccgtgccgatcacagctacctcattaccatgttcctccaagatggccgcccctgaggagaatcatcaactgggctttacggaagagagaaatccaaacgaccatcagcaacaaatgaaagactgaagttgaaaggaaatccataatttttgaatgctggccgaggtctgtgacctctgactgaatggtttccaagctccgaattcctagttagcattttggtgtggatacagaagacgagattaacacagatcaagtaacatggaaataaaaaaggagacaatgctggatgatacaggggcagccaacaagaggagaaaacccaagcattggcaaatgcctcattatccaaagaacactgaggtgtggagcaaaactgtgttgaatgaactgtagatggaaattctctccttcccaccgaggagccgctgcaggttgcagactcccagaatgccacactgagaagaggagggctaaaattctagagcagaatccctggggcagcccctgctgaagaagggtgcatctgttgagaatctcatcaccgcccccaccccgcccagccttcaatttagaggaatttctagttcacgcagaatgaagacaagatcacataagtgaggacgacgccccatttacaagtgtgatttggaagactgaagtggaaaccttgggaaggggcctcagagtatgtcagctggggtcagacgggaacaggagtctggctcaacacacatttattgcactcctgtttcatgccaagaaatgtaccaaaatctgggactgtgtaacacagcaaaggaaaagactcatctccaggaagcccccttgtctaggaagagaaattgaatatcagcataaggtggtgaaaagctgtgaaggagatgagtgccaggagtccatggaggaaggattctagcctggacaggtgaggaatggctttctggaagaagcagatgccccagctgaactttaaaatgcccatgtgaaatgaactgtctgtatcttcaatcagcaaatggagtaggtggccactgtttaattctggaatggggaagtgtaaaggtgtggtgtgtgtgtttacccctacttagggattcaaaacagacagtaaagaacaaaagtctagccctttgagcattctccatgggacatttgaggtctagctggccccagagaaagagagacagaagcaaggtcatatccatttgagaaaatcaaagtgtctgctccaattgagtctggtgtccttattcctggaatagccatccctactgctctggtgctgatttacctccggcagttcagtgcttcctggaaggtaggctgggctttttaacaaagtgactccttacttgacatgttttacccaaacacagaggccactgcactatgtgcaagaaacaacaaaaaattaaatgagactcaatgccttccttagggatctaaaaccccagtaacacagataaacaggtaaacaaataatgtgatggtgtgattctatagcaacaggaatagagcactgcagggccaccgaaggaaaaggtgatgacctggcttggattcagtgataaaaaggggcttacctcctttctctgtttctgctaaaagccagtgattaccccctgcttttcccatgttgggcatagctgtaagtactttagacatagcggcacatttaatcatcatgcaacaataagaggaagctgaggcagacagaagtgcccaaagtcacatacttgaagccaggacttgaacctgggctatctggctcctgaatccatggctttcactaataatgacttaccctccaatgaggaacaagctccattctggcctttctttagcgaaggcaactgcctgagctcatggtctgatctggcttctgggaaagagaaagcaggggaaacgtctagagatggcatactgggagaagaaatttcttgctgtggaatcctgcccccatctccctccccaccatacacaatcccacgtgcatttacacctacacgccgtgtacacacgaacattttttctgctactcccatgggccccaactctgccttttcatcaaaatcacccagagttttaaataaaatgcagatgttgaggcttgttcctaaattataatcttgggcatctaaattttttgattaaaaaaaattgacatgcatgcttaaagtaaaaatttagacaatacagcaaagaatgtgtttgtacccctcccacctagcccttagttcttccgaaaggcaaatacttaaccgttccttgttatccttccagaaaacaatatatgcatatattcatcttttttttcttcttcctctgtaggtgattgtggtgaatagtcatgagaatctgggaactggctcctgctctgtctatcttggagatgcatcttttgtgagaagccagggcaagaatagggaggcttaggcaatgggaagtttctgagtagataaagcagatggcagagcaaagggacagagcctggcgagaggctactccctgtagcaacctgcctaagagtgagaggaaagcaaggcatggctatgagcacgtgtagtctcagctacttgggaagctgaggctgggggatcacttgagcccaggagttcaagaccagcctaggcaacatagtgagaccatgtctctttaaaaaaaaaaaaaaaaagaaaaagggagagagagaaaaaaaggtgacaattcccccaacacacataaagtacataagagttaacaaggacacagtggcagaaaatagtcagaactgagcaagcatcagtgaggaaatgttttcctgaggagacttgagaagtctcaaaaatgaaaagaaagagtatttggtgtagaaagaatggcatgagatgtgaaagctcattcatccatttattccaggtatatctttttcttcagtactttgggaggcaataggtgtaatagcaagaacattcaggttagtgggttagtgtgagtctgccatatgtatgagggttgaatacacattaggtgtggtgactgtcatatgggaggcactgcaaggtgaaggagacatgtcctcacatttggtctttgggaagcgaagcaggcagaaacccaagtgcaaagtggccatttgttttcctaatgctagataagtacctgatgtgttggaagggtggagtagaactagaaactcctggaagttcttttaagaacgaatgcaggacctcatcagcccgagtctttaaataagtcacacatttttggtcaccacattctggaagggggacaaaaagatctgtcacagacaaaatttggagatatttaaggctttgttgactttggcaaatgcttgattatagttctgtggtctgtttgttttctagagtctccatgaattgcaagggaaaacaagtggtacactggtatttctatttgataacctgttctctttggaattccggttagaaatcaaaggcttacttgagttttaatgctttcg

SEQ ID NO: 401 - DNA, 3294 bp, Homo sapiens
cgaaccgtgtctcgggagcgttagagatggagactaacgtcttccaagggagattgcgtctccactttcaccctggtactgagaggttgagcacaaaattgattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatcttcttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcgctcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgcccgttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgta

SEQ ID NO: 402 - DNA, 3272 bp, Homo sapiens
agagatggagactaacgtcttccaagggagattgcgtctccactttcaccctggtactgagaggttgagcacaaaattgattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatcttcttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcgctcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgcccgttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgta

SEQ ID NO: 403 - DNA, 2081 bp, Homo sapiens
agtccccaggagaggctggtgcaggaaggctcagacactgtgttctctgacataatttatgtaagttataatagggggagaggctcagtctgggttgttctggagtctcagcatcttgcactttattatgagaaattttgcaagcttattactttgtagtaataactatgttctggcagagaatggaaggggagatgtgataaacaaatgtatgaaatatatgctacagaattagggagagagaagggccaggatagaaggtaaaacaggaagagggaagaagactagaggtgaggatggggtggggagacctgatttagatacagaggttagggcatctgacttatagctagaggtctgattggagggagtgaatatgagtatttaggcagtagagccaggcgtggtggtgcacacctgcaatttcagtgcttttaggaggctgaggatcgctgggggccaggaggtcaaggctgcagtgagctgtgaatgaaccactgcactccatcctgggtgacagagcaataccttatctcttaaaaaaaaaaaaaaagcatgtttaggcagcaggtgcgaaggccctgaggtcagcatgctcttggtgtatttgcaggccgtgaggaaccttgaccacaaagcatggtgaggaatggggtggtgctggcacatgaggtgggaggagagggcaggggccatgtccagtaggatctgggtgcttgtggtgaggagtgtgatgtgaggtccttggcaaggttgggcagcagcagaagataatctaacactctgtcttttgcgtgtaaaataacatacagatacacatggaagggaaagatgggtcaggagctaccgtgatgtgtccaggtgagaggtgatggtggcctggaccaggtgtggaggtgggggtggagagacatggttggattctggatgttgacttgctgatacgtgggacctgggataccaaagagagagaaggaagagttgagaatgactgcaagacttttggcccgaataactggatggaggagaaataacagatgaggaagactgtgggaagagcagatttgggggctatgggcattttggggggcagcgggggactgaattggggaatttagagacaaggaaatgtggtcctgggacatcatcactgacagttgggtattgcagagggagaaagagtgactcagatatgtccctggatgtcagttacagacttgtatcagtttcctgttggtgctgtaacaagtcaccacaatcttagtggcttaaaacaatatagatttgttatctcacaactctggagaggcaggcatccaaaatgggactcactgggctaaagttaagctgttggcagggttgggctccttctgaaggctccagggagggtctgtggcctcagcttttctggcttctagacgctgcctgaattccttggctctccttccatctccaaggccagcaatgcaggtggagtgcttctcactcagacttggaccatcttgcctcccctctccattgtaaagatctcgtgatcacagtgggcccacctggatagtccaggattctctccccatctcaggatctttatcttaaccacatctacaaagtctctttgccacgtaaggtgacacattcagggggtctggggatcaggaagtgaacatctttggggacattattctgtctaccacacagataaacctgtttcttcatgctgctccctaggatgaggtaggagtgcagctgtgcggtctcctattcatctcagacctctaaagcaccttagggaggaagatctcactgcagtaggctgataacccagtgtaacaaaaacctgtttaattacagaataacactgtctttagtagagaacaaaagggacattattgaaaaatcccttgactaacctgtaccttttggagctacacatcatgaggctttttacaaaatgcctcataaaattacctatgaattaaattgagatctatctgggagaaggctgtaaatttccctcaaacaagcagctatctctttcagctgaaacttgtctttctaggttgccccagtccccaccactc

SEQ ID NO: 404 - DNA, 5436 bp, Homo sapiens
caggagacaaacctcggaagggctgcccctcagagacatcaagtggaatatgaatactgatttctaaccccacttccaactcctgagtgctttacgctgggctacaaggttctcaatgtctcagtgcctcagcgttctgatttatcttatggaagcctgcctcatctattcatatattgcattcttaaacacagaataacaacaacagcaatgacaacaatgctaatagcgctccaacagagcttgctgtgtgcccagccctgttcgaagtgctccccaactttggcccctaggatgctcaggacggccctctgagcaggcactgatgtcgtccccctcacatgcagagaaaccaagacatgagcgtggtcaggtcgttcgtgcagagccaccgggctggggatgggcagagctggagtgtgtgggcacaggatcggggtttgtcaccactgtgctgcactgcctctgcaccccaactaggcctcacgctgatggagacatcgcagtgcatgggagaacattcactgcgtggtgctgaggacgcagcaggcactcggtacaacctgttccttgcgtggcccgctagctttgggtcccaaaataatctgcctcctgaatctgcaactttctccccacctgctgggcattctcttaattcaaccgaagcctctccctgtccccattaggacggccactcccaacaggagttcccggcctgtgaaggccaaccggtcggggctcagcaccccattatcattctgccactttccaaaggaaattataagcactttgtgtcaaccctcatctgtcccggcagccgcaccgcaggaaagcgattgaggtcagagaaggcagacagcctacccatcacacccgccgcggccattcctcatgtagtgacatgcaatctcccgccaagggtcacctctggggaagcgattccttcaagcctagaacaagtgccgaattgcagctttgccgaatgatcatgtggaacacattgaaaatagccgcctcagtaataaatgcttaaccaaagcagccccttcctccggcataaccaggagcatatttactgtaaatatgttaaccaattcatgctgcagcacatggccgaggagtcagcttcccaggcagcaaagagcaaacccccgctgggctgagaaggagcaagccgcaaaggagaggattgtgtccgccaggaaaaggaagaggcaggaaaaggcacctgggacagaggagcctcctgcaggccccacagccccacccgacagaggagtggcgagaaggggacttggcattctgcatcttgccgtcacctctgtgccccacggaatctgtgagttaagactggctccaagagaagtggcgtttgtgtttctccttcatttcctgctcacatggtgaagtccgtagtgtgacagctctgaactccacaggatgaatcagggtcaggggagaggacaggaggaaagaaggagcgagagaaaggggagagagagagaggagacgggagagtgatggcgagagacagaaatatgaatgagaaacgggaaaaaaatcgagaagatgatgagaagcctgaaagacagagaaagcaatctaagatgagaaaaagagcactgagaaagaaaacattctggaggagagagaaggaggggcagagaggggaacaaggagggggtggagagagggagattgagagggcatgagttgtctctggaaggctgggttttgtttccactgggaagaaaaaatgttctttgttatcaaaagccttgagtgacaccagcagctcctccccacccctctctaacacactagcacctaggctggtgtacacatacacatgcatactcaagtgtgcacacacacacactaacatgcacatatttgtacacacacaaacatatgcatgcacacacatatgcacattcatgtgcacgcatgcatactcgtgcacatacacactaacatgcacacatactcaaggtacacatatattcacatgcaccacacatacacacatgcatgtgcatgcacatacaagcacacacacgcatatgcgcacacctactcaaggcacacacatacacgcacacattcacacattcatacatgcacactcatgtgtacacacacatgcataggcacacacacatacattcacacacacgtatgtgcacacacatactcacatgcacacattcacatgcacacactcgtgcacatacactcacgtgccctcatacatgcacatatatgcacacatgcatgcacacatacatcacatccaggcacacagccatctagaggcacacatacactcttacagcacacagtcaattccctccccctacccctgaacctaattcagtcccagaacagagagagcaatacaaggtctgagccaaaggaaacagaccaaagccagactgggtctgggtgtgggggaggaggaggaaaggggtcgggaggaggcagcccaggtcaggggcccagagtggaccagcaatgcaattggaatgggaaagaaccgtagagccccctgagaggctgcagcccctcaggcctggccctcaggcctgggcctcccttcatcccagtttcaggctgcattcttaatcgggccacggccccggctacctagagagacagtcacacactggcttcaagaccagagaaaccccagcaaagggcagccagcttctgggcaaagagtgaagccaccggctccctccggcttgcagcttctcctttctgaagtgggtgggcagtttccggccaaccttttgcctccttctctccagccgcccctgctaactcccagtaatttgccaaaattaacagatttatggcagcatgttggtttggatcaacttttcgtatgtactttgcaagagaaaaacattttcttctcccccgacttactgtttgcccattaatacgctccacattcactggtgcttaatgactgttcaaattttctctgttcatagagaatgttgttgttgtgattaagggtgccagggtgcttgcaagtacaaacacaccaaagccatgaaaagggcaattaattctttaaaaaaatgcaagagagtgggagagattggatgctctgtttacagaaaagcaagaaagaaaacagatatttctaagaagtgtccttccaggacagcaacgtctcctgtaaaaatgtctcctggaaaaaatgttgaaatacaaatgttcatggaaactgctgtccagcagacatttggttattcaacaaccatgtgtcaactactcattatgggcctggttctggggtaattcataaaggaagccacagggtgtgggcgaagtggacatctgggccaggactgaaatcccagctcaagataagtcatcccttgcctctgagcctcagtttacccatctgaaaattaggaggtggaaatcccaagggtggctatcaaaattcaagaggacatgtgtatcaagggcttagcttgctgctagcacatagtaagtgtacaagaactgcctggttcattattcgttcactctcctgaacaaatcagtggccgttttaatggctttggtgtgtttggacttgcaagcaccctggcacccttaatcacagcaacagcactctctagcaccagagtacgttctctgggccatgggccatgccatggggctggattttgaagttacaacttcaagaaaggcaagtttctgcccatgtatggctgatgatccaacggtgggagacagaaactactaaacatctgcaatggcaacgtgtccaacagtgataaatgcctgaagggaaataaaacaaagtaagatacaaagcagggccaaagtagataaggccctgctgagctgtgttggatgatgtcatcaggggcctggggaggccagcaaggtgacttgtgcagacacccgagtcgggtgtcgatatcttcctccataccttttatctttcctaaaaatatggttgggaagccctggtccatctgcaaaggacaggggcaagttggcctatgcgctagcaattgctacatattgtgagagctcttaaaccaaaggtcaggacacacccagtgaatgtttcccttccagataagaaaaatattctgagcacctgctatgcgccaagcgttgtgctatgtagtgggggcacaactgcagggaaaccagacatggtccctccctgcctcctggcatttagagccaagacagagggtcagattataaatgaacacaggcaccatgattatttcatctcaaactctggttggtgctatgggaaaggagcagtgatctttgagacctgagagggggtcctgatggagcagacaccagcagaaggatccttccgggaagtgacgttgaagctaagcttgaaaagaaagaagccagtggacatcttctggtgagacccagagcaccccacctgcaaggggcctgatctcccttgaaccaagagccctgccactcgccccagctgcctaaaggctgacaggagaagagggagtcagaatggtgctccaaacagagctcactggaatctcagctcagccatttacttgctctgtcaacttgggctctcgctgcaggtacctgagactgttttctcgcctgtaaaattggaaggtgttatgggttgaattgcttcccccaaaaatatgttgaggtcttaaccccttgaaatgtgacctgagttggaaatgggatctttgcagatgtcattagtgaagacgaagtcacactggagtaggctgggccctaaatcaaatggctgttagttttataagaagagggaaatttggacacagacacacacaaagaggaacaaccagcgtgtgaagacagaggcagagattggaatgaggcagccacaagccaatgaaccgctgcagctcccagaggccagaagaggcaagggaatatcctcccctagaggctgcagagggagcacagccctgccagtgccttgattcgagacttcgagacttccagcctccagaactgggaaagaataaatatctgctgttttaagcactttggtttgtggtgctttgtcactggcagccctgggagtagtccagaattataacccctaccttccccgaggactgcttgtccagagggttccccagggtcccattcttaacagatcctccttgaatgccctgcagccaccgctgatgtgctggaagtcacttctgctggctttgatgaagggaaggaagcagatgagaaagagggtgtatatgagtgactcattgaacctattgtctatccatagagagaggggacgagagagtgccttgtccccaagacctgggcccacagtggccccttaagtaagttcaggccctctcacctgggcaggggtcagaagcctagagcaacagcaaccactgaaagccctcagcactccac

SEQ ID NO: 405 - DNA, 2720 bp, Homo sapiens
gctgtggaagctttgtccttgcagtcttcacagtaaaccttgctaccactcactctttgggtctgtgccatctttaagagctgtaacactcactgcgaaggtccacagctttattcttgaagtcagcgagaccatgaacccaccggcaggaactgactctggacacaatggcggctcctgaccagaccctcagaacctgaggacgggtgatcatttctggtccagtgtcttgactggcaccaagtcaagcattgtcctccacgtcatcagctgcaggccagataatctaagatgatgccaaacagtcactgcagaagaatttgctgcacggagctgtctgggatgcctcagacctgccagcggtagagctgcctgccttgcttcctcttgcttactcacagctctaagtctgaacttggctgcagctgtcctgaacagcccaggaggagcctaggcaggaggaggcttctctcctatgcaatttggctgaattttagttactcaaaagagcaaaggaagcacttctgaatattcgtcaggaggagccaaccaccttagcttgctccctgatgggttttgttcagcccctgccttactgttgtcagcctggactgtcttctgggcttgggttcaccatgtgtctggaccacgggagtgtctctaggtgtctcccttcctgtgcatttctcctgggcatagacacccatcctgtggaacactgggaggagggtgcaagaccccactgcacccaggcttggttcctcttgggtgcagcagcctcatccccttgcaagccttcctcccactcctcccagaaggctctgcttcctccacttgctcctctcctaggtgtgagccagcagggtttggtcacccagatatgaagtattaatgttggactcctgtctggagtcgggagtctattaaggaagacgtgtgggagaggcctgtgttcaaggcccttagaaccattctgcctgagccatcagctccttaaaaagaaatcaccaaagatcccaaacaatggcagagtccccctcccaccctttgggctacttggtaaataggcccaccaattctatctccaaaatatctcccatcaggaccatgtgtatattgacatctttatcttccatcaggtcagggttgccacaaaagcctccatccaaatttcctgaaaaagcccagtttctctaaatgtgtgcatgaacacggtgctgggcatggccctctcctctcagtccttctgcaacgcccagtgccttcacagccaaggccagacttcctagtggaagagcaaagtccctcctgacacggcttctgcttgcatctgcagccccacttcccccacaccacgctgcaccctgagctcctcacggagagccaccgtgtttcacacctgccgtgctctgggccaggtcgctgggcttgctggtccttagacttggagcacctgatgctgtttgcccatctgtgtccttgtcagcctttgagaattggatctggcagcccctcctcaggaagcccatgagagcctccgccccatactcacacagaccctgagctaggtggcccctgcctgtgtccctcagctcccagcccagcttccatgcagctttagcacagtttaccagcaccatcaagacccctctgggaggacagagagctctgggaggacagagagctctgaaggacagaacacgcatgcctttctggttgttcctctgaagcctagcacaacactgacacgtgagaaatactggctgaataaaaggtggaagtgaaaaagaacaacactgacacgtgagaaatactggctgaataaaaggcactgtgcattccctgcccatgaggaaggaagcagcttattccattttcaccccagcagaacccctgcatgcaggtttaggtcaacactagctgccagcaggatggagacccagcagcatgcggcacacgggagtctcgccgcgggtccttgacagaagagtaacgagacttttcttgaaatagtgtcctgagttgagatctgagaagaacctgttatgcatcctagaacacagtgcatttgcaagtcataagatgttagcaccgattatggagcctcgtgtgttcttaggggctatttccgtgacctcgtcgggggttcaatgagcagcttcaacagaaaactggatttccttttcctccaaggctgtcttatttccagattactctggacctaattttaatcgtgcacacctaccatggcaggctgttttcctgtcctcccaatgatctccatacaatctcactgctgggtagcacctccattcccttgcttacctaagccatcaaaacctgcaacaactcacaaaaccacaaaaagcaacagaaaatatcagaagataatcaaatgaatcaagacctccagaaaactgtgcataattcagttttcatttcatttaatgataatgtccacagttaatcaggcattccttatcatttggatctacatgttgaataaacacaacatccctagacctttgagggttttctaaataatctgctgttgattttcttaggtactgaccagattactatgaatattcctgatagaatatgctgacaagaaacaaacaggacaagcctaaaatagaggttctggtaaacattcagggaaaagtttattactgacatgtgagagctcggttttcaaggttaataaaataaagttgaca

SEQ ID NO: 406 - DNA, 2791 bp, Homo sapiens
aagcttctccgcgagtccagcgctgccactcggcggccgccgcgggcgcggggatcctgggtcgctccgccttgacccacgcgccccacgccccgggacttacacctggggtcgctccccgcacgcgcgggcctcgcgccggtgccgccgcagcgccccctgcaggccggagccgagctggcccaggcctgagtctggcccggggttccgtggccccagtgccggccccgcggctgctgctccggcccggccaggtgccttcgtgttgaggcgaaaggactgggcctcagtgggtgaagggaccgggtggcccgcttccacctagggcagaggctggatcggccgcggcgaggctgggcccagcattactgggaggggaacttgagagccgcgggttgatgttcggagctcaggcgacgactgaccacccacccttcctcgaagaggaacaatggcttgggtttggtttttaatttttgattcccccacctcccctttcttgattccaaaggaaatatagcattcaagcgccatgtctgttgggaatatataattccttggcaaagaaagaggaaacatttctctgataaacacaagaatctcagtaagaattgcattattgagaacttttcccactgataaagtagggaagaggaaggggaaaatagggtaagggaatgctggaagacaaactttaaactttatctccttttttttttttttttttgtcgattgttggtgcatcctgttggtgttccgagaagttgtggctcagcttgctttgtctacattagtggaatctttaagtctttctggtctgtctcagcatactcactggcaggccctagactacattacccaagtcattttgccgtcttggaatcctgagtatgtcatcactctgtattggagatgagattgctcagaaacactgaattcagaatgggatctagcaagatggtatttctggagcaataagtcatttactgaatgattatgcaaagcataaattgcattgtagtcctagaataatacaaagcttccctttagttgttgccgtaaattaataactggcattttaatgcactaaatgaattttagtagttagatttatatctttgacttctaggaatttcaactacattagagttcatatacacaaaaggggcaagcccttttccacagcatttccagcttctccacagaaacctagccccacatgagcaaaagatcacactctgtgcttcatcaaagagattacacaattacagattccagcatctcccaggagtcctttgaatttggattaaggtctataattacgtgggtaagggaataactaggtaattggctttctgcacctggaatgtattctcctgggtataagaggctccttttaatcagaagtatatgggatgaaagtgaaccctgtctcttaaggggagactccttaagaggaggattggggccctgtgttttaatagatcttctccacaatctttaatacctaagctccttccccttgtccactaatttgctgtagaatttttctagcatgtttatgatggtgttcagggcacactaccccaaaatataacaccttggcatattgaatgttttaagctgatggaatttgagaaatggcaggtgtgaggactctgaccttcccatgaagcaggtcataagaccctcatgtgagagatgccctctctatacctggagaaaagaagcagtcttatttgtgaagacagagagacgccaagaggaatctaaatgaataggccttggaaccccagacgcacgggccttgtgctgtcgctgccgtggcaccccttctagaagtgtcatccccaacttaggactctattctctataacagaagtgggagccttggacaactgaacgcctatctctagctcaagaaatgtcagctctttttttttttttgagactgtcacccagtcgggagtacagtggcgccatcttggctctctgtaacctccacctcctgggttcaagcgattctcctgcctcagcctcctgagtagctggggctacaggtatgcaccatcactcctggctaattgttgtatttttagtagataatggggtttcaccatgttggccagggtggtctcaaactcctgacctcaggtgatctgcctgcctcggcctcccaaagtgctgggattacagacgtgagccaccatgcccagccaagaaatgtcaattctttatcgtagcctggctttccatatttctcactagggtttttattctctagtttgtaaatcacatttggcgtttgtagatcactccttcccttttagtggcattctctattaggtgtccatctcccaatatgaagaaacagttttctgctttttcctcctttatctgatccatttacagatttattacatttataataggctaggtattggggatacaaaaatgaataagatatggtctgttttcaaaggtatgcagaaacttttctatatattcctactgacttgtatttgtatttcttgaattaaaaacaatcctggctgtgtttttttttttttttttttgctcttagtgaatctttgtttcttcttttcattatggcattccagttgagtttcaccacgcattatcatgagaataaataatttcactgactttaataatatttgatcacttatgttgatgtcatttaactctcatttacatttcagtggtctaaaacacaactaagatactaaaagaaaaataaaagatgagattattggcaaataattaccac

SEQ ID NO: 407 - DNA, 14713 bp, Homo sapiens
ctcctggatctgcgggtcggtctcggcgggcggattactcctcgcccacaacctcgaggccccggggtcaaccgcgccctccgggccggcaacccagggtttagtcagattcctcctgacccaccgcttctgggaaagaggcgcctcccgtcaggaggatgctgagttcctcatgactggaccagtgagtgtccactccctggtccctggcgagagaggcgggacccccacgccctcctggcgctctttgcagagatgttcctcaggcccaatccgggatttgggatgtctgtgcgtgctgtggagcagagagtttgcaacatggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcaccgctgcactccagcctgggcaaaattgaagactctgtctccaaaaaaaaaaaaaaggagttcctctgcataagctctctctctttgcctgctgccatccatgtaagatgtgacttgctcttccttgccctatgattgtgagtctttccccagccacgtggaactgtaagtccaaataaacctctttcttttgtaaattgcccagtcttgggtatgtctatcagcagcatggaaatggactaatacagtaaattggtaccagtagagtggggtgttgctgaaaagatacctgaaaatgtgaaagtgactttggaactgggtagcaggcaaacattggaacagtttggagggctcagaagaagacaggaaaatgtaggaaagtttggaacttcctagagacttgttgaatggcattgacaaaaatgctaatagtgatacgaacaataagatccagtctgaggtggtctcagatggagatgaggaacttgttgggaactggagcaaaggtgactcttgttatgttttagcaaagagactggtgacattttgcccctgcccgagagatttgtggaactttgaacttgagggagatgatttagggtatctggtggaagacatttctttttttttttttgtgacggagtcttgcattgtcgcctggggtggagtgcaatggtctgatctcagcttactgggttcaagcaattctgtctcagcctcccgagtagctgggattacaggcgtccgccaccacgcccttctaattttttgtatttttagtagagacggtttcactatgttggccagtggaagacatttctaagcagcaaagcattcaagaggtggcttgggtgttgttaaaggcattctgttttgactgggtgcggtggtgcacacctataatcccagcactttgggaggccgaggagggtggatcaagaggtcaggagttcaagaccagcctggccaatatggtgaaaccctgtctctactggaaatacaaaaattagcttggcatggtggtgtgcgcctgtagtcccagcttctcgggaggctgaggcaggagaatcgcctggacccgggaggtggaggttccattgagccaagatcatgccactgactccagcctgggcaacagactgagactctgtctcaaaaaaaaagaaaaaaaaaaaggcattcagttttataagggaagcagagcataaaagtttgggaaatttgcagcctgacaatgtgatagtaaagaaaatcccattttctgagaggaaattcaagctggctgcaaaaatttgcataagtaccaaggagccgaatgttaatatccaagacaatggggaaaatatctcccagacatgtcagaggtcttcatggcagcccctcccatcaacaggtccagaggcctaggaggaaaaagtggttttgtgggcagcacccagggtccccatgctatgtgcagcctagggacttggtgccgtgcgtctcagctcctccagtggtgactgaaaggggccaacatagagctcgggctgctgcttcatggggtggaagtcccaaatcttggcagcttccatgtggtgttgagcctgcgagtacatagaagtcaagaattggggtttgggaacctccatctagatttcagaagatatatggaaattcctggatgcccaggcagaagtttgctgtaggggtggggccttcatggagaacctctgctagagcagtgcagaagggaaatgtggggtcggagcccccacacagagtccccgctgcggccctgcctgatggagctgtgagaagtggaccaccgttctccagaccccagaatggtagatccaccgacagcttgcaccgtgtgcctggaaaagctgcagacactcaatgccagcctatgaaagcagcctggagggaggctttaccctgcaaagccacagaagtggagctgcccaagaccatgggaatccacctcttgcatcagtgtgacctggatgtgagacatggagtcaaaggatatcattttgaagctttaagatttgactgccctgctggatttcagacttgcatgggtcctgtagcccctttgttttggccaatttctcccatttggaatggctatatttacccaatgcttataccaccattctatctaggaagtaaataacttgcttttgattttacaggctcataggcagaagggatttgccttgtctcagatgagactttggactgcggacttttgagttaatgctgaaatgagttaagacttcggaggactattgggaaggcatgattggttttgaaatgtgaggacatgagatttgggaggggccaggggtggaaggatacggttgggttctgtgtccccacccaagtcttatcttgtagctcccataacccatgtgtcttgggagggacctggtaattcaatcatgtgggctggatgcggttgctcatgcctgtaatcccagcactttgggaggccaagggggagatcacttgcgatcaggagtttgagaccagcctggccaacatggtgaaaccccatctatactaaaaatacaaaaattagccaggcacggtggtgggcacctgtaatcccagctacttgggaggctgaggcatgagaatcacttgaacctggaggcggaggttgcagtgagccgagatcgcaccactgcactccagcctgggcgtcaaagtgaaacttagtcttaaaaaaaaaaaaaaaaagaagaatgggagtgggtctttcctgtgctgtcctcatgatagagaataagtcttacaagatctgatggttttaaaaatgagagttatttctctcttctcttgtctgccaccatgtgagtcatgcctttcaccttccaccatgattgtgaggcctccccagccacgtggaactgtaagtccaataaacctctttctttttttttttttttttttttttttttgagacggagtctcactctgttgcccaggctggagtgcagtggcgcgatctcggctcactgcaagctccgcctcccaggttcacgccattctcctgcctcagcctcccgtgtagcaggcattgtcacaggcgcctgccaccacacccacctaatttttttgtatttttagtagagacggggtttcaccgtgttagccagggtggtatcgatctcctgaccttgtgatccgcccaccttgggctcccaaagtgttgagattacaggcgtaagccactgcacccggcaataaacctctttcttttgtaaattgcccaggtatgtctttatcagcagcatgaaaatggactcatacaatgatccattacctagggtaaaattctcctgaatgtcaaacagagataaactacatttgggttttgggtaagtcccctgtaatgatgaatcaagaatcctcaagtctgtcttgccacccatttaatacgtatttttgttaaggctgaagtttagagttagaatcaggacattttggcctattgagaggttctgaattccaacagaagatgccatgtaaatcagtgaatttgattcttttaaaagcaacttacaaaatttacaagatgtattcaataaagcagtttagctttggtatatcaaaccttataatgaaccatttttcccacttcatcttatgcaatgtttaatattttctatttttgtcaaggatattaaacctacacctggaaacatattaaatgccaacttaaaatgtgagaagtttggcagaactcagacccattcttccaatttccaagctgtttaatcacactgattcagacactctggatagcagctgggattgtagttatctttatgctttgagctctctagttttgtctacacatcttataaaatatcccctcctcattctcctctagctggaacactaacccaatggatgttgtggtgaactttctttgaccaggcagagaagtgcagcattgggtggaccatgcacaaccagtttgagaagcactgctctaggggttgggggagcaacaatagaaagagtgtaggttctgaatacctgaagcatacattttagctctagactgcttatattgttgttacatgaaagagaacttttaatctggtttaaaccactggatctctttattccagcaagtgaatctatatccaactaatatttactcccagtctgttctttctcacccctctttcccttactataaaccttttctatatcaatttatatcattagttgctcagcccacaaaccagatgtcacttttgttttctcttttccttcccattcatagccaggccatcgttgtgacttattggctgtacctccaaaatatatcccagatctgatctcttcttataatttgtactgctacaaccttagtcaaagccactaatatctcttatctgaactccagtggtttactagttttctgcctctcttcttgacacaattcatctttctacatagcagccagagtaagataaaatcataaatcagatcatataacttctaccccctgtaccaatggctatcttttatactcagaataaaatccaaaacctttatttggcttccaagatcctacaagatagagaccttacttctcatcttgtacccatcatttgatcttcagtcccttgaaaatgccaagtctatttccatttcagggcctttgtgcttgttactattgtttcttttctcttggaaaactgcccagatctttccttagctgaattattcagatcccaactcaaatatcatctctttagaaaattctttcagaaccaggtgtggtggtgcacacctgtaatctcagctactcgagtggctgaggctgatggatttcttgagcccagaagtctgaggccagcctgggcaatatagcaagatcctgtcaaaaagaaaaaggtatctcaccatgattatattttaatttcccttcagcaattagaagtccctgaaattaatttaccttatttgttggcatttgttggcattgtgcaagtaatgcttgcacccaggaggcagagtttgcagtgagctgagatcacgccactgcactctagcttgggcaatagggcgagactgagtctcaaaataaataaataaatacataaaataattttagagacagagtcttgctctgttgcccaggctggagtgaagtggtgggatctcggcttactgcaacctctgcctcctgggttcaagcgattctcctgcctcagcctcctgagtagctgggattacaggcgtgcaccaccacgcctggctaaattttgtatttttagtagagatggggttttgccgtgttggtcaggctggtctcgaactcctgacctctgatctgcccacctcggccttccagagtgctgggattacaggcatgagccaccatgggcccacaaagctattttacttagcattttttttcccgaggctaaattgggaactactgacaatactattgacaatactaaatatatttttaaattattttacttatttttgagacagggtctcactgtgtcacccacgctgtagtgcagtgaaccatcaccactcactgcagtctcacccttcctgaactcaggtgatcctcccacctcagcctcctgagtagctgggactacaggcatgcaccaccatgcctggctaatttttaaaattttttgtagagatggagtttcgccatgttgcccaggctggtctcaaacttctgggttcaagtgatgcaagtgtctcagcctcctaaagtgctaggattacaggcgtaagccactatgcccagccttttattttattttattttatttatttattttttgagacagagtcttgttctgttgcccaggctagagtgcagtggtgcaatctcagctcactgcaacctctgcctcccaggttcaagcgattatcatgtctcagcctccctagtagctgggattacaagtgtgcaccacacgcggctaatttttgtattttttgtagaggcagagaggcagggttttattatgttggccaagctggtcttgaactcctggcctcaagtgatctgctcaccccggcctcccaaagtgctgagattacaggtgtgagccaccatgcccaccaacctattttttattttaaaaaattgacagcatactaaatgtttgtaatgcaaatgataaaattgctacaatgaaaacaagaagttgagaattagatgaagagttgattaagggaactatgagtcactgtgttagagcatgtatattatgaaaattatagcagaagtgataaagggtgacaattgttacctatcttcaatcaaaagctctttgaatatctttcttttttttaattttatgaattttttttacagagacagggtctcactatattgcccaggttggtctcgaactcctgggctcaagggatcctcttgccttggcctcacaaagtacctggattacaggcatgagccacagtgcctggccctctttgaatatctttaatgcttttagagattagcatcagagaattattaatactagagggcacaaggaattagccattgccagtggacacctacataggtgtgactatgtgactcagttttaaaaatgtgacacaatgaaaaaattccttggatgttatggaggacgaaaattttgtaagtcctatccattctttaatggagaaactaaaatttacaatattactttatttagcccaagattttcttaagctttgtattttctaattcagctttggcttacagaatcatgcttgaagtttgagactgccagctttcaacaggcagttactagtgaaactctttggaaagatgagaagatgttgacataagtgtaatgtgagacaaagcaaagtaaaatgtaatttttaagaaaatgttgccgggtgtgatggtggctcatgttgctgttggttgctatgggagtgaacgaagggggacgaatgcagaaatgaagacaaagacaaaaagagtatttttggaagaaggggtcaggggactccttgcttctagtgggcaagggccctgagcttctacagcccttcatatttattaggtagaaagagcagggagggagaggtaacagttggtcagctgcttgatttatcacaggtacacataattgcttcctttgtacaacaggtatacataattgctttctttgtacaacaggcttcagatgttcctatagataatcacaaggaacactgtgcttggggtgtgactgccctcagcaacccttctggcagcagacacagttgttagttttccaacatcctgctttcatgagaacagttttctatttgctcatatagcctccagtggtatactgagttggtcacgaccctcattctttcggcctgtaacaggctcatgcctgtaatgccagcacttttggaggccgaggcaagaggatagcttgagctcaggagttggagaccagcctgggcaacacggtgaaaccccatctctgcaaaaattagcctggtgtggtggggtgcgcctgtagtctcagctgcttgtggggctgaggcgggagaatagcttgagctccaggggtcgaggctgcagtgagccataatggtgctgctgcattccagcctgggtgacaaagtgagactatctcaaaaaaaaaaacggctgttagataaaaatgaagacaaacaacatttgcaaggatataaatcttaacccatttattgggggtataggctctggtgtcagatttccatctgtcctgtattttgtaaccacaaaattgtcctggctggattaattgtaaggaagtccctttaaacacatctagacttccaaagtttgtttacatactaattagttgtcatgaaaagctgcattcaacccagggtctgagatgccttttgtatatgaaaagtgcttctctttctgacactgactgaattacatacataacagattcatttatttaaaaacaatttaagaggctttttctataatgctgaacctgctgtgtggtatttatgtttaattctggtcaaattttcaaaactaataaacactgcaattcaaaaccattaattatcaagcatagaccaagtatctgaggttatgagcacatatttaagaggttagactctggcattccagacattgcaaataatacttttctcatttctaaatttcctagaaacaagtggagatttgtaaaaggaaataatactctttaaaacatttatttttgactcaggatctggctctgttgccctagctagagtgcagtggtgccatcatcacagctcacacaatagcctggaactactgggctcaaaccatcctcccacctcagcctcccaagtagctgggactgcagatgcaggccatcatgtcccgctaagttttattttatttttgtagagacagagtctatgttgctcaggctggtcctgaactcccggcatcaagtgatcctcccacctcccaataaaacatgtactgatggccaggcacttggctcacgcctgtaatcccagcactttgggaggccgaggcgggcagatcatgaggtcaagagatcaagaccattctggccaacatggtgaaaccctgtctctactaaaaatacaaaaattagccaggtgtggtggcacgcgccggtagtctcagctactccggaggccgaggcaggataattgcttgaaccccagaggcggaggttgcagtgagccgagatcgtgccactgcactccagcctggcgacagagcaagactctgtctcaaaaaaaaaaaaaaaaccaaaaaccaaaaaatcaaaaccaaaaccatgtattgatatcaaagtttttttatcctggcagggcacagtggctcacgcctgtaatcccagcactttgggaggctgaggcaggtggatcacgaggtcaggagttcaagaccagcctggccaagatggtgaagacccgtctctactaaaaatacaaaaattagccaggcgcagtggcaggcgcctgtaatcccagctactcgggaggctgaggcaggagaatcgtttgaaaccaggagggtagaggttgcagtgagccaagattgtgccactgtactccagcctgggtgacagagtgatactatgtctcaaaaaaaaaaaaaaaaaaaaaagaaaaagaaaaaagaaagaaagttgctttatctttaaaactatatatattgttttcacccctacatagtccttgcctcccagacatctcctcactaacgtcagtagacaatttggcatctgatggtttgaaatagtttctgtaatcaaatcctgaataaaatccattttaaagcctatagagagttaagaaacaagtataaaaatttgttgaagtgtttattgaacgaacataatacatttgtctgagaagagatacgcacactaaagtcccctacaagcaactaatgggaaaagatcacacaggtaactccaatttttaaaaatatgatcatgaaagataattgtagttggtgtttatggagcatcttttggaggggggggaacccccaacaactctacaaattgagatccagaacagagaaagtcatcaggtgaaatgccaagaccaaaaaacttattttatttgaattccattttctgagaagaaaactagtattgcagcagagtcatttaatgaaaacttaacagtttcactgaggattcagatatccgttgacatgtacatgacaatctttagattaaatcataaaaagttgactgtctccaagaaattgttatttcacaaatttatctattttaaatataacactgaagttattacataaacactgacgtcaaaatcatgccagagcagtgttactatttttacatgtatatgagtattcatgacctttaatgtctggacacattctaggtcacagaacagaagcaaattttcacttttgtgtgtttttggtacagtgacatgtctggttccttttgagctagatatatctgcttaaataattaacactattggatattagtccctcaaagtaaatgtctattttacctggtattctaggaagagagagagaaagaaaataaccaaagaaatgtgactgcaatctaatttccaagagagaaactctacttctgaatactggccccatactgcatattttatgaatatttttctcacaacttttcttaaaacttaagttctctcttaggaatgtctttagttaggtcttacaaagaaactgtttaatacacaatgttaacatctactaggcaaaagatgcttgcttctcttcccacaaaagccaaacagaaaacacaaagtgttactaacgttttctatttattcattaataaaaagtgcatagtacaagccctttatcccaatccaagtactcagaaaaagattaacaacagaccctggatggcacagacataatttgtttggcgtgatttaaacatataaaatcagtaattaacatttagcatatcacacgaccacttttgcttttaacaaactaatcttcacacatggtaacaaatacctatgatttttcatttagaaatattataagaagactaaacttactattgcaacaacaaaaatttaacccattaaactagaaactctcttcatttttccttcttcaaattactgttttgtgtcttaaactgagttggtcaaatttgagcacataattcatgtagagtgacagactttcatttagagtgatagacttccaaggttcctttgaaaatttaagatactggtaattccataaacactcccacaccacataccacaaaaacactaaaagtagccatagaatagctgtattcaataattattttggaaaatccacattatgaaatatgacttgctgaccatggaacagtgcttggatagataacatgaaaaaaatgaaaaacatctttttttttttttttttgagacggagtttcactcttgttgcccaggctggagtgcaatggcgtgatcttggctcactgcaacctccacctcccaggttcaagtgattctcctgcctcagcttcccaagtagctgggattacaggcatgtgccaccacaccaggctacttttgtatttttagtggagatggagtttttccatgttggccaggctggtctcgaactcctgacctcaggtgatccagctccctcggtctcccaaagtgttgggattacaggcatgagccaccgtgcccagcctgaaaaaaatcttttactagaaacagttccaatgttaacttttcccacatggaaagcaaaacaaaacaaaacaaaacaaacaaacaaatgcaacaaaacaacctcccactattattgtgcataaaaacacattaaatgactctaaaacaaaataaacttttttttttttggtagagacagggtcttgctatgttgcccaggctagtctcaaactcctgggctcaagcagttcttgcctcagcctcccaaattgctgggattacaggcatgagccaccatgactggcctaaaacaaaataaattcttaatggcatttgtggaatgtgtttaagagccaaaactgtgaaaatgtaagctttatctttcttttttcctagattatttaaagaggattgtagccacacttcagatgaatgtttacaagccaaataatgatttaagagtgtgctcaataaaaaggccataggtttaagaattaaatggaataatataaattactaggtcaacaagaatatttcatgtatagtacactgtctaaggaatgcagagaaattttacaagaaacccaagactaaatacttcattaagaacactggttactaagtaaatagatggctcatgtaggaaaaagctaatatatgtagatgtaatgtcaactaagtgcatgtgacagaaatgaagaactaggaataagaatccagattttctggccaggcacggtggctcacatctgtaatcctagcactttgggaggccatagtgggtggatcacctgaggtcaggagtttgagaccagcctggcctacatggcgaaaccccatctctactaaagatacaaaaattagctgggcgtggtggtgggcacttataatcccagctactcaggaggctgaggaaggagaatcgctcgaacctgggggtggatgttgcagtgagccaaggtcgcgccacttcactccagcttgggcgaaagagcaaaactccatctcaaaacaacaaccaaaaagaatccagatttttaggtgtctaatactagacattctgtatccaagtttcagccatttcatccaataaagccttctaaagccttttttttttgagacagggtctcactctgtcactcaagctggagtgcagtggcgtgatcttggcttactgcaacctgtctcccaggctcaagcgattctcctgcctcagcctcccgagtagctaagactacaggccgtgtcaccaaacccggctaattttttgtaggcacggggtttcaccgtcttggccaggctggtctcaacctcctgacctcaagtgatccacctgccccagcctcccaaagtgctgggattacaggcatgagtcactgcgcccagctcccaaagccaattttcaattatttgtgagccatagattcagtgactacatcaatatctcttgccagggattggcctaacagctcagagaacagattgttaggatatatgggcaagccttctaagttcaagaggcaagagcagaaaatggaatgctatagggatttagctccatcttaagccattctggccctttctgctctactttaccagctatagagttaggaaggcttccagtaggccacagcaagaggaaaaacctttattctgtggggctcatttatccaggatttaacttacctgtgtcatgttaccgatctattaacacaagtaatttagagttggttatattatttcaagaaattgagcacaaagccaggatgtacaaggaggaattcaaacaatcaatattggattatataatgaaaagatgcccttacaatgtttatgatctagaatgtaatcataataaaggggggaaaataccttatgagtatcacaattgtatcagagactattaaacagtacaatgatacagagaatttattcaattcatacaagtaatttaccagatctaaacagtgaatagactgacctaaggggaaaaaaatccttacattgatagcaaaatatcttctagcccccataaataatctgcaatcatttgctaggaaaaaaacttcataaccatatgggtcatgcagacatttttatttatttatttattttgagacagagtctcgctctgtcgccctgattggagtgcagtggcacgatctcagcttactgcaacctccgtctcccaggttcaagcaatttcctgcctcagcttccccagtagctgggattataggcacacaccaccatgcctggctaatttttgcatttttagtagagataaggtttcaccatgttggtcaggctggtctcgaactcctgacctcaggtgattcgcctgcctcggcctcccaaagtgctgggattacaggcgtgagccaccgtgcccagcccatgcagacatttttaagtgctattggtattcactttatttcaaactgagcaaaacaatacaaccttttacttttttatacattttaaaatttctctcatattaacattccttcctaccccaatccatcccatcaccaaacaggaatgagataaggagtgaaaaaaagatgtatgtttctcattttccttcttttcccttgaagtaaaccagtaatttattaaaatattttataggtcagaggataacaaaagactcaatgtagtaaataagtaaataggcattcaaatatcagtaacctaacaggccctaatacagctttaagattttcttctttttttttttttgagagggagtctcgctctattgcttaggctggaatgcagtggtgcgatcttggttcactgcaacctccacctcccgggttcaagcaat

SEQ ID NO: 408 - DNA, 1690 bp, Homo sapiens
aacatttgtgaccagcctaggcgacatagtgagacctgtctctacaaaaaatatataattagctgggcgtggtggcgcgcgcctgtggtccaagcttctccggaggctgaggtcgggggatcgcctgagccctggaggtcgttgctgcattgagccgtgaacgcaccactgcattccagcctgggcaacagagcgaactctatctcaaaacaaaacaaaacaaaacaagaaaaagaaaaaaagaagaaaattaaaaaaaaaaagaaagaaaaagaacgtcccagggtaaggtctgaggattgcgtcattaggcgattttgttgctgtacgaacaccacagaatgtactttgacgacctagatggtggagcctggacacacctcggctctgtggtgtggcctgctgcttccaggctgcaaacctgacagcatggggctgtactgaataccgcagaccattgtaattcatggggaaagcgcgaatgcagtcccccactacaacaaattatgcagtcgagttttccacatttgggaatatcacaggggtcagcacatccggagtgcaatcgatgagccccacgctgggaaaaaccaccttcgtgatcatggtatcttccctgccagagagaaaccaatcagcttcattttcaacttcttctatgactccagaggattcactttgcatcttgtgacaaatgaatatattacctgaaaaaaaaatgacaggatagatattgaagaaataattttttataggactctggagtgaagggattaatattgaccagagccaatgaggtcatctcatccttgaggggagcaggtgtgagcttcaaatgcttagggcctctggaaggaagcttccctgttggagaaatcaccaaccggctcagcatggtctgaatgaggatgacaaaagtgaagaaaaatgacgtcattgccagagtcaagtgtttctcctatcttggagttcatagggctgcttgaagaatccaggaggcagacaagccctcgctgacagactcacagctttcctgcgtgtttatcatgaagactgaggattggttcaaaataagtgaaactataatgatatttctcagttatcaatgtgatttgcaaaatgaacctagcattttgtagtaagtcattctgagaattcgttttttgtaatgctgattatcatatggaaagtaaaacacatctattacatatgaaacagtgggtagccacacctggaatgcagcacatagttctagttgtcacatctcaaagaaagtataaggggcctagaaaatattcagataaaaattattcatatcagggaagacaatattagaatttctagtcaggaaatatgagggccaagagaatttgtgagcaccacttatgatgtagggaagaatattatgttaatatagtcgttattgctggaataatagaattatgagtaaccctttcaaaatctcaaataacatagtttgagataagacatatgaaaagaacttctgcttggaagcagaggaatttgaaaatttattgaaagatgacacaggttgagagtataaatgtgctctagagagggcaaataattccataaggaatagctgtagcacagatgattgagggagataagggaaatttgggggatagctacttgacttatgaagatggtgagaagagaaggcaacctc

SEQ ID NO: 409 - DNA, 1469 bp, Homo sapiens
gttactagtgtgagtcctaatccaaaatgactggtctcctcataagacgagaagattagggaagcacgtagaagaaataagtgaagcagagccaggagatggttcctggggagatgtaaggccaccagagaaaagtgtccaggaaataatgaagaaggaagatgaaataccaaaacctaaatctgtggttgtgtcaccatgcactcctaaaagggaaaatgcagtgtacattgcacatgtagatgctggcaattcaaccactggaagacaaatactgtatttgactgaaatgggtgaaaacagggtatttgaaatgtatgaaacagaagttaaaaaagaaacagagaaacttagtacttgtcttgactcttagacacaaatcaggaaaattgagacaaggataaaataatagaagcgggttttgcctattttgaaactgaaaataaatattttacaattctagatgcctctggtcacaagagcttcatcccaaatacaattggtggtgtctctcaagctgatttggctgcgctggtaatctcagccaggagaagagagcttgaaattggatttgataaaaggacaaacaagagaacgtgcaatgttagcaaaggcagcaagtgtgaaacacttaattctatttattaataagatgaatgatccaagagcaaattggagcaatgagagatatgaagaatataaagagaaactagtgccattttgaaaaaagttggcttcactcccaaaaactgcattcactttatgcctgctcaggactaactggaggaaatttcaaagagcaattgaatttctgtacttagtacattggattactgtttattacatatctaggtaatttgtcagacttcaatagatcagttgctgtaccaatcaggctgccaattttgggtaagtacaaggatatgggcactgttgtcctgggaaagctggaatcaggcggtctgtttgtaaaggccagcagcttgtgatgatgccagaaaagcacaatgtggaaggtcttggaacacttgccaatgatgtagaagctgatactgtagccccagatgaaaagctcaaaatcagactgaaaggagttgaagaagaggaaattcttccaggattaatactttgtgatgttaataatcgtggtcattctggaggcacattcggtgcttagatagtgattacagagcatagatctgtcatctgcccagaatttaattcagtgctgcaaattcacacctgtatcgaggaagtcaaaataacagcctaaatctgcttggtagatagaaaataagactcaaccctgttttgtgaagcaagatcaagtatgcattgctcatttaaggagagcaggaaccatctgccttgagacctttaaagacttcctcaggtgcgtcattttaccttaacagatgagggcaagacttgcaaatggaaaagttctaaaactggttccagagaataac

SEQ ID NO: 410 - DNA, 1235 bp, Homo sapiens
attcctgtctcgctgtttcaacagtcagacgtttgttcttcaggctgcttgctccagtatcctcgtcagacaaccgcagggagcctttgtgcatttatttatttatttgcttggacttgtaatatgaacaaaacatgcagtcacttcccaccaggatgtgtccttctggacatcagcatacgtgcaagatgacaatttcagggtgaatgcttcctgctcgttggctttgctgctggctggtatatgagtagcactggctgatgtaacaaacgtacaccaacgttccagtggcttcctacaagagttctattcttcctcatgaaaaatttcagactacattcctggttgtcaggaagctcccctccacatgatgactcagggactcattttgttcctcatggctctgccctgtcttgtgcatgttgttggtgaagttgataaaggaacttagaaagccattttctgtggaggcataatccaagtgatgcctatcataccagctcctattcccttggtaggaatttactcacacaaccacctctattttagagggaagcagggagacttagtgtaactgtatgcccagaaaagaaaggtcaactgaggatttcaagtatctaccagtcttaagtgaatatagagaattctaggtggagaaaactaaagaaaacagagacagaggaacaaagtaagtgaaggttgcagagtacggaatgaaggagctggaagtggcaacgacattctacactagaggagaggatggggtagtttctcaatgcatggaaaatctattctctcggaagacctggtggtgctggaggcttgaattctcttctgtcagtagctacagaaaatcaaagaaggaaatatcaaactgtgttttcagggccactgactctgtgacttccgctgtctggccttcatgaagccaggcggtcaaatgggacacacagaaactcgaatcagtgagtccttcctcctggcctgaggccccagcttgatcccacaacagggaaaattctggaggtttctgtgttgacctgggtggtagttatgcagcggtgttccctttgtgacaattcatcaaaccattcacataatgtgttgccttttctgtaggtatttttttcttcaatgaatagtttaataaacacaaaaaagaaaatatggtcatcttatctttggacagtctctcaaatgttttataattaattaaattctttaacttatgtatt

SEQ ID NO: 411 - DNA, 10658 bp, Homo sapiens
agggcgggtccgcggccgccaggtgagcccgccccggtagccccgcgcgtggtccggtcggcagaggcttggcgagccgccatcccgcccctgccccaggcccaccttcccccaccgcccaggccccgctggcctccccggctcatctcgcacccggcgcagaccccatgccctcccgtctcggcagcgccccccgcttcgcctcccggtccggccccagctcgacgggcggaaccgggtgcgcacagcagccccgcgccctggcccagggccagcgggttaacgcttaactacgctccaggagctgtaggctccagccgcgcctcgagtccccaacctttggccccggaagccaaaaagaggagcggacggtgaaggagtcagggtgagttccagaggccgctcccagattttccctcccgagcctggccagactgggcgtatgtccgacatctccacctctgaccccgggcgctctgggctgagctgggggcgatggtggtgggcatcgacgccgtcttacctggacgcccacagtggacctgacctggccgaggggtgggggtggggttgggaactacggaggcgctcggggttcctgggtaagttcccgcggactgctcgctccttgccgggtgctacaataggcgtatccggtgtccctggagccaagctaggggacgggatcaacgtgggggcggggcagcgtgcccgaagggcattgctgcattccaggtgttggggaacgcagtgagcgaaggcgtggaggtgagggagaatgtggaaggcgtgcgcccggccggggaaccctgggctttgtcctgtgggcagctggagcggctgggcgttcccggctgcgacaacgcccacctggccccgcacctgggcctgctcgcaatccagcggcgcctctccgcatctgccttcacggatctcagccccagcagagcccttgtgccggaccctggggcgggattgcgagttcagagggagtcaagaggcgcccttgagtatggcgggagccccaccccaagcacctggtgggaactcacttgcctagggagagagcagggcagtgagcactccgggctggctcccaggaaagaccctccggcaggagcttggattgcaaggttggggaggagggaggccaggggagggacctgcagccaggtgatccgggtgcctgtatttcttcccaaggataatgtgagttgatgctggctgagatctgctccgatgagggtttgaaagagagagctccgggtgtcaaagtcagtggatggcaaaacatgcctggagggagcaaccaggcatccaaccacaggccctgggctggagggcgggggggggggggggtggaagcagaggaaggagagagaaggaaatttgggaggaagagtgggcacgaactggctgcccaattgtgtgggtgggtaggtggcagggagggactggttgttctgggtctgcccctccggccccaccacacctgcttccaggtgagcttaggaatttcccaggcttcctcccagctggagccagacgtgtccctcagaggccccagccctgcccatcctttcctgccctacccagggcttctctaccttcttggcttggcctgctccttgttcacaccttggtaaatgacccttcacaaaagtcattttctctatttgtgcttttctttcttttgccaggacgcttgactttctcgacagggagggggaggcaagcctggtgcccagtgctctgcctgcactggtcagtgcgcgtggctgtcacttggctgggaagctaggccaggagagcagctgcagctgtggaggtcggcagttgagaggtggagagacctgagcacacttgggccagtcgtcccgtggcatttgggagcccaggaccgagccggggggcaagtgtgggcaatgcttggagccacagagtgggggtagggaattggaggggtagagaggacaactcaaaccaagccaggaacccacagaggagaccaggaaaggaaaaccaagaaggagtgagtccccaatgcccccaaattgatccatatattgaatgatccccagtaaaagtagctccatgatgattccaaagcccttaggaaactaaaggtgccaggagaatgaatagacacgtctccatagaagacacacactggtcaacaagtacatgggaaatgtccagcatcctccaggaaatgcaaagcaaaaccacagtgagatcccacctcccacccgctgggactgggcagatgcagtcctggcaaaccagtcttggtgaggagcgggggtatcagagccctgctgcactgagatacacacacacaaaatggaatagtattcagtcttaaaaaggaaagaaattccagtactggctgcaacttggatggaccctgaggatcctatgctgagttaaataagccagtcacagaagaacacgtaccatacaatcccacttatgtgaggtccctagagtagtcactttcatagagatagtagctgacaggaggagcatggggagtgactgtttaatgaatacagacttgaaatttgggaagaggtaaaagttctggagatggatggtggtgatgggtggtgatgatggacattggagatgggcaatggacatggatggtggtgatggatggtataaatggatattggatgtggacagcggacgtggacagtggagatagagggtggtgatggctggtggacatggacagtgaagatagagagtagtgatggatggtggagatagagggcggtgatggacagtggagatagagggtggtgatggacagtggagatagagggtggtgatggacagtggacatggacagtggagatagagggtggtgatggacagtggagatagagggtggtgatggacagtggacatggatagtggagacagagggtagtgatggacagtggagatagagggtggtgatggacagtggacatggacagtggagataaagggtggtgatggacagtggagatagagggtggtgatggacagtggagatagagggtggtgatggacagtggagatagagggtggtgatgaacagtggagatagagggtagtgatggacagtggacatggacagtggagatagagggtggtgatggatggtggacatggacagtggagatagagggtggtgatagacggtggacatggacagtggacatggacggtggggacagagggtggtgatggacggtggacacagacggtggagatagagggtggtgatggacggtggacacggacagtggagatagagggtggtgatggacagtggagatagagggtggtgatggtcagtggagatagagggtggtgatggacggtggagatagagggtggtgatggacagtggacatggacagtggagacagagggggtgatggacaatggacatggacagtggagatacagggtggtgatggacggtggacatggacagtggagaccgggggtgatgaacagtggacatggacagtggagacagagggtggtgatggaccctggagatagagggtggtgatggacagtggagatagagggtggtgatgggcggtggacatggacagtggagatagagggtggtgatggacagtggacatggacagtggagatagagggtagtgatagacggtggacatggatagtggagatagagggtggtgatggagggtggagatggagggtggtgatggagggtggagatgcagggtggtgatggagggtggcgatggaggttggtgatggagggtggcgatggagggtggtgatggagggtggagatggagggtggtgatggagggtggagatgcagggtggaaatggagggtggagatgcagggtggaaatggagggtggtgatggacagcagagatgaatggttgtgatggatggtggagatggagggtggaaatggtgggtgatggagggtggagatggtgagtggtgatagaaggtggagatgaatggtggcgatggacggtggaaatggaagatggagatggagggtggatggagggtggagatggtgagtggtgatacagggtggagataaatggtggtaatggacatagagatggacggtggaaatggaggatggtgatggttgtacaacaatgtgaatgcacttgatgtcactcaactgttcacttaaaaatggcaaacatagtagtttttatgttacatatattttactacaataaaaaaagaatgaaaagcctataaaattctgaaaaataaaaaagggggctttagccctgccagagagtagaatccatcatagaacatcttgctatgggcagttgactggacacacacatcagagcaggtctgtgtgatcatttagcatatgattaatggggcatttaaaatccacgaggggccgggcgcagtggctcacgcccgtaatcccagcactttgggaggccgaggcgggtggatcacctgaggtcagcagttcgagaccagcctaactaacatggggaaaccctgtctctactaaaaatacaaaaaatagctgggcatggtggtgggtggctgtaatcccagctactgaggtggctgaggtgggagaatcacttgaacctggaagcggaggttgcagtgagccaagatcgtgccacttctctccagcctgagcaacaaagcgagactctgtctcaaaaaataaattaattaataaataaataaatccatgagggaaaggatgtcatttaaaaaagggtgtggccaggcacggtggctcatgcctataaccagcactttggaggccgaggcaggtggatcacctgaggtcaggagtttgagactggcctggccagcatggtgaaactctgtctctactaaaaaaaaaggacaaaattagctggatgtggtggcgcatgcctgtaatcccagctacttgggaggctgaggcaggagaatcgcttgaacctgggaggcagagattgcagtgagcctagattacgccattgtacttcagtctgggcaacgagcgaaactccatctcaaaaaaaataaaaataataataaaataataataaagggtggtggagcaactgggcggccttggtgtctggaaaaacatgacgttggatcctgatcccactcttcacacggaaataaattccttatggagcggaaatagaaatgcaaaaacccaaaaccacaaacataatttggaaaaaacacaggagactatttaatgatctcaggatccggaaggcttttctgagcacaacaaaaaagcagaagccacagggaacattgttgaaaaatttaattaaattacaaatggcaacattttgcctagaccacatatttaaaatcaaaggatgtgcaacaaactggggagaacccatgataactcagtggttaacaaagggccgattctcccaacaaagggctactatcagtcaacgaggaaagggccaggccgccggacacgctgcacaaaggaagccccaatggctgctgactgcaagatgctgaacctccgccgtaatcagggatgagcaaattggccctaccggaagatggtattttcacctgtcagacgttttcatgagagactgggatgggaggagcggggagacaggcacttcccacaactcccagcaggagtgtgaatttggggtgtcgggggaggggattttgtttccactatagcctggtactgcgatttggtccagggctctggtgaagatgtaggagttggcctgcgtcagcgcccgtccccgctttccacagcgagcaaagaccgtgggaaccctgatgcccctttgcatttgcgcttctgtacttagctgctagtctcaggcagtgaaagcttcaagccacccgcagagccctggaactggggcattggctctagtgggaaaaggaggcttcccactggcgacccaccatgacagaccacaaaagacatgcaggtccccacagtcaggccctgacacccactcttcctgccttcttctgcctaggcttgcacagctgggcaagtgagcgggagccacgggttagctgagatcacctgcggccaggaacagggccttcctggaggtgaggacaagctctgcttcctccaggagcaggtgctggagcagagcggctcccccgttctacaagtgtcctctgtgtggcggcccaggtctgtgcgggcctgtccagcccaggagaggacagaagtcatctgtagcctgggcccctgtggcccccagcgagaggccctggtgggactggtctttctcagcctgtgcacctggggctgaaacaggactcaaagagggaaagtggcccaggcaggccctcccctcaggcctcccctctccctggctgctctcccaggcttccctgctttcccttctgagaccccgactactggacccagccttactgccaagataattatccacaacagcaggagcgcccaggcccatgaagataatcgcctgcccagcactgtgtccacatccagttcatcccagctgagacccaagtgcagctgaggggtgggggacactcctcagctctcgaatgatgccaaccctccagggcctggctgggagcagctcagtgcttcctggctccggggctgtgttccctacgtcccattcggagcttctctcctgaagaaaacagtgtctgcctgcacccttcttagaaagcaccctgacacgtggctacaaagagcagagagcacagtacccttcccagacacacaccagcacccccacccactgcatttaagccaccactgtcccgccgcattcatccctcctctaccccctaaattcatctttcagtggaactctgcgttcatccctccactccccgctccattcatccctccactccctgctccattcacccctccactcccccctccattcacccttccactcccccctccattcatccttccactaccccctaaattcatccttccacagaaccctgcgttcatccctccactccccgctccattcacctccactctccctccattcacccctccaaacccccctccattcacccctccactctcccctcccttcaccctccactccctgctcctttcacccctccactcccccccattcacccttccactcccccctccattcatccttccactaccccctaaattcatccttccacagaaccctgcgttcatccctccactccccgctccattcacctccactctccctccattcacccctccaaacccccctccattcatccctccactcccccctccattcacccctccactcccccctacattcacccctccactcccccctccattcacccctccactcccacctccattcacccctccactcccccctccattcacccctccactcccccctccattcacccctccactcccccctccattcaccctccactcccccctcccttcaacctccagtcccctctccattcacctctccactccccccattcacccctccactccccactccatccctccattcccccctccattcatccctccactcccccctacattcatccctccactcgcccctacattcatccctcccctactccttacattcatccttccactccctcactccattcatacctccacttccccctccattcattcctccactgccccctccattcctccactgccccctccattcctccctccactgccccctccgttcatccctccactgccccctacattcatccctcccctatcccctccctgccccctccgttcatccctccactgccccctccgttcatccctccactgccccctacattcatccctcccctatcccctccattcatccctccactccctcactccattcatccctccactgccccctccattcctccctccactgctcctgactgccggctctggggcagtgctctgtgtcccatggtgcagagtaggacaatgatgaggaggcagaagagcaatcgagtggagtttcggagagtactgtcataaccctgcgctgagggcggatcccatctctgcccaggtcctggatctttaccacccagcacccacacaccccctaagctctgcaggacccatggtgaacaagatgaggaagaggactgaggtggtcatctcctttctacttcagcgggaatcctttctctgcggttcatcagggaaaatggaattttttttgctcacctacagatcagctctccagcatgacgggccctgcggaccacctgcctcaaagcctttcctccttgttctttccaacagaaccaggggctttcagccatctgtggtgatctcttgatctcggggaaggggccaggtccaggactgagcaagggcacataactaatttggggccaaggagatatgaggggaagtgtgctgttgcaggggacagtgtgtggggaagggcgcttctaggaatgccgtcctcctgttaaagagttgatgtgaggtaagacattctctgtctctactcaccgcctctgctgggtgaggacatgattcttgggactgcagagccatcttgagactaagagaagaccaggagcagagcagacaagctgaccaagatccctgccacagctgaactggacccagagccatagacttcttaatcttacgaagtggatcaagctaacaaacttaaacgatgttgtttaagctactttgggttggatgttctgttagttacagctgaatcacccatgtagcagaggatgtttttatttattttagagacaagctgttgctctgtcaccccggctgaagtgcaggtgcaatcatagctcactgcagcctcaaaatcctggctgcaagtgatcctcccacctcaccctcccaagtacctgggactacaggtgcactctgccacgccagctaattttttaaatttttgtaaatatggggcctcagtatgttgcccaggctgttattgaattcccggcctcaaacgatcctcctgcttcagtctcccaaagtgctgggattacaggtgtgaaccactgtacctcgccctgcacacgtgcttagatatgctttctccaagtactgttctttggaatactggtaataaatatttctatgagctgggcacggtggctcactcctgtaatcccagcattttgggaggctgaggcgggcggatcatctaaggtcaggagtgcaagaccagcctgaccaacatggataaaccccatctctactaaagatacaaaattagctgcgcgtggtggcgcatgcctgtagtcccagctactcgggaggctgaggcaggagaattgcttgaacccgggaggcagaggttgcggtgagctgagatcgcaccactgcactccagcctggacaacaagagtgaaactccatctcaaaaaaaaaatttttttttctatggaaaaaagtctattttgtgagatatacatatatttttttttaaataaaaatgtgttggtccaccccccccacacctccacccctgcagtcaaagccactgaccatggagccaggagccacccaatgaggtgtcttttctctaaggatggtgaagttagagaaggctcctttaaacctcctccaccatgtgccagaaacccagagaacactcacggcggccctgagctctcgagaatcgttgtgcaatgcccattccagcagccatgcacatctcatggccagggtgagcctaggaaggaagggcagaggatgacacattcgacgtgagtaggactttctgtgtgtccactctgtggggctcttctttggaacgtcactgtggacacaggagtcagaggtgaacgaaggcactgagaggggatggggcactggcattggaggagtgaggagcacccagccatccttattcgctttactgcttttggcagtttttctgtttgatgtgttaattcgtgtacacgctgcatgccagccgccactgatggccgccttaacggcggtgctgaccacggctgctttgtcagcacaggtgaagctgttgaaacgcctctcagaggggcctctggtggcactgcccatctcttccctcagcctctcctgagtgaggcctgctgcggggtttccgagagttccctcaggaagcggcagaagggagcagatgcccgaggtcaggtgcctgagagacggtagcatttggacagcccagtagcctttcccatggtcacgcaaattctcctgaaactcaggcagggtctgaagaaacacaagatggcacaaagccatccccagagccgtgggtcccacgtggttaaatgtggaaaacactcgctgagggtcatagtggaaaacagcggctggagatggggtcttcctgttggctgccgagacggtgacatctacaggtgttgagtggctaaaaaaatgtattccttgcaatgcctcacagacatggtaacgtatgcacatatgcgtagtggcctgccagggctggtaagataacatcccttctatattcagggagatgaaatctgatctttttttttttttttttttttttgagacagagtcttgctctgtcacccaggctggagtgcagtggcgtgatcttggctcactgcaaccttcgcctcccagg

SEQ ID NO: 412 - DNA, 2856 bp, Homo sapiens
aagtctatgtggcccttaccatctgcaacccagagacgtgccagctgttcaccactgagctatgccgggctgggatcagatgggaagtggaacctcgtcatgaccagaaactgtttccctacgaagagcacttggagatggcaatgctgaacctcacactgtaggactcacatacgactccaacgggattgtgagaatcaagtcactctagtgggaagagtttttatatgggaaagcggataaaactttcattggactggaatgtttggagaatgttaatttccaaatcaggaaccacaaactgccctctaataagacatcagctatctaagcatgtgggtgctccctttctgccagcagttctggttcttaagaaaatcgccatcaatcagacatgaaatctctggctccaaaaatagcattttctttgtgcaaataaaaacgtgtgtatcaagtatgatgttcccccaatgtggacacactcggttccccacaaagccaagcccgctgcagctgccacatccctggacacattcggttcctcacaaagccaagcccgctgcagctgccacatccgtggacacactcggttcttcacaaagccaagcccactgcagctgccacatccctgggcttacagtgcagcaggtgcttttttcaagacaggaatcaaaatgttaggaacacggcggaaagatgacacctggagagcaaacgcaggatgaggagtactgcagaggtcacacggaagtcgcagaacagtaatccgctagcaggggcatggggcgtgaagaacagaagaagataggaagtgtttccgagcctccagaaaagaaatcagagccaagcacagcttcccgggtcacagaaccaattcatttaccaggcggcaccactgccgtcatttcaccttctggccactgggaggcgctgctcgaaagggtttgccctgagactccgagaagaagctgcgggaaggacagcaggggtcccggggttttagcctctggcccaggagttatgtgtccataaccaaatggagcacactctgcacccagctctcatcccatcggagctgctgcgattcccgcaggttcttccagaactggtttagcttgcccgcaggatcaggaaagtttgagaaaagcatctgcaaaaaaataaagagcagagcttaactcatttcctgtccccaccccatcccaggtcaccacctggctgaccccaggtccccgacccaacaacaaaccctcccaagttcctaactccctcacttggactcgagactcttcacgccccagcagcgctccgcctccaacttgacatcacgctttctgtcccactttcccacacttcgtgccctggagcacctcccggcctctacacgctgtatgttcccctgcgagcaccctcctcttggcctctggccaagtcccacccatctgtgggtaacaagggggtgttggtgttcttttcagccttgctaaactgtctgaatcaaggatcacaaactacagcctgcaggccaaatccagcccacagcctgtgtttgtaaataaagttttattggaacaaagccacaccccttaatcgaagatgatctgtggctactttcacaccacaacagagtaccatggttctgacagagactaggagacacagtctaaatgacttctgacctggacctttactgaaaatcctgccaatcattctgttggcaagaatgatgtattacttttagcaataagaaacaagtaacctttgcagaattccacccatctttcaaggctggtcccagaagttccctttgcccatgcacctacctgatcctgatcacttccgaaactgcagcccggcccacccggctccagcatcatttgtggagtgtcagctccataaatccagagggcaggtgggggtgtgtcctaactttcccgagcctactgtaccgaaacgggacagcagagtaggccagcctctgtgacttctgctctctccctagcttttccgccagaccccacatggtcccaccctggctgtgggaagcagggatcagggagcatggctcagtgccagtctccagaaccctctccaccctcgcgtggtggcagatgtggctacctgcagctgagctgccagttcctctgagtcctcaaagaccaggccattttcttcatgtttcaccagctcatgtaaactgcagagagaaccaagggagcctgagagctgcctggagaagacaccagacccctggggtgcccacctgggcttcagcctcccaccccatgctcaagccaggctgagagttggaacagggggtgtgttttccggggggtggttcttagatttggcatctgaagggtataaaggggggtacacatctaaatggccaaaccgatttgaagagggagccttaaggggggtttgtaccttctgtgctggatgctcttcaaggactgaagaattatttttgcatgtttttcttaactccatggccatggaacaagtaaagggaacacccgggggactggctcagcacataaaagatgacttttctagggcaccaggtttgatcccgacattccctgagctcagctcacaggaggggctcacatccctggatcccatccaggagccggctcctgagcaggggccaagggctcagcttgtgctggggctactgcttctagaatctcctctaacgccgcccttccaaacacacgtctgtgctgggtagagtggggccacagcatgacactcatttaactgattcaaacccaccacgtgagcttggccaaaagggacatggtgggagagaaagaaacaaagaaaaccatgtaagcctgcaggcaattc

SEQ ID NO: 413 - DNA, 2209 bp, Homo sapiens
tacactctttcttgcctgctgccatgtaagacgtgtttgcttctcctttgctttccaccatgattgtgaggcctccccagccatgtggatctatgtgtcctgggtttcttctttctggtgggctcatggtctcgctgacttcaggagtgaagctgcaggccttaacgctagatggaaaagttctccaagtccctacccggcccagaagcccagctggcttcacctctcactggcactggctgcaggacttcgccgcacctagcccgggcactcccgcagcctagaggaagctcctcccagacaatcaagaggaaaagaggggaagcgagaaagagacggagagccgccagcgtggccaaagaccccactaagagggaagggcggtccacgcacgggacccagcctccgatcaagcccagcaggtgtcgagatcgcgcccacccggaccccacgccggccggccagcgctgcgcgcagccccagctcctgcccgcgcctctctcttcacacttcccggagagcagagggagccggctcaggcctcagccagccccagagaagggccctcacagcgcagcggggggctgaagggctcctggagcgcggccagagcagacatggagaacgaggaggcgcggagagcgagcgagggctgctagcacgttgtcacctgtcatgatgttgtaaaataagaaagagtaaatgttattttagaattccttcctggccaggcacggtggctcacgcctgtaatcccagcactttcagaggctgaggcgggcggatcgtgaggtcaggagatccagacaggagatagagaccatcctggctaacacggtgaaaccccgtctctactaaaactccaaaaaattagccaggcgtggtggcgggtgcctgtagtcccagctactccagaggcagaggcaggagaatggcgtgaacaccggacgcggagcttgcagtgagccaagatggcgccactgcactccagactgggcgacagagcgagactccgtctcaaaaaaaaaaaaaaaaaaaaaaaaagaaaagaaaagaattccttccttgtttcctgctgtagttatttgtcaaaagatacaaaaaatctgtaagagttaagcaaagctatatttattttgctgcaacactactatgcacagtgacatggtcaagttgctttttataatgatttctagtgatattaatttgcatcagtcgttttcatgaccccaaagccaactcaataataccagaaaatacttgtttgcttgcctacattttgtaataatccaatgtcctgaaataaaaatgaatattttcttcctggaaataaagtgagataattttcttcttccgagagactcatgaaacaagaacagaatgacattatactaaactatttcacaaatattggtcaacagtggaggcttttttgttcatttatgtaaatttcatttggctctattttcctaagttgcattttatgcttctttcacctgccttgccaaatgaaaagaaaaatcatttatttattaaaacatacactaacagaagaaaataatttcactcttcacaaactttggcattatgaagtcactggttactggagatttaatttctgtaacatatctgaagtggttatttttttctttccatgaaggaaaccttttggaattaagatatggtacattgaactaaacggggattgcatttgctgtttctgtgataacattttacatctgaaattccaataaatatttctcttcttgctttgaggtggtttagttaatcattcaggtggttggctttcataagaagtaaaggcgtgccagcatttatagtttcccagagttcgtttattgcctcaagcttgtatttattcttattacactcactagcttagataccaggtgaatacctgggagaaagaaacaattaatttcaaaagtaataaaaataaaagaacaaaaaaatacaaaactattcaacatgccagcaatcctgttctcttaagaaacctacctgtttttttcaatgtgtgtaagttttagcattttatagcaattagatgagtctgtatatcattagaacttctgtccttggaattaggacaaaactattttctgcaataaatatttggctctagaaatctattttgacctgtaccataatgcatagcagcagaattaaaatattgtgtgttatcatc

SEQ ID NO: 414 - DNA, 1112 bp, Homo sapiens
atgttccttgtgaattgcttgcatccagcattaagggctggtttttatcttttatttttccaatcctctttccttctcaaggtgtccaagacacacagagccatggaatctcacagatgtctgagaattcctcctcctgggactctcagaggatccagaactgcagccggtcctcgctttgctctccctgtccctgtccatgtgtctggtcatggtgctgaggaacctgctcagcatcctggctgtcagctctgtctctcccctccacacccccgtgtacttcttcctctctaaactgtgctgggctgacatcggtttcaccttggccacggttcccaagatggttgtggacatgcagtcgcatagcagagtcatctctcatgcgggctgtctgacgcagatgtctttcttcatcctttttgcatgtatagaaggcatgctcctgacagtgatggcctatgactgctttgtagccatctgtcgccctctgcactacccagtcatcgtgaatcctcacctctgtgtctccttccttttggtgtcctttttccttagcatgttggattcccagctgcacagttgaattgtgttacaattcacaatcatcaagaatgtggaaatctctaattttgtctgtgacccctctcaacttctcaaacttgcctgttctgacagcgtcatcaatagcatattcatatatttcaatagtactatgtttggttttcttcccatttcagggatcctatggtcttactgtaaaatcgtcccctccattctaaggatttcatcatcagatgggaagtataaagccttctccacatgtggctctcacctagcagttgtttgctgattttatagaacaggcattggcatgtacctgacttcagctgtgtcaccaccccccaggaatggtgtggtggcgtcagcgatgttctctgtggtcacccccatgctgaaccttttcatctacagcctgagaaacagggacatacaaagtgccctgcggaggctgctcagcagaacagtcgaatcttatgatctgttccatcctttttcttgtgtgggtgagaaagggcaaccacattaaatctctacatctgcaaatcctgccc

SEQ ID NO: 415 - DNA, 5855 bp, Homo sapiens
ctttcgagccgcgacaggatggggaggaaaaagtttgcggcggaggcggcgtcatgtgggacggggcgggcggagcgtcgcgggccggatgggaaaggccgggagcgccggcgggaggcgggacggccgcgggctctgcgcccgccctcggcgcggaccctgggccccgaccccgcggtcgccggggctccccttcctctgtcccagtgcgcccagccccgcgctccgcacccgggcacccccgcggggttctcctgagttcctggagctcccggggctggcgctcacgccgtgagaggggtgcgcccttaggggggcgggacggacggggggtttctacgggaggtaggaaacgggcggcttgcaaggcgcgggcttaggccggagcctggtggtgcgaggtccccagctcggatttctccctggtggagagtcccggagcagaacaaaccagcagaggctctggaaagggtcctcctgagcacgtggctcattcattcattcgacaaacgttacctgagcgcctgcccactcattgcccgagtgtgctgggagcgccgcaccaactgcctggtaggtgggagaagggacacgtcaggtaacaaacagcacaggtaagtgccggccactcaaatggggtggaaagaggtggcacagcgctgccgagggagtgcgttccagacaggtgacctcttgcttgggtgctgaatgagtggagttttccagagagaccaagaggaagcagccgcagaaacctcagcccagctgggcttgcagaagctaatgctagaatagttgtgggactcaggatctgctgaagtcgggggaagagagaagtagggaaaggaaagcccaggccacgcgtggggctcaggaacggcatcctcgcccgaggtgggagttcttctcaggccctggtgtttcccatgacagtaaaaggtgggggcttcagatttctccaagggaaaagttaaagcaacacacacctatttatttttactgtaatttcagaaaagagaggttaaaaccaagacatggacaaagcctccgaatgaaggcagccctttaaatggaataaatttggtttcatggcacattaatggggtgtcttctctccgaagacacagagacaactacagtaggtctgggggccgtcagggattggaggaacgaaggtaagaaaaggaagaaggtaagaaaaagaggtccctacctctgtgaggtagggacagtgctgaacagcagggctgggagagcccacagggaggtggccaggatggccacagggcctggggaggaccaggtggggcaccatcctgcggtagagaatgcccgtcacctgccctaggggccacccagaatgcagattaaataagtatttgggaatggcacaggagcttttccattttcgtgggttagaggaaagctgctgcgttcaagaggataacgtgggacctgagcattctggtaagtcaaccccacattcatggaaagccacgggctctgttttactgataaggaactgaagtcccacagaggaagtggccaggctcactcacacacagcatgcacttgaagctttctgtggaaatcagaaacctccggggctcaggcgctgtagtggtggcctggtgactctgaccccttgaaggagaagcatctgtgaaggtgctgtccaggacaagtagggtgctctacggtaaaggacatggtggcctgacctgctccagagcagggaggcctcccttgaggaaataagataaacccagactttaaggataagcagaaaccagctaggtgaactggagtgggaacagcacgtgaaaaggccctggtttaggaaggagcaccactccttcagagcacagaaaggccaggatggccgaagcatagggaacaacaggaaagtgacataaattgaggctgcagaggtagaagaagggccttattggtcgtgctaggaatttggaattctgcaaagaagcctgggaaacagattttggtgacactcgccttctctttaatgtgcagtttcagttctgttggtgtgattctgcattggagatggcgtgctgtaacgaatggccaggagcttaagagtcatgcagacttgggaggcctggccttgccacgcccagctgcatggccatcctcctcctgtttctggccgttctgtttctaaaccttggggttctgatattcctacatgtaaactaggggctgtaataggaatctcacaggtgagtcttaggattataagaggagacatgactgcatgtgtaagacatcataatgatgtgcttcctcatctgaccctacctccaggttctttgataacctcatggttcccattttctagaacagttgccacttgcactcagataaaggtgactcactgaatgcataaataagtgtagtgccggatttgcatacttttggtagactgtcatataataaatttataaatcagaattttaaaactccaggtggggccgggcacagtggcccatgcttgtaatcccagccagcattttgggaggctgaggcaggcagatcacttgaggtcaggagctcgaggtcagcctggccaaccagggttttagtagaaaccctgtctgtactaaaaatacaaaaattagctgggcgtgggtgcgcatacctgtagtcccagctactcaggaggctgaggcaggagaattgtttgaacccaggaggtggagattgcagtgaagcaagatcgcaccgctgcactcctgcctgggtgacagagtgagactccatctcaaaaacaaacaaaacaaaactccaggtggaccacgggccaggtggttgtagcttcagtcccttgattgcaacatgtgcccaagtttggctgagatgtacctgtagccacggtccttgaagccctgagaagatttgtcagcatccccacggtgctccagcagtgctctcatcttgtggctctaaatcgagtccatggccctctctcactgtcctatggttgcataagctcagaactggcttcgtctccaattccaggagccctggaggttgtggcctgttgacatttttacctcctgagtcaatgtggctgggccacaggtctcagttgccctcccaggcatcttgcaggacttggatctgtgccaagcttgtgggtgtgaacaagcccaagaatgctgaggctctcagttgctcagtgctgcccatcactgggatttcagagtagtgacccccctcctccaagatacaacagaatcttgctttggggccatgaagaacacaatcaatattacagttttaaatcttgaaaagtacagttttaatttttttaattccaaaaaatttcacacatgtgcactgcaaattcaggaggtaaattcagcaaaatcttgcctggtggaggtaccagaaggcacagtgagtcaatggggcatgtttctcagtcggtggggagagatgagaatggaacagggatgtggagattttatgcaggaaaaggggcctgaccacagattttttgccctttgaaaggagaggaacaaggcctatgcccactgcctcttggattcagtgggagatctgggcatcatactggatgaccaggcatgtagtcacaatgcacaatgccacccagcccaaaagtgtatattcaagactttagacccaacttcgtgcttacaggaaatagaggaggttgaggaacaagtgacaccataagaaatacagtgaaacaggccaggcaccgtggctcatgcctgtaactctgagcactttgggaggccgagatgggcagatcacctgaggtcaggagttcaagactagtctggccaacgtggtgaaaccccatctctactaaaaaaaaatatctgggcatggtggcaggcacctgtaatcccagctactcaagaggctgaggcatgagaagcactggaacccgggaggccgaggttgcagtgaacagagatcgtgccattgcactccagcctgggggaacaagagtgaaactccatctcaaaaaaaaaaaaaaaagacactgaaacaaagccagaaggtagaatattctttcaggtagtagtctggtctcttcaatagtcaatattatagagcaagaaggggccagtggagaagagctgttctagattttaaaagatgtaagaaatacaacatttggccgggcgcggtggctcacgcctgtcatcccagcacttaggtaggccgaggtgggcggatcatgaggtcaggagatcgagaccatcctggctaacatggtgaaaccccgtctctactaaaaatagaaaaaattagccgggcatggtggcatgcacctgtagtcccagctactcaggaggttgaggcaggagaatggcgtgaacccgggaggcggagcttgcagtgagccgagatcgcgccactgcactccagcctgggtgacagagcaagactccatctcaaaaaaagaaaagaaaagaaatacaacatttaaatgcactgtgttatccttaattggaaactgctttaattatccaacactaaaaaaatgtcaagggcaagaggtggtttgaactatggactggtgttagatgatgtattttttttattttgttaagtataataatagttgttatggttaggtgggaaaagatccttaaattttagagctgcatgctggagtatttagaagtgaaccgtcattgtatttgttatttaaaatactacaggaataaacaagatgaagcaaaattgctcagtctagatatgggtctatgagtgtttcatctttctacttttttctccatgtttgaaatccttggtaaaataaagtcaaagtggaggaaggaggagcttgagattgaaaaatcagtttgagaagcagccaccttgactggcttcactctaatagcctggacgctgcctccacactccaggtgcactgctcagcattctccaagaagatcattaaggcagaccctacgtgttaaatttcaatcagtttcattgagcaaatatgctgttaaatagagactgctgtgtgctgcgtcagtgtgccttatgggcaaatgtgatggtgactataaatgcagaccaagcagtccttcccacactgtgtacacaaagaaaggagctctggaactgggagccaggacatctgcaggaggagaattctgaagtgaaaggaggcctggatattggttgcaaggccttgtccctggagcctggatgctctcataccttctacatctgggcctctgggtccaggacagtgccagggagagttcatagaaacaaatgtgttgaagaccttagcggttgtctgactctgagacagttacctggccactcttaagtttcctcattttttttttaattttactttaagttgcgggatacatgtgcagaacgtgcaggtttgttacataggtatgcatgtgccatggtggtttgctgcacctgtcaacctttcatctaggttttaagcccctcatgcattagatatttgtcctaatgctctccttccccttggccccctgtcaggtcctggtgtgtgtgttgtctggcccccaccgtgtccatgtgttcctattgttcatctcccatttatgagtgagaatatgtggtgtttggctttctcttcctgtgttagtttgctgaggatgatggtttccagcttcatccatgtccctgcagaggacatgatctcatccttttcatggctgcatagtattccgtgttgtgtatataccacattttctttatccagtctttcattggtggacatttgggttggtttcatgtctttgctattgtaaatagtgctgcaataaacattatgtgtgcatgtgtctttatagtaa

SEQ ID NO: 416 - DNA, 2069 bp, Homo sapiens
ctgttcggtttcgccttcctgctgtgcagtcttttgacgcttgctgtccaactttggagttttcttgcctttttttctctcagagttgagcccctgcccgggccctttagtccctcggtcacgaggaacggtagagtttagaacctgtgagtacgttagaaagttcgcagtcgaggaagaacagggttcgggcaagggcagctggtccggtaccaagggaaaacaggctgggatggtgaaggcgtcagtggctacaaggctggaagtttagcaccagaagggaatttggagatcaattcaaccgcctcatttcaggcatacttaaattgaaacccagaaagatgaggtaatttgcagaaggtcacccagcaacccctgagcaggcaggactgcaacacaaatgtctgacgtgggcttccactgtgtaatgctaagcagataggacgtaaattcctttgcagacttctcatttttccttaccccctgcctctcatattacacaccttccccatttagcttttcttcttttactttgcacttgcttttgtacatctaaaaggaattaattattcaacagcagtgggaacccttgaaacataatctggaaaaaaagattaataaagttttttttatgtcgcgtagtgaaaagagcatgtgctttagagacaaacctgggctccagctatttacttgtgagagctttaggtcaattggcttttattacagctttttaaccataataaaatggggatccctgcctagcagaagattgattaaatggatcataaattgtccaactagtgcctagcaaatagtacatactcagtattttcccctttttaatccccgttttacaggcgatggaactcaccagagaccagatagctagagaatggctgagctgggttttaaatctagtcaatcttgaccccagagctctccagcctaaaggtaatgtttagacttaacttccagtggtgtcattataagagtcaaaaacagactgaagaaataaaatagcagaataaagtagtggggcattaaagaatcatctagttaattcttggtgatgataacagaaatgttgggaaaagtgtcagaagccttaattttctccccattctttctgagtatctttagatcaaccaccacttcccaagtatttgcaaacaagcagcatagatattatagccctagaaagagttggaaacattatcacaacattagcaagagagtcaaggcatttttaaggaaacagaagcttccatttcatgaactaataaagcccaaggtgccaaagacactgatgtcatactggaaagtggtgtaaaataaaattataagcataatttcaacatcaaataaaacaaatgatgaaacatgccagttaatggcagagccagcgtccaacctcaatcccaatccagctcagaagctctaattctaccatggttatctggcaggacttgacacttcaattggattgtactcaaagctgtattttcttaaacaggcaaaatattctcacagaagcaatatttaaggcagagctctttttttttttttttaaggtttgacaagatcttcaaaagattaagaatagacaggaaaccaattaagaatgttaagagttacggccaagagtttgggcaaagaaagtttgccactcaactctcaatcatttgcccccagaaaagggattaggttgggctgttcaggctaattatatgaacattttataaaaagaaatcagacacagaaaatcaagccccacaaaagcagaagctggtactccaagctgtggctcagcccttcccttcccccacaggacagaactcagctgaacatctacttccttccctactaactcagcagttctcagaaaggaaatggcaaccatatgctttctcattaaccaaaacgaaaggcagccttgagaaacaagatggtctgggcaatacagaaactgttcagcccaggctagttggtttcagctacctctaaatcactcccaaagatgtggttaataaaaagaaaaaggagatgtcaaggagacaattattgctagg

SEQ ID NO: 417 - DNA, 1112 bp, Homo sapiens
agtcctgctgagcctctcctaggcactcacaagccacagcacccgccacttagtacttctcacaaatgccctatgagtttggtatgatgtgcttgttttatagatgtggaagctgaagcttacggggctgaagtatcttgcctcacatcacaggctgctaagaagcagagctgggattggcatccaggttgatctccctctaaaagcctcccctttcactacaacccacatagactctcattccaaccccacttcaagcatttcttcccattatcagacctgtgggacaaggtttggttgggaaaacacgaggctcttcaggaagacagacaacagattgcccatcatttcatggacaagggaccgacatgaggcgcacccagatctctgtggctttttcttggtgccaaacaaatgcagaaggagtcacttctcaaagaacacagtgtttttcttcctcttctcacctctcctgggccggtgcctgtgataattgggaagcacagagtctggtttttccgggattggaaccaatgctgtgaagagtgttctgacaataaatgttgattgacagttgatggacaatgttcttgaatcagtttttcctgtgctgggtgttaagctgagaactgcactaaacaactgctcaacaacctgcttcctgttcagatagaatttactacactctctctctgtgggcctcagtcaggcagccaggcgagatggtatctcagacgccttccagctccatcactcaatgtctctatcaagaagagaacacagatctgaaaacatttttccccctaacactgagttggggttattattcacatacaaaaacacaggcaccaacagagataactggtcaggaaataaggagctttgattctggtctcatactctttgacctagtaattctacttctgtgaatttatcttaaagaaagaatccagaggacagagctgtgtgcacgaaaaggtttgctttcgcaatatttggagttactgtcaataaaatgatgtccaatgcaagaatgcgagagactcccttggtggcacatgaggccaccgcaagtgataatttcaaagacacagaaaaacatacttggcagt

SEQ ID NO: 418 - DNA, 1160 bp, Homo sapiens
gccacgtgaaggatgtgtttgcttccccttccaccatgattgtaagtttcctgaggcctccccagccatgtggaactgtgaattaaacttctttcctggagtgtgaaaatgaactaataaactctgtgacctcagagactccctctctgtgaccctgttctcaaatgtatgaagatgggtgctcaaagatctctctctaaacatggaacagggcctgtctgaagacataagtgattaacttctaatctataactaaggtctgagtcctgaagaccttcctctggaggctgagtagttaatctagatgggtccaggtgctgcaggtaaaatacctcttttctgacaagactaggactcttacatagactaccatgaactaaaagaagcacaacattgccagagtaacctgtgatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaacttgatcatcctatatgtctgctttgtattttcttaatgtacgtctccccatttgctattggtcatttcctatttggctcatttttcaactgggttgttttcctgttattaaaagagttctttactga

SEQ ID NO: 419 - DNA, 1793 bp, Homo sapiens
tgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgttcat

SEQ ID NO: 420 - DNA, 1767 bp, Homo sapiens
gcttggcggggccccatgctgggctgtagggcgcacagctctcctttctaggtgccaggtcgaacactgagcttactattgtacaagatctaacccaggagggtgagaaaggaggagatgaggcaggacagcaagagggactggggtcccacacagcagctcagccactgccgacctcggggtcaggaaacagacacccacaagagcgtccacgacccgtatgggaagatgtctgaaccccgagacggcgtgttctgtgctggagaacaacttccagggctttatccaggtgttctaaagccacagcaccaaaaagaattctcttcggcaaaggcagcaggactcaacaggaagcagacgtttgcgttccgttacttgaggaaaaccaaatgctgctgacatttctacccagagagagtttgcatctctcctgcttcgcagccatctttcctacggttttaccaggagaatgcctagctcttctccaacctgtgccaggcctgacactcagctcctctgggagtgcctccatttccctgtgcgtacaagcccacggtgccgtaggatcaccggtccactctgcgcggcagcaccgcaccccggagccgcagctcttcctcccgcttgcccgacagccctggtgccaagccctgtctgagccccaccaggaggaagcgcgtgctggctgctctccatctgctctgggactctggcctgctgcttcctctgcctgccactccccaaccccgtttcctcctctgaaaactggagctacacctgccccaacagggcagaattaccttaaatggcacaagacaattgtacagcagacccacctcttctccaaagttttcagggcccaaacccagacacctccttgcaggactcatggctaccgtgggctcgcaccaccagcctccccatgcgttttcctgcctctgcttttgctcaatctgctcaatgacagaaacgcgacaacagaggccactttctccaaacccagctctccctcgaggctcccatcctgctgctcacgctgaggccactctaccctgccctccgcagctcacaggcagacctggagcccagtgactacagggttggcctcctcatcttgccaccactcacaatgcccagcagtgttaaaatccggcaggatgcacccgcttgggaagcagtccccaaagcagaatcgtcaccacatctgaatagtttctgccatcccactgacaggccagcatctaaaagagatgtgcgctgagcgtccgttatgtggtggcgtcgctgtggtttcttaaccagaacgcaaaatcctgtgaccaggattatcaccggctcgtttcatacatgagacgggggaagccaaagtaaccactcaggccacagcagaaaaacgcgtgctggaatctgaaacaaagtctgttggattccaagggttcaacgtcttttgtgatgatgaagacgaagcctgcccaagagcagtcagagctgaaagaagaaaagcaggagggcctgtgaatgcccccaaccccctaaaacctgcagctccaggtccgacactcccaggtttgcgttttgaatttacactacctatggggtccaggccatcacctaagtgagaaatttcacacgctcacccggggtgctcaaagccatctctctaaatgaggtgcctgatgtgcagacaacccttatatgatctacatctcttcacctgtctggaaatcaagaccctctcacgatttttttgtttgtttttccccgaga

SEQ ID NO: 421 - DNA, 1501 bp, Homo sapiens
cttaccctgtgcaacctcacagggccgggccttcaacgtcagcactatggctctctcttctgtcgctttctctccttcaccacgcagtctgtgaacagcactttctacactcctcgccggcaagcaggctcgtgtcgagggtagcagattccactggcgattccactggtgctgtgagccatctgctggctttgcacctcttagaatctggtgtttttttgttttttgttttgttttgtttttaatccttttccgggtaaccagaaagggaagctcaattcccttaaccccgagaccactaaaggggcaatacaaaaagaggaaataaatacatttttaagcatacaagagcttcacaatccagtagatcattttgtattctggattcattttgctttgtattcatatgctaatctcttcctttccacgaagggattatagggttccacaatggggtatctgtgtaattttctaaaagggcacaaagggtttaaatcattgtttctttgtagttggaggcaagggagagcaggaggaatgaaaatttacactgaaggtttttttttttttaattaaactctgcaggtgaggtcaactgtggaaccaaaataggttttagaatgagaagtttcaagagcaaaggaaggggagaaagagcacttaaaagttattaagtgggtttgttttttttttttttggcacttatggaaaaattgaaattaaaagaaatattctgtagcgttttgtagtgtagatttaacttatcctgcattaccacatcacagtatatgattttcaaaagcaaatgttagagccatgatagtggttactcaggaaggaagagggttgtgatggggagggacacaggttactctgataatatttcattttgggggctaggtggtgattacatatatttgcttagtaattatttgttaaactgaatatacagataaaatgcacttttcccaatgtatgttatagattgggggatttttttaattgtaaaatattcataatataaaatttaccatcttaatattaagtgtatggttcaggtgcattaggtacattcgtattgttgtagaaccatgaccatcatctatctccagaactttttcatcattccaaactgaaacttcatacccaataaaaataaatgtcctttccctcctccttccatcccttgataaccactgttctgttttctgtctctacgaacttgactattctaggtacctcatataagtgggattgtactgtatttgtctttttgtgactagcttttttgcataatgtcttcagagtagcatacatcagaatttccctcttttttaaggctgactaatattccattatatgtatataccacattttgttcattcactcagcaacggacatatggactgtttcctcaatgtatgttacgtttttgaatttttaaaatgtggcttgaattcctacaacaggacaacattaaaggaacaagaagcttgaaagc

SEQ ID NO: 422 - DNA, 4038 bp, Homo sapiens
ctcctgctccttctgccatgattgtaacttttctgaagcctccccagtcatgcttcttgtacagtctgcagaacggtcttgcaacttggcttcaatctgcacagaagaatcagttttaaaaggtgatgagaagcgagaaggagagaagagctgcggcccttcggggagcccagaccttgttgctctctgagccatggctgtgacaccctctttggagctctgtggttcctggtgtctccaagcttccaggctccaccatcacattccctggtgcctggaagctgcttgtggtactcctggtccatctacaacctcacagggaacgagcgcctatgcgggcacctgaagctgcctgccctgccacagcgtgcctggttatgtgcagtggcgggaccccaggctcactcactcacacagccgtcactgctccacgcctcgctcgcccttggcaggcgtggaatccagaccggtagcgtaagccaagcgcagcctgccaggccaactgtgtgcaatgagcccagtgggcctcagcaaaactcgggcaaaggtgccaccagccacagagtttctggccagaaaagtgacactccaaggatcctgtgacagtttcacacctaacaagctggaaagtgtgtgcctataactgttcaaaacaggtccttcctcacctacaaaaagaagtatttcttcttcatacattgagcaccacatcaacagggtctcactccattgcctacactggagtgcagtggcacgatcttgggttactgcaccctctgcctcctgggctcaagtgatcctcccacttcagcctcctgagtagttggaactacaggatctctattgagctgggtagaacttccttccttgggatggcagtaagaaccaaagcaagaaatgaaagcaacgtgtttccacacatctaagaactcaaaacatttccaaaagccaccataattggtttgaccttatccttgtcctggaattttcagtgatgtctttcttgtagaacagattaagcagcatagcttcatttaatgtatttatgatgatttctgaccatattaccaaaaggcgtaacagtggtaccaagggagttaacaattgcaaaggtgcattattgttctcttattacttggttgggctactaatttttttttttttttttttttttgagatggagtctcactctgtcacccaggctggagtgcagtggtgcaatctcggctcactgcaagctcagcctccagggttcatgccattctcctgcctcagcctcccaagtagctggggctacaggcacccgccaccacgcccggctaattgtttgtatttttagtagagacggggtttcaccgtgttagccaggatggtctcaatctcctgacctcgtgatctgccctccttggcctcccaaagtgctgggattacaggcatgagccaccacgcctggcctgggctactgatttttaaaaattagaatgtattaaagtaaacacacaaaatgaaatgtagccatataaaatatagactttaagttttgaccaatgtatgcacctttctagtcatcaacatgatcaatgttgtgtttactgtacattcagtaagatatttccatcacaataaaagtttttctcatatctatttgccatcagttccccaacctcttgcctcaggaaaccagcagtctgctttttgtcaccattgattcgtttatcttgtactagaaatcaatgtagatgaaatcatacagtatgtattctctttcatctgccttcttttcctcacaacattttttagattgatccaggccattgtgggtatcagtagctcattactctttattgctcagtaatattttgtcctagggttataccaaaatgtgtttatccattcacttaacaatggacatttaacatgtttccagttaaaggttattatgaataaagctgttataaacatttgtggaaaaatttttgtgccaagttatgtctttatttttagggtataaatacctaaaaggggaattgttgaattgtgtggtaactatatttttaattttgaaaaaattttccaaactgttttcagagggaattatgtcattttatattagtatgacagtttccattgccccgtgtctttacaaacacttgattttgtctatctctctatttttaaccatcctgaatgttgtgtaatagtatcttattttggttttcatttgtttatgcctgattactagtgatgttgagcacagtttcatgttgtcttttcatgttgccatttctatgtacttttgtgaaatatctattcaaatattgattttttttaaaaaaaatgggttatttgtctttatattatagaattgtagaaattttctatataatttgaaaatcagtgctttggctgatatacatattgacaatatttttcctagtctgcagtttgacttctcattttctgaatgatgtcttttggagggaagaagttcttagttttgatgaagtacattatattattatttacattatagtttgtgtattttatttcctatgtaagatatccttacctacctaattttattaatactttcccttatattttcttctagaagatgtatacttttagtttgtgactgcaggtgtagaatttattttgagttatttctgtatgatgcaaagtgaaggtcaaaatttatttacttattttccaaaaaagattatcctgcttttctagccccattattttaaaagattatctttctcctcaataatacattggcttacttattgaaacaaactgaccttacacgtgtaggtttatttctggacactactgtctgttctgttctactgaggtatatacctatcatgatgcaaatttcatgcttatactaagactgaaatggggtagtgagaattcttcaattttgttcttctttttcacaatggttttggtcattgtcggttctttgtattttctaaattattttagaatcttcttgacaatttctgtaaaaattatgtgctttgattttgatcagccttgtattgaaaccatagatcaattttgaagaattgccaccttattgaggtttctaatccatgagtatgtcatatttttctacacaattagatattgtataatttgtcccagcagttttctgggataaacatttatgtacaaatcttcatgccaagttatgtctttatttctttggggtaaatacttaagagtggaatagttggattgtgtggtgtgtatatgtttaattttgtaagacatttccaaagtgttttcagagggaattgtgccattttatattaatatgaaagtttatattgctccatgtctttacaaacacttgattttgcccatctctttagggggattacacatcttttttgatacatttttaataaatatattaagctttttggcactgctagaaatattttttatttcattttattattgtgtatttcttgtattagatataaaattgatatttatatgttgaccttgtatcctgtgcccattgctaaattcacttattccatctaatagatttttgagagtccttggatttttatgcgtatgtgatctcatatacgaccacaaaatatcttgacattttaatctcttcctttccaatatgtgaatttcttacttattttaatctttgtcacactgttcaggagctccagtggaatatttaatataactgataacaaggagtatctatgctttcgtttctaatcttgagttgtagaaggtcacactgacttaacagcatttcataacagtgcaggtcttttgtaagcactgttttaacagattcagtaagtgttctttttttttttttctctttttaaaattttctgttttattaaaaacaatatattttcattatataactttagaaaatgcagaaaactgtgggtaagaattaaacgtgtgtgtgtatacttttttaaaaagttggtcgtaatgtatatattgttttctttgattttgtttaatgtataaccgtttccc

SEQ ID NO: 423 - DNA, 12939 bp, Homo sapiens
cccggcctcctgtggcactggctagccagatctctgggaaccatcccagcgcaggtggctctgcaggaggccaactcattacccagcaatggccttgcctgatgtgggtaacaagctcattacctggtgatgaccttgtttgtctgttcctggtgtcagcagcctcagctctccctgcaaggaatgtctagcctggggtgggtctgaccagtctgtgccacaggcaccagcatcccagtctgcactgcatggggtgtcgggtctgacagcatctacctatatgtgccctgagggcccagactcagcccccagtgggaagactccgggctcctgatggacccctcccaattgcacaacctgagcaggtggtttgaagaagttggctgggaaggagatggaggactccagctccctggggaattcttcatgaatggcgtcgaaccatgggactctggctcccgtgaagttgaacttgtcaaagatgtcgacagcaagaactggggggacagttcatttaatcagacatcactcccagggctttcttgaacccttgctgttatcaaaatgaccacaactgtcacactgacactggctggacatatttattaattaatttattttttattattaatttttttgaaacggtgtctcacagtgtcgctcaggctggagtgcagtggtgcaatctctgctcactgcaacctctgcctcctgggttcaagcagttcccctgcctcagcctcccgagtagctgagattacaggcacacaccaccatgcccggctaattttttgtatttttggtagagaatgggtttcaccatgttggccaggctgttctcaaactcttgatctcaagtgatctgcctccctcggcctcccaaagtgctggaattacaggcatgagccaccgtgcccagcctacttatttatatgtattttttaagacagggtctcactctgtcacccaggctggagtacagtggtgcaatctcagctcactgtagcctcaacctcctgggctcaagcgatcctcccaccttagcctcctgagtagctgggaatacaggagcatgccaccacacctggctaatttttttttaaatagagatggggtctcactatggcacccaggctggtctcgaactcctgggctcaagcaatctgcccacctcagcctcccacaatgcagggattacaggtgtgaaccgccatatccagttgactaaccatctttagaacagaagcgacttccaacttcctgcatcccatgtgtacctacacctgtctgcagtgagcctgaagtgaggcaggatcctcgacactcactcttctagagtctcacacctgagggtctggaaggcctgccaaacccccaagatcacggcctaacatctcccaagcccaggacctgtcccctgggagccatgggtgtgtcattgcagactgtcttcccaaaggctccatttacagatgaggaaatggaggccttgctgctgaaccttttttttttttttttttttttttttgagatggaatttccctctatcgcccaggctggagtgcagtggcaccatctcagctcactgcaagctccgcctcccatgttcacgccattctcctgcctcagcctcccgagtagctgggactacaggcgcctgccaccacgcccagctaatttttgtatttttagtagagacggggtttcaccatgttagccaggatggtctcgatcacctgacctcgtaatctgcccctcctcggcctcccaaagtgctgggattacaggcatgagccaccgcacccggctttttttttttttttttgacagagtctccccgtcacccaggctggaatgcaatagtgcaatcttggcccactgcaacctctgcctcccaggttcaagtgattctcctgcctcagcctcccaagtagctgggattacaggcatgcaccatcacacctggctactttttgcatttttagtagagacagggtttcaccatgttgcccaggctggtctccaactcctgactgcatgtgatctgcctgtctcggcctccaaaagttctgggattataggcgtgagccactgcgcccagcctctgaatcatttttctaagagcatggccaagtgggggccgggagcccacctgctccacccatggggacccagctcctgggcgcacccctgagggttgcaggcctccacccccaacgcagccagtgccttactcatgttggtggtgacgatgacaaagggctgcaggtacgtccactgcacgttgcgtgccacattgctgaagtagccctcgaggcgccggagcagctgtgccgtgccaccctcgctccgctggatctgctcccacgctgccctggtggccggggccaggagggcactgcccgagtggatgatgttctggtcagacagacagcgctcagtgctcagcctgcggaggcctggctcgtgggaccgagggacatcagccctgaaaggctttgctcgcctagagagctcattcattcattccagccctacactttagattgtgctctttaatattagtctccaattttttttttttttttttttgagacagactttcgctcttgttgcccaggctagaatgcagtggcacaatctcggctcactgcaacctccacctcctgggagcaattctcccgcctcaacctccggagtagctgggattacaggcacacatgtgccaccactcccagctaatttttgtatttttaatagagacagggtttcaccatgttggccaggctggtcttgaactcctgtcctcaggtgttccacctgcctaggcctcccaaagtgctgggattacaggcatgacccactgaaactggcctagttttcaatttttttttttaagtttaagaggaatagaaaaatgttactaagctcacaaagtatattaaaatccagagaattaaacgtgcttcatatttttagcttaatttattagatttacaagcactgtttaaatgcttggaaggtctgtttgctagccaaacaactgatataggaaaataaaaatcaaatatatgacgtatattaattccatttaaaatacttaagggaatttcatggtttaagttaataaataggatcaaacattaatcagagttgaattcaaagagacaaggaagtcattttttagtacttgattttcataaatcccgaaccctaccacataaactagagagactgtgggtgattcaatgtcagaggccgggactctgtcagagtgagccctgccagaggtttttccacgtacacctcaagacgctaaggcagggaagacatgtggagacatccctgttatatcagaattcctcctgaaccccacatttaaagcagtgacggaatcaccacaccctgggctgagcagagaagccacactgaggctgccatggacatgcggacagctcctctgcgggtgaccctctgcctctgcgcaccccagggtctatgtgaatgactgggtggaggtgtgaggctgtgcttaagagtttggggaccacacccaagacagaaaccagggcagacacggtggctcacgcctgtaatcccaccactttgggaggctgaggcgggtggatcacctgaggtcaggagttcgagaccatcctggccaacatggtaaaaccccatctctactaaaaatacaaaaaattagctgggcgtggtggtgggcgcctgtaatcccagctacttgggaggctgcggcaggggaattgcttgaacccgggaggtggaggttgcagtgagtcaagatcacaccactgcactccggcctgggcaacagagcaagaccatgtctcggaaaaaaaaaaaaaaaaaaaaagacagaaaccaggagggaaagctgtttacagagtcacacgtggagaacaaatgccactggcccaactcgcaggctgggactcaaattccagcgaggggatccttcctggtctctgggggccctgtgcagaccagaaggtctcgtgggggccctgcatggactggaggtcctgtgggggccctgcgtggatgagacaaccaggtttagtgttgggagcaggacaccagcatgggctagcccagtcccaccacctgaacagaggggctgtgatcctccaagctacccagggaatgtgacacctgggtgcacagctcgtcccaatggccagaatgtatggaaatccaagcgtggtggctcatgcctgtaatcccagcactttgggaggctgaggtgggtggatcaggagtttgagaccagcctggccaacatggtgaaaccccgtctctactaaaaaatacaataattagccagtgggggcgggggggtggcacgggcctgtaatcccagctactcaggaggctgaggcaagacaatcagtcgaacccgggaggcagaggttgcagtgagcctagattgagacggtaacactgcactccagcctgggcgacagagcaagattctgtctcaaaaaataaaaaaaattaaataaataaagaatgtatggaaaacgttagcacaaatggagaaagttagcttaacccttgagagcaggcaggcagggaaaggcaggcctgggtgccctcctggcccaagtgggctcaagaggccctgcatactctggtggggggtgctctgaggggcagcaggggtcctggtggagagtgctggcaggaggactcccagagccatgcagcctggatgtgggatcggatcctcttgcattgcctgctctactggctcagaacccaaatccctcaaagtgaggagtcccactcactgggaagcagtttttggttcagacttcccatggaccctgggaaacttcctcagttgtcctgaaagctctgcagggtgagaccactccttccctcccacccctgagaagggcctgcacacagtaggtgctcagtccacgcacgagagcaggtgacgctggggcccctggggcttagcagccggaagcccaggagttctctgcctggtgcatgcgtggctcaccctgggagcagggctggggtgtgccggctgctctcccagctgtggacgctcacgcccaccctaggtacaggctggcaggggctgccaggctggggaggctgtgcctgggttttccctggggtaatttcaagtaaagggtgttcttttcctgtgcgccagtagacgctttggtctcattcatgaggtttgattttttttaaacatgcaatcctacactttgggaggccgaggaaggtggatcacttgaggccaggagttcttgatcagcctggccaacatggtgaaaccccgtctctagtaaaaatacaaaaacacagcagggtgtggtggcacacacctgtaatcccagctactccggggctgaggcaggagaattgcttggacccaggaggcagaggctctagtgagccaagatcgcgccactgcactccttcccggatgacagagtgagaccctgtctcaaaacaaacaaatacgcaattctttttttttttttttttgagttggagtctcactgtcacccaggctggagtgcagtggcgcgatctcggttcactgcaagctccgcctcctgggttcatgccattctcctgcctcagcctccctaagagctaggactacaggcgcccaccaccacgcccagctatttttttttcttttctcttttgtatttttagtagagacgggatttcaccgtgttagccaggatggtctcgatctcctgacctcatgatgcacctgcctcaacctcccaaagtgctgggattacaggcgtgagccaccccacccagacagtttgcttgttttttgagacaaagtcttgctctgtcacccaagctggagtgcaatggcacgatcttggctcactgtaacctccccctcccaagttcaagcaattctcctgcctcagcctcccgagtagctgggattacaggtatccggccacctcaaccagctaatttttgtatttttagtagagacagggtttcaccatgctagccaggctggcctcaaactcctgacctcagtgatccacccccttcagcctcacaaagtgctgggattacagttgtgagccaccacacccagtcccagtctttttcctatatgtgatttacattggttttcacaaaaaatttatagctattttttttttaatttttaaattttttgtagagatgggatctcactatgttgcccaggctggtcttcagctcctggtctcatgcagtcctcccacctcagcctcccaaagtgctgggattataggcctgagccactgtgccactgtgcctgaccctgcattttcacttattgttactttttcagcactcctcctttaattcctagtacctgctaagacttctgttgaagctcacctgcttaattcctctttgtgattacacaattttatattttggaaagcgtcattgccagggctaggcatagtggttcacacctgtaatcccagtattttggggagccaaggcaggaagatcgcctgagctcaggagttcaagaccagctgggcaacatagggagactccatatcttaaaaaaaaaaaaaaaaaaaaaggaatggtggcacatgcatgttgtcccagctagttgtgaggctgaggtgggaggattgcttgaggcctggaggtcaaggctgcagtgagccatgattgtgctactgcactacagcctggatgacacagcaagaccccgtctcaaaaaagaaaagaaaaaaaaaagaaataggaaaagagtcattgcctggggttcattttttactttttaaagagtgcagagtagtttttaatgtatttaaaacatttctgaaaatggaacaaactggataatgttattttttatttgttattttaattaggggcatttcttctttcctccgttaagcatcaaaacttggagaccagatggcagatttgcacctttacaaccagaagctcagggagaagttgaaggaggagaacacagtgggtatgttcagattgcttttgggtaccttgacccagccacattgtctaccctagattggtgctcatggtacttcttggtggcatttcaataataggttgagttgtataccatctccctttacactacattatgaaaatgacattattaaataagaattttgatggagctgataagctagtagaattggcacatgaccccttttatacccagccctcttgtctggtgtgcttgaggtaataataaccccttttatacccaaccctgctgtccagtgtgcttcaggtaggagtgtcctggcagatccatatattgactaattgctactgtatgtagtacatccttagaccacccatattctagcatgtgcagcccaggcttgtactgatgctctgctgaggtctggcatttaagagaaagacaaacagctccttcaggccaaggatctctgtcaacaggctgaagaggtgagggtgctgagcctcagtatgtgaccaagtttggcttccacatggtgatgtgctgtggcttcatcccacaggtgagtgcctgggtgagggtgttccctgatgctctaatgctggtcacccactcattttttttttttttttgagatggagccttgctctgttgcccaggctggagtgcagtggcgcgatcttagctctcctgggttcatgccattctcctgcctcagcctcctgagtagctgggactacaggcacccgccaccacgcccagctaattttttgtatttttagtagagatggggtttcaccgtgttagccaggacggtctcgatctcctgacctcgtgatcctcccacctcagcctcccaaagtgctgggattacaggtgtgagccaccgcacctggcggtcacccactctttatatgtgacagaatgccagtcccctaggcaccagcaagattgactacctgatttctgaaagcagaatacaagctgtgatacctggaatggggagagcagaagccgagagtcactgagctgagccaggcaggctcatgggacatgctggggcaggcagatcagcattctaagcagaggaagcctcaagtgcaaaggtgatgttgcacaaggctcctgatgagtatgaaggactggagacagttgggtgacaggtagtgtgccaagtcagggattaagtcctgattatcagctcctctcctgaggcctttacaaattattatttatttagatacaattgagatataattcacataagatccaccactttaaagggtagaattaattggttttagtacattcacaatggtgtgcaatcatcactgctgtttaattccagaacatttttattaccctaaagcagaacccattagcagtcactccccatttccctgttccctggcccctggcaacctctaatgtatcttccgtcgctttgaattgacctattctggatatttcatatgagtggaatcacattacatgtgaccttttgtgtctggcttctttcactcaggatcatgcttcaaggttcttccatgttgtagcacgtattagaatgttatttttttatggctgagtaatattccactgtatggctaggccacatttttgtttatgtattcctttatatggctgaataatactggggcctcttgaaccatcaccttttaaacctgtgaagttccaaagaaggctttggacaacccaactgccctgtgcttccctcaaagaagccattattggaccatattttggtttcgttagggacacagtgcccattatataagagctagtccagtttaaagctactgcttcccgaagagagcatactttcaaatctgtctcctcgtggaagcccgtcctgattagttgggtccctgcagacaatgaccaagctctccctggcgcagatggagggtgagttccccagctggaggtcactcagggcaagattctcatgaaacccaagcagatttacggttcccagccaacaggcagtcctcacactgggctcgctagaactgcacaaggagtttaccagatttaccaagacccccgagatctcaaccacagctggctcccctggagtcacacagctgtccggagccagtgagcagtaccatcctcatagtccaggtgaggacggctgggtgtaggttgtggtcctgtttttcaggtcaaggggtgcaagtggtggggtctacaggtcttggtcctgttgctgaggtcaaggggtacaagtgatggggtctacaggacttggctggcccagcagagtggtgtttcaaagaaatgaagtgaaatcttacccagaacccctgtgtgtgaagcagatgagaagcgggctggtctgtttggagcacaggtagcccctcaatgtcccttcagactccaggatcaaggaaccacctcggatcagctgcagcctggctaggaagggtgaggggccagggaggacacctgccctgcttcctgcgtgtcgtgcctcggacagcaccaggttccggaggcttcccactccttgggagggctgaatgagtcctgggggagtgtgtgctgcagccactcgggggcagtgctgaagagtgggctcctcagatgcctggggcactaaggcccactggagccaccagctaggtcggctgcagtgattgccccatgctctgtacactgccacataccaggcaccgttctaagtgcttcatcggactcaactcacccacttgccccagcaggtaaccaggcagatgtcactgatcggttttacagatgaggaaactgatgtgcagagtgacactcctgagaccgtgaagcttgtaaatggggcagctgggttttgaccctcagtctggctttagagcacaggccctgaccatgacacggccctgcccctctgtcaaggggaggcctgaccattgggaccagctgtgcacccaggtggcaccttccctgggtagcttggaggatcacagcccctctgttcaggtggtgggactgggctagcccatgctggtctcctgctcccaacactaaacctggctgtcttccagaaagaggacagagctcagacactgagagcttgggcaggcaaatgggaaatgacgggaggctgcacggtgcacctctgtgccgggggtctgacagccaggctgtggggaggggacctttccatcctgctcttgaggtgcacacagcaccagagggtgagcccaggggccgagtcaccacagcacccatgtgcagggagagtctcgatggtgagggccgctgaccaggacggtcctcctcaaaagagttttacaaaataaccctttgcataaaataagcattgtatttttctctgttgaggtgtaattgacataaattgcacccatttaaaacgtataatttggtaccttttgacatgtttgtacctgtgaacctctgaccacagttgaggtggttacccccaaaaggttccccgtgcccttccctgccccgggcaaccattcttctatattgtcactgtagattagtttacatcttgtggaatttaatctaaacagaaacatacagtatgtactcctttttgtctgacttctttcactcagcataatcattctgatatttatccatgtctaaaatcctttgatattcatccatgatacacatccacgttgcatgtgtcaaaagtcaattccactgtattgatatcacatagcctgtttatccattcacatgtggacagacttctgggtcatttccagtttttgcttatacgaataaagctgctataaacctttgtatacaaatctttgtctggacaaatgcttccacttatcttgggtaaatacctaggaggggaatgactgtcatatggtaggttcatatttaactctttaagaaactaccaaactattttccaaagtggttgcatcatgttatattcccaccaacagcgtatgagagttccagttcctccacatccttcctaacacttgatattttctgttttaaattacagccatcctagtgggtgtgaaatattatctcactgaggttctattttgcatttccataatgactaaagatgtggagcatctattcaggtgcctgtttgctgacaaaatgtcttctttggtgaaccatctgttcaattattttgcccaatttgtgaataggtttttttcttattattgagttttgagagttattatttgtatatttaggatataagtcttttaccagatatatgatttgcaaatagtttctcctgatttgttgtttgtgtattctcttgaaagtgtccttcagaggccaggcacggtggctcacgcttgtaatcccagcactctgggaggttgaggtgggtggatcacttggggtcaagagttcaagaccagcctggccaacatggtgaaaccccatctctactaaaaatacaaaaaaattagcttggtggtgggcacctgtaatcccagctactcaggaggctgaggcaggagaatcgcttgaacccaggaggcagggaggttgcaggggccagctgtggccacaggctggggacagaggccaggtctgaggctggtcctcagtgaggagtaaaggggatggaccgggagacagggtgcaggtttgacactgattttgcttttggggatgggtcgagggaagaggctgagactctgggcttggacattgggtacggaggatgtgacactagcagacaggctggatctggaggcctaaggtgtgcagtgtggggagctgtgtgtgcaggagagatgcagagcactagggagcctgaacccctgctccagtgcacaggcctggcacacggcagggaggaggcagtcaccattccctgacccgcccgggcctgggaggcagggcagagctggtgacgggccagcgtggggccttggaatgacatctggcatgtggcggtggaggggggacatgtaactggggactgtggactcccagctggaatccacctccaccttccacatccacgcactgccttttggtctttactgagcacctgctgtgtgcaggggctgctctagcccctgggaccaccaagggccagccctccgcaaccccagccctgcattcagcccccacccacttcctccagagccccacaccccacatactgaggactctaggcgttttcccactcttgaaggcactgagctgggaacaccacctctggccaccagctgtggactgcagagaggcctacggtgaccaggaagggtggagctgcccaaggtcatacagcaagccggcactgcacaagctgatcccatggctgcccagccttggggaatgggggacttctggcatgtccccgagctggcctcatctgggccctggtagaaggcaaataaaggcaacatctcaacaaggttgtgatagctgggacaaattgaggacacagtgccggggatccaggcaagcaagggacaatccaggaaggctcccaggaggaggtgaggggcctgaagcccaccctggcctgagcccctcctcggtactctagcctgcctagccctacccgcttcctcgacgggcccctcacccagcctcagccttggcctgacatttcccgtgacatttgctacaaagaaattgagtcataaatccaaaggttaaatttgcacatcgcctcaaactgctgggggaagcagtggtccctccacccactgggcgccccgtgggtgcggggtttgtgtggcagggtctacccatcctggggcacttgctggaggcccacaggtctcctctggtcctccgaggcacttcaaccactgtttcccaaaacaggttcctgggcacaccaggccctgaggtacatcgcataggggtgcctctcagagaaggtgctgcccacccctctccaaaacagagcccaagatgccctgcgggaaaggagcaccatcagcacc

SEQ ID NO: 424 - DNA, 1208 bp, Homo sapiens
gctactacaaagatatcaataaccatccaaaaatcacttaaaatttaatatcccttaatttccaaagacactttgtgatctgactgttcttgaaggaaagcctagaactgaaactactagaacttggctcctctctaggaatgtggagacaggtattctgcaaaggagaacttgacaaggaatgctacaaaataccagtcacctctttagaagctcctcccacctctcctgctccatttgatggaatggcaggctggattcagagaggcacgtgccaaaggagctgtttaaatccctctagacatcccttttcaatggatatctcttttgagtataaagagagctttcaatgtgtcttgctatcattttcctgaccctaatcccagattaactagaatcacctttagcatctaagtgagtgggtgctatgaccttccatcaacgcatgtggcatagatgctaaagcaccagtcttacatggtgggaaccatgttaaaaatcaatggataaagtagcagagcctctaaactaagaagaaagagacatagcttaattacagaacactgtattttcataatcactatttcattgtgagtatgaagttctcctcttttccttaaaactaaattccatcttccctgagaatagggttaagagaaatattaaaacgcaaaatgtcaagggccttttaaaagataacacaatgggatgtctatagctaactgcaacgtaaatgtgtttctactctaaaagcttttccattactcaggttttaacctcacctcccctctggactctaggaatacatgtagagatgggaaaagtcaatggggaaaatgtgcgaatgatcgatttcttcgattgtcggattgagggtggcacaatgtcttaggcggcggcgggtaagtgactcaagcgaacctgttcgttccctaggcgcccctgtctccaagaggcggccccgaaggtgatccgccccccagagcaggaaaccagcccaccagtcccagcaaactctcctccgagcctgggatgaggaaaggagtcctgcaggtctctaacgatgggtcctaggggttcagcagcaaagttgacacaaagctgtctctgccctatacccggtgctgcccatggtactgcactcgaccgggccttgacccggagtcgccgatactacagctgccatggccgccaagtggcatctcttc

SEQ ID NO: 425 - DNA, 1114 bp, Homo sapiens
catctgcgtcagcctcccaaagtgctgggattacaggtgtgagccaccacacccagacattcatctttatttttaaaggacatttttactgaacataaaattctctgagttggcagttttttctttcagcaatcttaagatgtttatgccttctggcttcaacagttggagcaagaagattgctgtaattcttatcttggttcctctggatatttttaaggttttctttctatcagcaatttgattacgatgtgcctcataaggatttatttgtgtttatcctgcttggggtttattgagctttgtggacttgtacatttatagttgtcactacagttggaaatttttaagccattatttctttaaatacgtttctatctcaagaagtacagttatctccaaatgagcgtcatctacatgtccacaactctgatcagaccactcttagagccagtaatgattattttaatacctaccatactttgtgtatatttactcctcagtaaatatttgtagagctgcacatagggaatttctttaacacctttaaagtttatttatttaaataagaaatacatgcccatggtaaatatttcaaatagtacaaaaatatttcaaatagtacaaaaaaggaggtattctgtgaaaagtaagtctttgtttcaccaaagataccaatccctgccccctccccgtcctaaggccatcactgttagcatttccttttttctcctcccaaaattgtctgtgcatgttcaagtatatatggatatatatccttgtgctagcatactatatacactgttctgcatctttttaaagtttaataatcttggcgatcattctatatcagtacatataaagtgggctttttatgaatggcctaacattacatcatacagatgtatcataatttaattaagtggtgccctgttggtggatattcaagtcgtctggtcttttgctattgcaaataatgttgcagtaaagtaaaatgtaaaataaaagtaaatgtcttacttacttaaaaacctattttaaaagtaaatgatggactttaggaggttaagaattaaaaattaataaacatataaataaatgaggtactctagca

SEQ ID NO: 426 - DNA, 1464 bp, Homo sapiens
tgactgtatttcaaaggcagtgactgtaaacaaacttggttgaagaaataagaaccacatgacaaaatgcttgaattaaatcttttttttttttttttttttttttgccacatttcacatttgagaacccagaattcagctcctgttatacaaaatttgtaaaaatttattgccttggcgtaaagtgacaatcatgccttggcgtaaagtgaaaatcttcacagaagggtatgctttgtgtcaccaaatgggggtgcagctgtgtgatatctgtgcagtttgtgataaaattaaaaattttctgtgaaagattcttaactggaaattggaagggaaaacaagaagaaacaatgtaatgtagcagtggaaacaaaattctcacaatgaatagcagtctttccagcttctttgacacggatttcctcatcatcaatggcggctctcctgaactagggatgagtgtgaatctccatttgaggaaggggaagaagagcttggagggtgacagcctccccctgagagagccagttgtgttcatgattttggttccttcttcctcctaattaagcatctgcccaggagcccaggagccagggcttagcttcctggctattttcaactcttcttagtgaagaccagcattgccagcccactgaccccagtagggtcacccctgcccactgagaaccagccaccccctcaccccccaccagagttccctgaaggaaccagctgcctctagtgggagacagagtaaaggcagaggggcccctcctttctcaggtgccctgtgctagtgttgggcagctctaaggttggaaactgctttccccactgagctgaaggctgcctcctgggatatgcacccggcggtccccattcagccccgggagccactcggatcaagtctggctgtatcccgagggcgaccaggacagccctgtgagcagcagttcccctcctggaacactgcttcaccagcccatcaccccagccctgtggactgctcctccctcacctggtttctacgtggacccaccattcttgccctcctggacccctaaactggcccatgtgtttagttgtagaatgggggccaggactggacatgtggtttgattgctaaggacctagcagaggctcatcatgtggtagactctgtattttatcgtgtgtgtatgtgtgtgtatatttacacacacatacacacaagatagatatatatattaagtggacactgtatgtgtatatatacacatacatatattatagatgtatgcatatatgtatatatgtatacatatatgtatatgtgcatacatatagaggtatacatatagatgcatatctgtatacatgtgtatatatatacatatatggatacatacatatttatgtgtacacatatatgtatatgtgtatatgtgtacacatatatgtatgtgtatacatacataagtatat

SEQ ID NO: 427 - DNA, 2631 bp, Homo sapiens
gagtgtgccaggcagtggagatacagtgataaatgcttgctgaagagcgctaagggacaatgtccagaaaaagagcaggcctaacggcatctttttagcaagtttcctggcagtaaagtgaaaaaggatgaatgacagcaacttagtttacttgcagcttcctgtaaatttagtcatctgaacaagaggggactgaactgtttcaaaacagaaagcaattgtttcatggacactggccagtctacaagcagagcactctcatggggagcaccagatgagttccagccgcagttcttttataagctttaagtgcctcatgaagacgcgaggatctcttccaagtgcaacctggtcacatcagggcacattcagcagcagaagtctgtttccagtatagtccttggtatggctaaattccactgtccctttctcagcagtcaataatccatgataaattctgtacaacactgtagtcaataacagcagcaccagacagcatattaattcttttaccataaatttgtgtgtaattataatgttctatgtgtggtgttatcaaaagaatcactgtgtctctaaatatcatatatgtatgtctggataaatacattgctgtacaacatctccaacatgcaggtcatgctctaggacttggggatatagagtaatacatgtttcgtggccaataataaaagtgacaattgtcttcctaacaaaaaataaacatgagaaataggaattaatcagcagtctcaaggctcccaaatgccttagtgatattatttatccctctatttatattacggtctttttcttccctcacatgctcaatacatgagacacgctattgctgttgaattcataggaatgcataaatagactttcttccactcagactgaatatgactccctaaggattttgttggagtgtagtaatgaatgctggttgctaggtagtagaaactgacactgcagcaggcaaccaagtgcaatggtgaaattgctgcttaaaccctgcttatcaaaaagattcacagtgccgattaacttaggtagtctacagagcatcattaatttatacacaaagcagagaggctgctccaaatagcaaaaaatggtatggagtcgggtttggagggagtaaatattaaaatcataaacatcttacagaggcatttctgtgcttcatggagacagatggcatatacaggaaagacagggagctaagacagacaagaacaacatacaggacaaagcacctgattaaacactgcctgaaaatctgattaatcttttgactcaggaatttaaggctagtcaaaaaagccttctgtgaacaccagtgacatttgatgtttgcacaaaaaattaataaataaaaataaaataagggggtaaaaaaaagacacaagagctttgggtgatatttggcactctgcctctgaaaatgatgacaaaccctgggtattttttttttttaaagagtctagaaccaagcagcaatttctggctaaacaatgcaagcctggctggcagttacctttctctcatgttttgtgccttccccaagtcattaagtaagagatctggcctcggcttgcgtgtaaccagtaatgacaacctctttgcagttatctgtgtgcaaacaaccagagacattcagaactccaatacagcatttttgaagaaaagtaaatcaatcaagaaattaaactatttaaaacatatatttctttcaaataataagaaaaaaatgtcaaggagaaaagtgccctccctgccccacaattcaacatgcagaacagtcgaccaatgctttcatatcagcaggatggttcgatgcaagtacacatatcctgagctatccacagtccccgaactctgcaacattgctttcaggtgatagagacaagatggtccatgcaaatgagctgacacaagtcatgtcgtgtgcaatcaagataggatcccagacatcttcagaatggtttacagtcacaagaaataaagttccaatgaagtggttggcatttggaagcacactgttttaaatatatctccctgaaggtatgtttatatattagtgcactggtcaatatctgacactatctgtcattttattgcaaaaggatatcagggcaattaataggagggatcttagcactactttagacaatctttaaagcctgggtaagattcattagctacccaagtggcatttctgacttcaaattgtagtatcatgcaagatttatactgtattaatggagcctggagtaactctacatttaattatttccattatggggtaaacagcacttgaattaatacaatttagccgactgatgcagtttggttgtttggtttacaagatagatgggatgggagatcgagagcgcctcagaggacaaggagagttgtagggtgatgttactggagagagcctcagagcattgcctgccaagcccgctatgttgtttaagcttcgggatttttcatatccttttatgaaaaaatgcacagacatcagttgaattcaaccagaatatagacagacaaataataccatgcagggcaatcaaaagtgctactttcaagctcaaagaagaatttgtttacaaagaatttaat

SEQ ID NO: 428 - DNA, 1864 bp, Homo sapiens
ctcttatgaagaaaccgttcttacggaagcccagatgagacaacttgagacaggattcagaaacgctgattttagtaaccttaaccctcggcccttggtgggaacttcggctctgtgggaattagtctttgggggactgatggtcatgctgaaatcttattgcgtaggaaattaagtacaacaaagaagacccgtcgtgagaggagagtgcggaagaaatgcgaagtctacgggaggtggcagctgcagaagcttggtgttggatttggcgttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttactaacaccacatctcacccccacgaaacttggtaagggcagcaacagaactttatctgccatatgcactcctgtattcctattaccaaatagtgccagggactaagtgaatatttgtccaatgaatgagttttaagtaggaaacgtttgcatagaatcattttgtttcttttggagttcaaatcttcggatattttacccttcccaatccaaagaaaagtctctgagtgaagagatgggaacaaaatgtaagttaaatatgttgctttaacaactgtttattgaactcgtgctatagactatagaatgatgagcaaaaccaggcacagtttcggccctggaagaggaaaggcaggcatatatttatcaagtaagtacattaatggcggcacttatcagttgagagaagtgcgctaaggaaaggaatatgattctatgatagcgtataataaaagatccttgaccggggaggggaaacgtaccagtgattaactgatctgaagaatcagtataaattgactttgtagaaagtataggtggatggctgagtgggaccatcattcaggaagcaaatgcctgcagaaaaaaacatcaattttaacaagaaacggtgtatcagagatgaaactgaacctattccttgtcttttcttcttgcttcagacataactttaaaaaattgcttacgctgtctttagccacatctcttccccaaactccacactgttcggcgttttagccgtctcaaatttccttttcttaaagacccatgacaatcttcagtgttgtgtctttttctacgtcgtgatccttttttaaagctgagctcttcttgtttttcgtctcctttctctttttttttttttttttttgtgatggagtctcgctctgtcgcccaggctggagtgcagttgcacaatttcggctcactgcaaactccacctcccacgttcaagcaattctctgcctcagcctcccaagcagctgggattacaggcgtctgccagcaggcccggctaatttttgtatgtttagtagagacggtgtttcaccattttggccaggctggtcctgaactcctgacctcgtgatccacccgcctcggcctcccaaagtgctgggattacaggtgtgagccaccacatccggcccttcctttctcttaagatgaaaatattggttcttttttcctacacacaaggaggcaatgaaaatattggttcttttcattgccttattattaatgttactattaataaatattaatattaacataatggttatttgcttcatctacctatattcacaggtatataaacacaacaatagcaataacaggataaagaataaaaacagaataacaatagagatattgctaacagat

SEQ ID NO: 429 - DNA, 5339 bp, Homo sapiens
tcaacttgcctctgcttcctcctgggaacctttcctggccctttagctaagataagaaaatggaatcacagcaaatataagcaacatacccaggagcacgcagctggcaaacagctgagctagcacttggactcaggcaaactggctcccgagcctgcacgtgtaaccactgtgtgacactgcctctcagagcagcttcgtgttgccttcggaacaggtcttcggaagagtgtctggaaaatgccttgacacattctaattatttgttcctttatcatgggaatgtttttgaaatcttggaaccagaaaactgccaagctatcttcttaattcttgtttcgtgacacttaacttcgaatacagaatttattatggctggttaacttagaactctcttgattctaaaaacagcttcctgacttattcttcagtctgccagagctgttctttgcagcagtattttaaccccttcacatctttctttatgtcaccatgacattaacttataccacaaccacatctctggaaggggtagccattcatatgcaaaagcatatcacagatgacaccttagaagcccttcttgactggattcacaaaacactgacaaaaaccctcttttctacatccaatggggcattcaggcccaccaaagttttttttttttttttcaaattcctcagaggtaatattctcacagtcactctgactttgactttcagttcccattgaagtgttgatctcccttgccatctgcttccctatgctccatagtgacccatacctggcttccttctcctcctagacttccctgtggattgcacacacacaaggcatttttaggtataacagactttattgaatgtttggggcaacagggatcagttagcagttccatcaccacaacacaacctcaaactgaatttagaattttctgtttctaaatgtcctccagtcatcccatcacagaattctcttaggtcacccttgtagcaagctccagtctcttgcagcttcatcctgctccagttctagctatactttaaatacagtttttctcgcattttatgcacagttgtctagctggcaactccttatttgacttcatgcctgcctttgtctaaaaatttgttaatatcttgctaaacaaaatgaccattgattctttaccagtatagcagaactggcagtgacttttttctcaatgacaggaattttaactttcccctctgatataagaagtggccatagtcattttgagttttaaacacatttattatttaggctaaactagtaacaaaaatgtattagtgttgcttttaaaaatatgataagaaacacagtgtactatggagtgtatataacttcctcatcttctggtaaatgaacattaatatgaaagtaaaccagtaccactggttacattaactgcaggaggtagtggtgggtctgcggccagctttacctttggggagaaattcttgaataaggcagtggttgctaatcaaatctcatttctgcttgttaatggtgcccagtagagaacattacccatacctcagtacagggctcaggtagaaacaaggggagagaatggatccagaccaagtgaggctgtgacagttgactactataagggtgcattagtctgttctcacactgctacaagagatacctgaggctgggtaatttataaagaaaaagagatttagtggactgacagtttcacgtggctgggaggcctcacaatcatggtggaaggcaaaggaggagcaaaggcatatcttacatggcagcaggcaagagaacgtgtgtaggggaactgccctttatgaaaccatcagatattgtgagacttattcactatcatgagaacagcatgggaaaaacccacccccttgattcaattacctcccaccaggtccttcccatgacatgtggggattataggagctacaattcaagatgagatttgggtggggacacagccaaaccatatcaaagggcatctgaacaatccacagacctatcccaagaatgggtgtggtgaaggcagttcatggtaacagaggctgacaatctggcacatggtaccagaggctgacaatctggcacattgggggttccaggtggagcacagagtgcaaagtcaggcatagctaatccacagcagaggcacctgcttcttcacagcagcatggcaaccactgaccggaggatggcagcaagaccctgagagaggggcttagatgggtctttggctagggttctagtcctacaaggagtcaaagttattggtcagcatgtccacaaagattatggaaaaaaatgtttcaacacagtaactggaaaagttgccattggaaggcctgagggacctctactgcttgtcccttgcagggtctgattgacagcacaatttaattcctaagtctgtgtatgggaggcagtttgtgtcttctgatctaattcttgccattttcatgattagctcaggagccttggcagtcctgggcatatgaggaccttggaaggcaaagtcagggaaatgtgtcagggccagtgatcatagaacatcattcagcacacactgggatacagaagaccctggctttcctcctggggcataggcagctagaaggagcattgtttctattcttataatgcaaaaattaaaaagtgtatcaaactataagttatgaattgtctggaactcatagaggaccttggttgtaggacaaccaactgactcagaatctaagaagagaatggggcctccagaaagagacaagacacacatgctggcttggtagggggtagacgctgttgggtaaattgatggaggctgagagtgaactgataggaaactgaagaacctgaggagagacagaattgtgggagtgcgtgtactctctagggctttcctccatgaaccccaatgggtacttacagaagatattggagaaagacttttaaatgtgtcctttctggataaaataaaacaggaaagggaggtactttagttgaaaggctggaccttatggatgaggaagcaaggcatgtggacttttgagggatgagcattccaggcagaaggagcagcaagtacacaggccctgagttgggagtggcctggctggtgagaggagtagaaaggagaccagtgtggctggagctggatgatcagggagaagaggaatagagatgaagctagagcgggatcaggggctgggttgtatagggtctttgggatgactgaatgacagactttggcttttggtttgagtaagatgctgaaaccattggagggttttgaataagaggtgatttaacatgacctttgatttaaaatgatcttgaaaatatttggcaatttccaatgaggtttaacgtacattaaccctttgactctgcaatcacattgctgggtatttatcctagagaaataagaatgtatgtttgcacaaaatcttatgtattcatgttcataaaagctttatttgtaatagtcccaaatcagaaataaccccaaatgtctttcagtgctcaatgggtaaatggaaaaacaaactttggtatatcagtatgatggaaaactactcaagaataaaaacagccttgtgcagtggctcacacctgtattcccagcactttgggaggccaaggcaggaggattgcttgagcataggagttctagattagcttgggcaacatggtgagaccccatctctagcaggaaaaaaaattagtcgggtgtggtggtgtatacctgtagttccagctacttaggaggctgaggtgggaggatctcttgagcctgggaggctgtgtgaaacatgatcgcaccactgtactcagcctgggcaacagagcagactctttctcaaaaaataataaaaataaagagatatcaaatacatttaacagcttgcatggatctcaaggacattatgctaactgaaaaaaaaagccaattccaaaaggttttatactgtatggttccacttatataacatgttcaaaatggaaaaatcatagtgatggagaacagatcagtggttgttggggtttagggttggggaagggtatacctgtaaatgagtggcataggatgtttctttgtggtgatggaacagttctgcatccattttgttttttgtttttgtctttgttttgttttgtttatgaggcagcgtcttgctctatcacctaggctggactgcattggtgctatttggctcactgtagccttgacctcctaggctccagcaatcctcccgactcagcctcccaagtagctcagaccacaggtgtgcaccaccatacctggcttatttaaaataaaatgaaatttttgtagagatggggtctcatgttgcctaggcttgcctcaaagttgtaggctcaagcagtcctcctgccttggcctcccaaaatgcagggattgcacgtgtgagctaccacatccattccagttttgtatcctgattgtaataatgattgcacaaatccatatgtgtgataacatttcatagcaaaaatgtgtatatatgtgtatatatatatataagtgagtaaatgaaaagagtggtagactcctgaaaaggtctctcatttagataaagtattgtaccaatgccagctgtgtgatgtactatggttatgtaacttgctctcattggtgagacctgggagaaggatacacagaatttctctgtattgtttttgccatttcttgtgagtctaaaattatttctaaataaaacattttttaaaaaaggttctctctggaagttatgttgaatcaacactgaagggacaaaggggaagcagggagaccaattaggaggctgctgtagtcatccaggtaagagatgatggtggctgggaccaaggtggaattggtgatggaattcctacctgtcccttccaggctgtgcaatgggacaactttaagagccagagtctccagctgtcactaccctgtcaccatccctactatcatctctggaccccatatttcacctgtgctcaccctgacaccacttctgcccttgtgtctcctcacagcaagtgtgggtgctacttcccctgagatgccatgagtttctttttccttattgccaggattgccctgagccatcacaggcccttgatttttactatctaagctgtatttcctctgcccatccattaggaagaagattgctgtctggtttgaactggaatttctcgctatgtcccactggaggtatgtcatagtctgctcttctcactcctctgtctcaggaaacatggtggaattttcttaagaggcttcgaattccttttcctcctta

SEQ ID NO: 430 - DNA, 4970 bp, Homo sapiens
gaggaagagctgtttttctgttccaagtccagcacttccacccttgcctgtctacttcactggactttcttccaacaactcctcctctttacccctccccagcttctgtctccctgtccactagctcctcttcctcaacctacaaacatgctcaaattcctttcagtcaaaaaataaacttctcttctatactaccttgaacctagttactgccatctagtctgtcaaacttccatgtgctctcatactaccctgttttagtactgattctgtcacattgtaattgtttatttccttgttttccttctatatcagactgtaagcttctgagaaatctgtctcttgatcctggttgattcaccgaagcccaagctagttcctagtgcatcgtacgcattcagtaaatattttttgaatgaatgaacaatgttagagccatgcctctgccattcactttgtgaactacctgtaatttttttctacccctacatttcggttgaaagttcacttgaaggtcaccacataaatgtgaaatctagtggcttctctctttacatcatgcttgacctctgcaaccattagtgcttacaaatttaccttttccacacattcatggtcacgtatacctgggtcattttgggccagtctcagtattgcattcaaaagaagcagacaagccccgaacctttggaaagtaatgaacttctgtaatatattagtgaaatcttctaatgagatagaaatatacaattacataaagctcagcaaacttcaaataagttctttttacccaccttcccatatccttacacagcttggcaccttcaatctctcttttgtaacagttcacccaaaacttgtacacttttggccaaaaaccccttgtcctttgtccccttttttcatcttctatgtttattttcttccaagaatagattattctttccagtttaaatcactttagcctcttttggctccttccaaccaagttctttcctaaaccagttatcttactcagtattttagaagtccaggagcattgtcttgatttcatttggtttgcccttaccaactttctttgcatcattttatttaatcttaatgcctcacatcagtgagtattccctgacctcctgggtgtctcccttctgtgtctctgtggtgccccgtttataactctctggaaataatctatttctatctcttctctaggctatacatttcttaagggtaggagtcctgtcttttttttgtacccccatatctagcatagtacctggaacatggtgggtgttgataaatgtttattggactgatgcttctgtgaaatttaatactttctcttttgccactggcttttgttttgttactaggtcttcaaatatggattaaggtttccttaatgtctttttttctttttatatactcttagtgattcctctattcccgaggtatcacttatcacttccataaagatgactccaggtccgttttctagtctggctgttctccttattataagaccatttgttttcaaagttgaatgtcagacatctccacatgaatgtgtcaccagtatcttaaatgcaacaaaaaactcagtaatccaaacttatcttccttttaaaatttcttcctatgtgctccatgtctcagttgttctaacccctacccttccggttacctatgctagttggaatcctggcaaatgccttaacttctttcttttatactctccctaatctgtgatcaatgcctatccatcctgcctctgaatgtttttcacgtttgcttccccttcccatctccacttttagtagttttgttatcacttaccttcactattgcagtagtctcttaactgacctcttttctaatctgtcttccgtgctgttgttagaaatatcttcctaaaacacagatctgttgttactgtatgttcatcgcttgactaatttacttatctttcaggtctctgccaaatgtcacttctaaataaagtatgtctgtcttctttgttgtttgtttcatgttcctttcctactgtcatctaatactgtttgtaattgtgtttatatttgtgcattgatttgtttaatgtctttcttcccactggagagatttatgtaagggactggggagagttatgtagaccctgggcctagcacaatgctcgggacatagtaacacttaaaacatatctgttgaatgagtggatggataatagcaaagtacaggcagtgcaggcaaacagataccaagtagcaaaggcagggaaattacagggtcctagactcttagtacattctcacagaccttaatctgtagtttaaaatagtaatgggcttctctcttttgctttttgcatttatttccctaaggatgagagtgaacaacttactaccccacactgacacttcagtgagggcactgtggaacctttctaatcagaagatgggaccaggcttgacaatgattcaatcaaagcagttttagtgtcacacttgtctcatggaggctatttgtatttctgaagaaattccaatcaaataacagcttactagatttttttcctggtctaaatattatttttgggcattttccacaaaaagctttttgggaaaggtggttcttacactggggcttggaataattgtatctctatgcttggccttggaataattctgtctctgttggaattgtgcacacgttgaggcctgaggccttatcttttatagggccttcactatgtagcttctcatatattcagcatcttaggagagaatcatattcaacatagttttgctttaagctttttacttggtatcagcagttttgccttaagttctaaagcttaataatgaaactctgttgaatgagaacctttccaaaagatatacttttctacataagctgagtttattcatccagagtcatcaagaatagattatatttagaacatatggaatgaataaatattagtgaattcatctttattggacttttaaatttctttacatataattccattcactcatttattcagccatctacacttgagcaactactttatgccaaggactgtagtaaacatttaggatctgaagaaaaatatgacttgattactcttaagaattttataagtctaggctttttttcatgtctgaggccagattgatttttcttttcctttttttcactcaggatgaagtacatagtggtataatcctagttgactgcagcctcgaactcctgggctcaggtgattctccttcctcagcttcctgagtagctgggatacaagcctgtaccaccacaccttgctaatttttattatttattttctgtagagatgaggtctctctatgttgctcaggctggtgtcgaatcctggcctcaagcaatcctcctgacttggcttcacaaagcgatgggattacaggcatgcaccaccacacctggccttagagtgatttttcttaagtgcaaattcgtgctcttttttctaaggcctcagcttggaatgtcctcttgtattacccacctctcttctttcaggactcatctcttaggaaccttccctgtccaaggcagctgagtacccttcagtatactcatcctaccctctccctctcctgttgtggcagttagtaccatgttttgtaactacctgtttatttgggtctccccaactagactgaaaaaggcgcttgaaggcagggctgtttccgtccttgtgtcctgagtgctgagcacaatactgagtacagtttgtgacctatagaatttgtggagggaaggcattttggatggaggctgttggttaagtgacctgcaaaactgctccagtatcatgccaggatcagtcttctttgctcattattgatgagaagcaacactaacttatgtctttattcctaacttaattatactccaagtacacatttgcatgcttcattacatgcctgtagtgatatcagtgacactgataaagtattttttcatattttagttctcatgtttttgactctttattttaactttgttgttgattgaattgagtatttgagttgctgttagtataaataaagtttccatcttggatgacttaccatgttaacaaaaaaaaaatcacaagcagtattatgtgctagtgataccttgtgatttaaaatgtattttgttccagcaaagaaccagtttgggtctctttggagaatgggcatacatctgagttgacctcaacttttctgtaggagagattattgaatctcctataaaggattatatgtaaatatataaattaacatttgtctgttttacaaaatagagtgtctgaaacaagaatacataaaatgttattttcaatgtactagagtagaggagtttggtatttaaaggagttctgtactttggtaaagccaaaattcctttgattacactagtggttggttatttaatcaggatgtgaattcaaattgcctacaaaattttgaaaaaatgcagatgtttggctgactccacatctatcagattgcaatttctagtggtagtgtccaagctcctatatattttgtaccaactacctgggtaatttgatgggttttcagaactactcaactatataaaccaaagaacctcaaaccttaacatatatatgatcatgtgggaccttgttaaaatgcagattctgagtcaggagctctgggtgtgacctgagattttccagttccagcgagctccatgtgatgtccgtgctgatggtgtgtgatccacactttgaacaataaggctataaataataaccatctacattttaaaagatttcctttttttttttcatttaagtgtggtgtatctgtttcctactcttgcttattctataagagaagtgtaatgggctttagatccagtctaaaatagttttggtttggatattgtcttccattaaagtttcagtacgcagagga

SEQ ID NO: 431 - DNA, 1811 bp, Homo sapiens
tgggccatgggtaacaattaaatcagaacatagaaaacaattaaaggccaattgtaagatgtcaaagaactttgaatttcagattttcaataggttgaatatagttatcaaggatgcatcgttttaacattccttcatgtctaccattacgtcaataagaaaatcagttgtgtaaaaaatctacttaatgatacaaggagtttctatctggaaaaacaattctaaaaattttcaggaaattagaaataaaatgcctgaaataactgaaataataataattttggactacagctctttaaaataaaactgtagctaataaattattatctactcactcaaaataagtttcaagaaaggataaaatatacctgaaaattagagttgaaaatatttatttcttgtaaacctgtgattgccagtaataagtttttgttttcccaaaaaaagaaaaaaacaaaccttttgtgaattattagaaatttaccaaaggttaaaggagaagaaagagctctaatgatgagctcaatttgacttctatgaaaatatccaaagttctataatcaatcatagcatatctatttatttactaatgctgtgtagcaaattaccacaaaacacagtggcttaaagtaaccacagtcattttttatctctcttggattctgtgggccatcaattcaagagcagcttgattttatgattctggctctgagtttctcacggagctgagtcagatttcaactggagctgccatcatccgaaggcttgatgggggctggagaatccaattccaagatggctcactcatatgcctggcaggccagttttggcaagtcttcttctccccatgtggacttcaccatagggttatttgagtgtcctcacaacctgatgctagcctcccccagggcaagtgaccccagagagcaaggtgaaacctgaaatacctcctatgtcccagccccagagttcacacattgtcacttctgccacatactatgaggcgcaaaaaaccagcaccaattcagtgtgggtggggatacaaaatggcataagaaatgagaatcattaagggccatcttgtagctagttattacagaacactatggactaagatatcatgggtgggatcatcattatctaagcatataagataacacacaataatatatcttttagtgcaatgaattaacagcagccaatctagtactttatattttctatggctgttttactaaaatcagtgttgctattttttcattaataaataggtaaacaaaataatgataaaagtatttttgccaatcataaaagtatttctacaaaaaatcaaaattcattttaataaaatgtggcatggcctgtgatagaacgggcaaaagaccaggctatgcaaatacaaaggagtcttagcaaacttcctgaaataaatgccaatcactgtatgcatatgatcaccatgcacatgtgtatgtgtatacataaatatatgtacctacacctataatatatctgtatatttttatgcatatagtttgaggtttttgaggatttgaattatttacaaaatgatatcactattgttgtattacttaggattagtttatgttatacataacaaaaaaatagactgggcgccgtggcttacgcctgtaatcccaggactttaggaagccaaggtgggtggatcacctgagatcaggagttcaagatcagcctggccaacatggcaaaacctcatctctactaaaaatacaaaaaaattacctgggcgtggtggcaggcacctgtaatcccagctgctcagaagg

SEQ ID NO: 432 - DNA, 3759 bp, Homo sapiens
gctcagcagggagaagggctcttgactctgtggcagtgtggccacgtttccatgtgtccatgtgtccatgtgggctgctgtaggccctggctcactggtcccaggacctgtggctaaaaggaggcattgctggaggcctctcttgagaggtgggtacgtgggccatgctgcctatgccctcctcaggtccccagaaggagcacttccaaggggtgctgagtcgggggaggtgggcaggaaaagatgccagggaaagttctgagcccaggtaggagtgacagtgatgtgtggtggagatcctacagccaaacgaggagcagttaacaatgccacttcaaaaacagcgcctgaggctcagaaagaaggtgtatcttgccaaccatcacacagcaagtcaccagcagagctgagaccagaacccaagctcctggtccagggctcagtcattgattgttccagccacacgtggctggtgccaggggcccgtccggtctactccctgcggtgactctttctcctgcctcccaactccagaaaaggatcctgctggggagcctggggtgagatcccaagagcctttccgtgtggacgtggacatagtggggtaggtcgagagaccaaagcaggattctaacaggcctggacatatgtcatgggccatcaagaccatctgcatgaaggtcttttgctacagaagtgaggtggctttttgcagctgctcaggagaacaatctggcgtagaagtgggaagggaccagagaatggggcgttggaagacctaggttggagcctcacctctgccctatcttcgctgtgtgaccttgagcaggtcactctaactcttgccgcctcagcttcctaacagcgcccctgcccggcctctcttgcaggcccacagaatgaaaagagaggagttccaggaaagggtttggcagatggcatccctgcaggactgcctcgcggcgctctgccccatccagcccctacgtactggccatgtgacctcaatgtttgatggactcacttggcctctctgaggctcgctttctccatctctaaaatggaggatgaagcaggttcagccccacgggcaggcagcactatgccagggacatggcgagccctctggaaaagttcacctgatccagacgttgctgggtcaacgggaaggaatgactttcactcctctgcttcaaaccaccagactgtccttggccctccctaatgaaggagcagagaacagcagagtgggcagggaccttggaggtcagcagggtggctgctcagcccagaggcaaccgggagctcgtcccagggtgtgacaattcagtcagccctttactgaacactcggctttaaaccgcctcatgcctggcatgaggaaggcaccgtgctggagggtttcaccacggttctctgtgtgtctccggggagctcactgtcctgtctgaggcccgtccggggtccggacagtggagctttcaggttcgtgcgcaccctctgcctgcctcttctccctgtcagtaaggacgtgggtgtggctgggaggcagatcctgggtggagaacggagctcctggttctgaacagtttgagggtctggaagtcctttaagaagatggtgaaaactatggaccttctccccaaagagaagcacacatccacatccagaggcaaaaaccccatcgctcagaaccccgtggatgaggcagtcattatccagtggtgctgtcactatggctggggctggccttgatctctgttgctggattccacatgttcattctctctggccacattatcagatctctagctccaacatcctgtgtgataccaggatggccattgccatgatcttgtccacgggtccactttcagcagctgggccctggagggcagcacacagctcatgattgggttggagatgggggagtcaggggcagatggtgggagctgtccccagccctgcctctcttaggaccctcctgggactcaggtacatagggtccctgagaaagacccagtttgatgagacaggcaggaggaataaggaagagtgtagtttaagaaagttttctccagctctggttcatgcatccgtcctgaaagaaggcagggaaaggattattcacccatttcacagatgaagaaattgaggcttggagaggtcacggagcacacagagcaaagaagtcaaaaccaggatttgaatctactctgattacctccagagcccatgtcttgtcccaatggatggaaaattcttaactatttaactcaatattgagcagctactgtctacagaattctgtgccagacagcttgggagacacagacctacagggagatatagttcccactggaagcacccagggcagtaataattatcatcataacaaaggaataataatagctaacattttggagcacttactagggaccagcattatgctacacagttttcatggattatctcatttaagctctcaaatattttggggtgtaaataacagtatgcccacaatttttgtttgttgttggtgttcagaagtgtatatccgtttttgagaatggaggctcagcgagattaggagccttgctctcaacgagggaggaattctggctgcgactctgtcccttactacctgggcatcacctctgtcaaacctggacaggtgccacttagacctggctgaggttggctgaggcggggaggatggggaggttgtgggtaggcagcacctattcatacccacagtccagggactgttccagaagaatagtattccctgtgcccttgccgcctctgagccttggtgtcccagcctttcgatcctctcacttctgatgtccttgagccataatctgagccattctctaggataaggagatgcttgaggttgagtgaaaggttgacatttctgcaggagcaaagaatgacttgatgcaggagagaaaggctgtggggggaaagtgagtgaggcaaatccccaaggcagagcagagccttccaaagggtgcaggggagagtcttggtggagggggccagccttgctcagcagccccaacctcaacaaggacccctacccaagaaggcctgcaaaatagcaaatcaatgaagacagcaatgaaagcaatgaggagggaagagggaccagaatcccagtcacatcatcacccctcacccctttttctggcctcagttttccttctgtgaacagagggagctggcccttctgtcatttgcaggattttcatctcaggctggcagcaggagctggaaaagtgagggaggtccctcccttccccggcccggggtctgtgattggcagcacctcctcctctcttcctctcctgtcccttccttccccttccctcccctgctttcctttcccttcccctcctccccttcccttccccagtcttcccctcccactctttcaagcccccagcgtgctgtgcagttattagtttaggttcatttagaatcggcttagcaaccccacacccctggaacctggaagcttaaagcacaagatgtctggcaaatggaaattcaattgctttaatatagagactattttgctgcagtcgaactggagcctcttattaagaatctgatggaatttctaaacagggagagaggccccaaggagggggcatcgcccatcacacaccaacattgctcttgacatatttatggctccaataaaatctcacatctggtatattttaaaataaaattgaaaatttatcactt

SEQ ID NO: 433 - DNA, 1784 bp, Homo sapiens
gggacagtattctgcctactgtaaataccataatcattcgtgaaaatgaaccaagatggcagcaagagaaactccacagagaagaagcctattactggtttattaatgaacatggtgttggttgccagaggaaaaccataagcttccaagcactactggagaaataacatcagttgcttccaatcaatcactgttcgatggatccaggcacatgccccacctcagcctgacctgagaatagggtaattgggacatatgtcagaggctcaggagtccctaaaaaaatttcaaatagagaatctttttaaaatgtctgaacaccttttattgcacataaaatgcaccttaaagtggacaagatgggaaccaaacattgaaatctgtgagttgaataaatccagtgaagagtgttggcttcagccagaaatcaatataaatcatgaaaataagtggattttaaattcctggtataggaaagattagaaatgaaatttggaatcaataggcaagttctagacctattgctctgcatgctaatttacttagtggttatgcaagccaatcagatagtagtgaattcaggcaaaagaaggaaaaccatttggagaagcacatatttggggaaaatagtgctagaatcattattacaatgagaaacacagttcagagactagagccaacaaggttacattataccttaaataatcaaagttgttggccaattcagaaacaactatactgcttattctgaggaatataattcacagagggaaaaaagatctttacacagactttagaaggtctatcaggagaacagctatagctctttcttcttaagagacagagaacacagaaaagtttcattccttaattcaagacttgagtcaagtaaagcagtggaagaagaaaaagaatacagcaggtccaaactgctaccaacaccatccaactatcacactagactgtcaagttgaggggatagagattgggacagtgttacaaatggatctgagcccagagcaaaactgtcagaaaatgcaaataccaatgaaagcagcagcgggggcttttgtcaaaccacttcttgttcagagcagacaagtaccaggacttctgtcataataatctatctttcttcgtcggacttcagagagccaggctaacaagcccttcatcggtggcttttatatcaattttaaaccaatcatgactgagtttggagagctgaagtctcttcagggagactacatctcagtcagagactcaaaggaacatcagcactgaccagcagtgtgatcagaactgagggaagcagggtcagttactgagggcagcaaacgcaaggcagattcaagagagcacatccagaaggcagcactgaaatgcaaggtgaaaatgagcttgcctcaactcattctaaaacctatgaaaacagagtcgacaaagagagaaggaatttagtgggaactgaaactttccctattcttagcattatccacttggttttactagatgacaataatgatgatcatattgatgattacacacaggttgaattacagagcagactgaccatctttcccccaggaactaggaagcatcagtattcagagcgaatcaagtaaaatctgcagtgtttgtttcagtagctgactggcaggaactaagctcaggcaattcctcacatgcacgcgttttacagccatcgtattgctcagtagctgcgagacacctacagtcatcctgtatgttggcagcctgtttgagaatccaggatggctaac

SEQ ID NO: 434 - DNA, 1877 bp, Homo sapiens
tcgggaggctgaggcaggagaatcgcttgaacatgggaggcggaggatgtggtgagccgagatcatgccattgcactccagcctgggcaacaagagtaaatctccatctcaccaaaaaaaaaaaaaaaaaccttgtaatatatgtatggatacatggaatcactgtcaggaaaaaaaaacaagtgaaatggcattatattatgcatagaaaaccagaaatccgcagatcttcgcatagagtaagttgatttctgacacccttttccccccacctcaccattataagagtctctgggagttctccttccctgcagacctctgcctccctgatagacaaataataagcatcaattaataaatatatctcagttatctggcttccctattccctatttatctatagctacacattcaagcatatattgttctactgcagtgggcatactagtcaaagaaagatccatactttactccttccaaaatgaacaccatggacactgttgattgagtccttaaacactttcactatttccacccctatttattctctgtcagtttctaatatcaggtctccattgccaaaagaaaatagggtccagtatgacatcagataatttatgccaaaaccaatataaatttaagttcttgataaacctttgctttcatttagcattagaaacttcaatctggaaagataaggtgaacattacttacttgtcccaagctaccaaagccagcctctctataaggaatagattccgctgaggaggaccgactgtataaggtgaaacaaaaagaaaaaaaaggcaaaaaacctagttttactttttattgttgttgtttttttgttttggtttttttcagacagagtctcactctgttgcccaggctagagcacaatggcacaagcttagctcactgcagcctccgcatcctgggttcaagtgattctcatgcctcagcctcccaagtagctaggactacaggcgtgcaccaccatgcccagctaagttttgtatttttagtagagacagggtttcaccatgttggccacactggtctcgaactcctgacctcaaatgatccactcgcctcagcctcccaaagtgctgggattacaggcataagctactgtacccagcctcagaaaacctagctttatatgttgttagcacacagaacactcgttttttttgggggaaggggcacatgtcactaatagaaagtctccgaagctggattgatgggaggaaaacacctttcccttctagttttgagagacttcctcttggctcccaagaggagggattccctgactttgacacacatggccaccttggcacaaaagccttgtggtatgaaaaaacaaattcgtttttatgtcctcttctccttttccatctttcagcataaacttaactcccttaagccgagacatctgttaggacctgacccccagtcattgattaccagtttgtctggcaatctggactttccagtgatgccactgagatggcacctgtcaaaagagcagtggttccatttctagattgtggatcttcagataaattctgccattttcatttcattccctgaaagtcagggttggcttgtgaaaagttgttaaacaatatgctaaatgtgaaatgtcaaccctcactctcaactttccctgttcggagcatgagatgaagacttcattgggttttatagtggctttctgatttttggtaatccattgaagaagggagtttgagagttgttgtatactgttaatgattgtctgcccatgtcctgcctgaatggacagtatctttaataaagctggatacagtttggcttagggaaaaaaaaaaaccctagctttaaacttctac

SEQ ID NO: 435 - DNA, 1077 bp, Homo sapiens
atgccattacaggagttggtgtcctttgaggatgtggctgtgggcttcacctgggaagagtggcaggacttggatgatgctcaaaggactctgtacagggacatgatgctggagacctacagcagcttggtgtccttgggtgatgcagggagatggagaagaggaaaacccagcagatgttgactttttaaaggaaagagatctgaggagtttaatgtatttcagaacatacttctttctggtgatcctgatgagatggaagcttgacctgtaatgagtcagctactattgctcaagagctaactcaggtagggaggaaaacttttgaacgtcatgtatgtgggaaaatattcagtaagaagcataaagtcactgaacataagaaaatacactcaggaaagaaaccttataaatatagtgaatatgagaaagccttcattagccaatcatgtgttacaaaacatcagagaacacatacagaagagaaaccctatccatgtgccatatgtgagaaatccttctgtcagaaatcaaatctaagcccctcccagtatgtcaaagaactcacacaggtgaacaaccgtatgaatgtaaagaatgtaggaaaactttctatgagaaggcaaatctcaatgtacatcaaagaactcacataggggaaaaaaccctatgaacataatgaatgtggaaaaaagtttcatcacaagtcatacctcagggtgcatcagggttttcatataggcaagaaaccctatgaatgtaacgaatgtgggaaaacctatgagaaaggaatcctcactagccatcagagaaatcacacgggggaaaaaccctatgaatgtaatcaatgtggaaaaccctttggctggaagtcaagccttaggtcgcatcagagtattcacagagggcagaaaacctatggatgtaatgtatgtagtaaaagcttccaccagaagtcagacctcactaaacatgaaagaattcacactggggaaaatccctatgaatgtaatgagtgtggaaaatcctttggctggaagtcaaggctcagccaacatcagagatctcacatagggt

SEQ ID NO: 436 - DNA, 2177 bp, Homo sapiens
ccccactatccctcctcctcagatacagcaactctgtagggccagggatgtgcttgtgaatgggactggcttcccgggaaaggcaaacagagcaggcagtggtgactgtgggcaaattaacctgtttggcctttccttcttcttcttgaaaagagagagagagaaatgatagaccaggtgtggtggctcatacctgtaatcccagtgcttcgggaggccaaggtgggaggatcacttgaggccaggagtttgagaccagccatagcaagactccatctgtacaaaaaaacttggtaacttgctagaaatgcagactcttgggccccactccagacctgctgaatcagaaactctggggctgggcccagcaatctgtgtgttaacaggccttcagataacgctgatgcacactcgagtttgagaatataaagggctgacatgaagggcttaccactgtgcttgtcctgtgcacgtgagaagccctcctaaaaattgtctttcgtctttggaggggataagctggaccctgaagagtaagtaaaatatggcagcatctttgcatctcatccacaaatttgagttgctcagaaatacatcacttcttaaaaatgttcggtgactcactgaatctccgactcatatcctccacgttgctgcgctggcataaaagtaaacttcagtccttcttgacttttccatgcctttctggggttgggtgttggttcttgggtttcacacagtgctgagaggcgtctaggtcctccatccacttgggtgaccattcagctcttcatccttccggtccacatgaccccttccaaattagaagcctcggctgctctcagagctcgcttggggccccaggctcttcactgaagctgccttgagcaccatcatccagagccacagactcatatgcccaaagggaccaggttcatcaaggagacaaagtggactggctggccaggtgcggtggctgacgcctgtaatctcagcactttggaaggccgaggcgggcggatcacctgaggccaggagttcaagactcgcatggctaacatggtgaaaccccgtctctactacaaaaattagccaggcacggtggcgcgcggctgtagtcccagctactcaggaggccgaggcaggagaatgaacccgggaggtggagactgcagtgagctgagatcgcgccactgcactccagcctgggtgacagagcgagactccatctcaaaaacaaacaaagtggactggctgtgacccagcagcaagaggtggggactgtggggacgtatcatgtttgtgccaggctcacaggcgtgcctctggaaacacaggcctagcgctaccagatctctttatccagacaagctgcaaatctaaatctgaactttcaagagaaatttgaaataatctatcttttattttcgatgttgttgttgttgttgttttggttttctgagacagggtctttctctgttgcccaggctggagtgcagtggcatgatcatagctcactgggctcaagtgattctcccgcctcagcctcctaagtagctgggactacagatgagtgccaccacgcctggctaattttttattttcgtagagatgggggtcttgctatgctgtccaggctagcctcaaacacctggcctcaagcaatcctcccacctcagcctcccaaagtgctgggattacaggtgtgagccaccacacccagcctcagtcttttaaattttggaaatccatcagaaaaaattaaaacactacatgggccaaaccaaacggctgtgagcaggattcagctcaagtggggatgagttagggtttccgggcttggaggcagcctcttctccagggtcctgcttcctccccagggaggtgccaggaagcacaaccccaagacccacagcccaggatcccactactccctctctctcttctctctcccccagccacaggaagtctctctgcaactgggagaggagttctgttctccccactgtggctccaaaacccttggtggtacctcaaatcccctccaaccccttagttcttctgaggactctctaaattctcctaaaagagaagaaaagccagaaagatgtatgagctatttcttgttccccttctgctatatccctcccctgaggcaacagctgcctgttttgatg

SEQ ID NO: 437 - DNA, 2120 bp, Homo sapiens
ctaattttaaaattctatattcttaacacttttgccattggcccacacaactttgcttttcaccagtgtctaaagtggctgaaacatcagcatcgggtggtggcaatgccttgagggatatcttatcatatgcagcatggcatctctgggcttcgtggaaccagacatagtgatcaaacatggagcatatttctactgcagataactagaaactggatcatggcgataaagctaatccaactggatggatcctagctctgtgacatggctgacttccagaagcacaggcttttttgctctcgaatatcaggatgatacctggagttctgagtctgatgacctggaagatttggggtaattccgtttagtagacacagctatggactcacacaaaattcattcatttttgagtctactttatttacagttatttatcctttcttgaaaacttttagcatcgccttgattaaaataagttcataaaataatcttcactgtatttgttacatatggcacagaataatttagcactttataaatatgtctcattgatgcacaaatgggaggagcaccctttgctgaaagcagtacagtgacttagttcaatttggctacggtagcactttaaaaaattaccatgagatggcgctgtggccaagtaaatgcagtatgctttaaacagttttccctaattatggcagttaattgcttttttttgaatatagaggaatctatcattcaacttaaagtagagcaaggtttgttactccgttttaatagtattcattaaaagtgaatcctttaatcacagatccataaatcatttgacaactgtgtttcacttaggtgtgagtctgtttaaaaagccatagtagtcagaaaattgccagactaaacaaagggcccaaaggtaccattttatttaggatcaagaaactatatatgtggaccattgttttcgccatcctcatagacttgtcttaaagttcttccacaaaattagattaatttccagtttatttaaagagctgatatttttgttacactttaatctgctttgcagcaatggaaggtcatagaaatattagaacatgaattcacatttaaataaacatgatacaaacatgcacacatgtgtatatactgagtgttttcattgacttgcttttcgtccatataaatatataaatattgaataaagtgcatgagaacatgtctgtacatatatacagctacacatttgcctatacagtatacacttgaatagatacttatggaagaaaaaaacacatacacatttgtaatatataggtagtcaaaagacatctatcaggcaacattaatgtacattctgatcaagattgagtatatgggggtagaatctgtaatcttttccctaatatataatgaaatgtgcagagttacaagtgaaggcaaaatacattagagtggagacattttaacatttatattttcatcagttagtatggtatatcataaggagtagttcagttcaaatgcagccttggtactagcagcatattatacattctatctttgaaacagtgaaccatctttcaacatatctatgaggacataatgagaattttatgcatttccaaattacacaatgacacttcccacattctttagttttcaaatctgtatttttttcccaaaggtttagggcaaacactatttctcattcaatagaaatgcttcagcattgtaatcatatatataacattgattctaataacaacatgcaatttaaccttgagtgttataatatcaaggtggattaactgttgttaatctctttttctctttagtaaccatttcaatgaaatattataatatctgcttttctattagggagcccagtgtcaatgagtaatactgaaatgagtgagtttttggagaaatagaagaaaaattttgctcaaaactatggtagttataaactggcttgagattgaggtgcgtatttctaaattaattgcaatgttaagcctcaagtgatattttccccctcctttatttgtttggtgtttattggtaaccaatcaggaaaacttatttttaaaactactctcacagttgaaacaaacttgtttctg

SEQ ID NO: 438 - DNA, 1025 bp, Homo sapiens
cttggctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctggttcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacacagcatacgtggagaacgtgcttaagaatccactatgatgggaaacatttcattctcaaaaaaaaaaaaatttctcttcttcctgttattggtagttctgaacgttagataatttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgcttgtagcatttttatcatacagtagattccatccattcactatacttttctaactgagttgtcctacatgcaagtacatgtttttaatgttgtctgtcttctgtgctgttcctgtaagtttgctattaaaatacattaaactattaaaagaaaaa

SEQ ID NO: 439 - DNA, 3210 bp, Homo sapiens
tttttccaccttatggataaatataaaactatattatagtttgacagacctaattattttgtaggtgctttagaagtagaagaactaggattggtggttggtcagttaaaatggaaagtcacaaagtctagatactttgattgcttgtattagatgtatgcttattttccatacaatcttttaatgaaggactacaccatttctttgagatgtctgctgcctagattctattacatatgcatcatatatagttttcagttttgtcttaaagaaatctgaatagagaattcccttgaactttcacagataccttccctcagttttccagctttcttcatacccctaatttgaccacagtttttacagtaaaaattgtagaaatcaagtaatattgacaaccacctactagctaatagtcatcagtcaacttatattaccttggaagtggttaaatagagtttggttaagagccacaaatttacttcatattgtaatgtaattatttttttaaaaacttccctcaacagaaaggaataatgtgctacaggaaaaggaaaacttacctgaggtagagagtttaagcaagaggtgaatctggtgtaatcaggcaaggagtcaagtattaactctgtatgtgtcaggtgctgggaatatagaggacagtttcttaacacagtctggggtgtaggtggagatacatggggtggctttgaggcctttcaggttttcatcactgatagatacctagcccttatttcatggatgcctcaaaccccattttccagtctaagctttcgcccctaatctatttgcctgtactgcataaccttctaaatatgattaaaatcttccagaagtttttagtcagccctgatctggccttctcaccatttcttcacatactagctaatatttaataagtagaattatgtgtaaatttgggtcttcctggtatatgagcaaaaaaagcaatagtttccttatctgagctgaaaaagacactaatgttcagtggagaacagaggaagagaattccaataagcagagcctgtggttccaggtgaataagtcttaagttcaaggatggtgtagagggacagagatgcattctggccctccagggttagatttgtcaagaggcgaaatagttaatttcagacagttctctggaactgatgtaatctggtttacttagggcagtggttttcagattggaagtacacactattaaacagaagcaattccactttaaaattttgcttggctaaaggattcagtggctattttttttttttttttaattaccaatgtgaataaggtttattggttccggggaggagacaccctctctagtatgagaagctgcaaagaaggttgtacttggagtaaaaaccacactcttcacagaagctgatcgtgatacccattgaggagactgattgggcctcagctttctataacctgggaatataaatgggtgttataaagtttcgtgttacatgactcagttatcagaattgtatctccagcttagaaccttacagggaaaaactggaaattacacataaatatcacccacttgccccctccaccccccaactttataaggtaggtaatattatttacacatgcagagaatgaggtgtggtaacctgcccaatgatacacagtaagcagaggaggcagggttttttggtccagacagtctaattcttaagtgtaagctctttactaagctgcactgttgtgaaagcactgtacttgaagttacaggcataccttgttttactgcactttgcagatattgcaagattttttcttcaaaataacgaaggtttgtggcaaccccatgttgagcaagttcattagtgctattttctaacagtgtgtgctcatttcctgtctgtgtcacatttgataactcttaaaattatttcaggcttaaattatcatgttatggtgatccgggatcttgaatgttactagtgtaatttggagcctcatgaaccacacccatacgatggtgaacataaatgcacgtgttctgattgctccacaaacaggctgttccctctctccgtctccttaggcctctgtattcccggagacacaacattgaaattaggccaattaatagccctacagtggcctctaagtgttcaagtaaaaggaagagtcgcacgtctcagtttaaatcaaaagctgaaaatgattaagcttaatgaggaaggcatggcaaaatctgagatgggccagaaagataggcttcttgggcccattagacaagttgtgaatgcaaaagataaatcttgaaggaaattaaaagtgctactccagtgactacacaatgataagaaaacaaaagaaccctatttctgatataaagttttagtggtctggataaaagattgaaacaggcccaacattctcttaagccaaaaccgtatccagagcaaagccgtaactccaattccgtgaagtcagagaggtgaagaagttgtggaagaaaagtttgaagctagcagaggctggttcatgagatttaaggaaaacacccatctccataacattaaagtgcaaagtgaagcagcaagagttgatgtacgaactgcagcaagttgtctggaagatctagctgagataattgatgaaggggctatgctaaatagcaagtatttaaggtagacaaaatagccttctattggaagcagatgccatctaggcctttcataggctagagagaagtcaatgcctggcttcaaagcttcaaaaaagactgacttgtgaggggtttatgcagctggtgactttaagctgaagccaatactcatttaccatttcgaaaatcctagggcccttaaaaattaagctaaatctactctgcctgtgctctagaaatagaacagcaaagcatggatgacagcacatctctatagcataacgcatctaatattttaaacccactgttgagacctattgctcagggacggaaaaaacctaaagctttcaaaatatgataagctcattgacaatgcacctagtcactcaagagttgtgatggagatgtacaagaagattgatgttttcatgcctgctaacatgacatccattctacaacctatggatcaaagagtaattttgactttcaagtcttatttaagaaatattaggccagacgcggtagatcacgcttgtaatcccagcactttg

SEQ ID NO: 440 - DNA, 1298 bp, Homo sapiens
gttctggaaacaggaaaaggacccatcttattccaaaagtgtttgtacttttttctggactccaagttggatgccttcaccaaagtggtttcaaagactggaacaaaaaagcctccatcgaggccctggctagcacagtccctgttactttaagagtagcattccacctccccctcacacccacatacttgtcctctctttgcacagcaagtgccaagcagtgacatctactatagtttctaggacacgatggtctctgctctacagggaaaaagagcgagcgggacagaaagaaggcgggtggtgagggagaaggagcacaagcccagctatgttcccagaggaggagtcacttcctcgcaataatcctgagatgctgtttatggctgttctgctgatatgaagcctggagccgcaggatgcagcctccccctggctgtccattaatcacgaggggctgttacagagtgtacagagtgggagttctgcctacaagtggcctctaactgtctccagctcaatgaaatgaacctgtgtgaaaacttgttttatgagagattggtttatttgtaactaaactacttcctctgttatttgataagatcaaatatttgctactgataatctgagagtgtcacatttattatcctgtttcagccgttgcctaactcctttggaactgactccgttaactctttgagggacagcagtaggttttagaggaccggtttctattttctttcagcaaagccaatgctatctttcagacactgagtcagcattattttagaacagctatgacatgtgaatcaaaaagaagcctttctcttccaaaacagaaagcagacaaccatagtaacaggaggctctgataaattccctggaggttctgaagccaccatgaaaaggaaggaaaggtattctgacttactaatataaaaatggttttgcacgtgctaggatttctgaaatcacacattttcaatatgttcaggatgactttctatagtttgttagaccctcaaatatctatgtggggcatgatctctaaatccggcagcattctgcatcttgacacttggccttttggagtctgagctcatttgcatttggcaggacttgatttcctgctttgacagaacggcggtaaggtggtggtgaaagcctttacagtgctccctcgaagggctcaaaggactttctggatatataaaattatgtttccaagaattaaatggaccagaatgaggcagattttgtttgaaaccaggctctgttacatgcaacacatctgaaaa

SEQ ID NO: 441 - DNA, 8880 bp, Homo sapiens
agagcttcctgtaagcgaacccgtgaaggttccaggaggatggcgcacccggaaagggcgtggaagctccgcgccccttcccacagactttcccccatccatctcttcatctggtgttcatcgatagcctttgtaatgtccttaatagtaaaccggaaaacgagaaagatgtgcaaggatgcacaccaaactgttgtcgtcgtcactggtttcctaatgggaaggataagaggaagaggagatggagtctcactctgttgcccagacgagtgcagtggcacaatcttggctcactgcaaccttcacctcctggttcaagcaattctcctgcctcagcctcccaaagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacagacaaagaagagcaccctcccaaaggagcccgcatgataagtggccacggcgaacatcactgtgatcagtcagaaaggcaggcgagttattagcttagccctgaacctcctacttaatgtagaaccagtggtgatggttaacagaccctggctgcagtgacaagcctgggacctgctcgaggaaatccaattgaaaagcagccaagaggaacaacaagctagaaacagatgttccagctaccaggatgtgcacgcatttaacctgaacatgtagttggggtgggatggtagcattcgtttctaaatatagtgatttcacttcttcccccatatagatattgtcaagtttaattatagccatccacattagttttgtcaaattttcagcaatttctttaaaataagaagatgtcagaatgataactgctattaagggaattcagggtgtttggtttatctacccagtcttactaaaacatttcagttaaatcatccactcttaaactccagtctcatagcaattaaaaattatcttttaaaaaattgcccaaatgaaattccaacagttcatgtaattatttgatttaatattaccatgttagtaaaatatctttaagatagttatattttcatgagtcactttcttagtcacttctagttcctaaataggggagtttgggttgacagaggtgtgataaccatgcgaacaggggctagaatataagcttaacagaatcagttaattagatttggaagagagttgagtcttgtgaaccacagtgatatgtcatgtacattaggaaacattctcctttacgtcaacacaattctggttttctctaatgggctttatacgaggagagagaccatctcactgtgttgatttttctcaagaaaaaaatcaatactctcaatggattttaagtagatctaatgtagtactgcactatgctcataagaagataagcatatgtaaaagattttaaaatgtgaattaatgcatgccacactgaaaccagatcataccccacactcatgttgttattatgtgtacctaaagcaaagaacagctgcagagtattttctctggtaacacttcattttttattggtaggttttaatccgatacatttttggggtcactgaattcttatttgctttagaatgcccgattatatcattctgcaaaggataaaagggcttgagccatcatcctgtgctgaaatttattgaaggtatttatgaagagggtgatcttgaggaatgcaagcttttaaaatctaagaacagcagcaaaaataaattaatcaggaatccatcactaatttatacatgagtcacttacgaggaaggtaaaacggttcagtaaattatggatttacaaataaacttgattctagggccttggaaaatacttcgattggaatatagatccatttttcctcaaaacaattttcacttcaacttcagatgtaggggacataaaaccaaatcccctctctgaaaattcaaggggaactcttttctggtaacgtgaggcatgagtggtgatggttcacagggattcatctgctctccacaaactcaggggtgggacccatctatcgtttttctaactcattcccatgaattctaaattgtcaacacctaaggttaatgatacctgtctttttgctgtcataaacagttagggtggtttagcaagagataaatcatctttacacagaggattgtgctattgttctcagcaaacaaaggacaaagcttatttctgtataatgttaaacactgttctaatgaaataggcttttttttcttttatgcattaatgaaattattagcctacaacacatttctttcttgatttggaacatctgttcttcaaaagtgtgtagagtaataatggagagtttctacacatcatggctcactctcatctcaaaatatacactgatttttaaggaatgtgtagaaggaaaagccaaccatccttttgattattggattaaccaccagagctgccttcatctgaaacatactccactcgattgaggatgatacttttagctactaaataaatacacagaggaggtgtggaataacaactttaccaagaatagccaacaagttcatcttacaactactatgagcaaaaagcgttcataaaaaatatcttttttttttttttcttgagatggagtttcactctttttgcccaggctggagtgcagtggcatgatcccagctcactgcaacctctgcctcctggcttcaagagattctcctgcctcagcctccaagtagctgggattacaggcacccaccaccacacctggctaattttgtatttttagtagagacggggttttgccatactgatctcgaactcctgacctcatgtgatccacccacctctgccttccaaagtgctgggattacaggcatgacccaccacgcctggcccaaaaaaatatcagaaaaaaaaattgttttcacccctttaaatattaaataattgatttttttctgaaaatatttcttatacaattcaataagcacactaattttagaatggagggtcattaatgctgtaacaaaattggaaatatttgctattatatgtttttaatacacactaggtacatattaaatactatatctgtgtaatagttaaacatattaggtagttcattaggttcatttaaaattggccaagctcagtagctcacgcctgtaatcccagcatttttggaggctgaggcaggcaaatcacttgaggtcaggagttcaagacctgcctggccaacatggtgaaaccccgtctctacagaaaatacaaaaattagctgcgcatggtggcatgtgcctgtggtcctagctacttgggaggctgaggcaggagaactgcttgaatccaggaggcagaggttgcagtgagacgagactgtgcactgcactccagcctgggtgacagagttagactccgtctcaaaaaaataaaataatataatgtaaggccaagggctcagcaacaacgtaatgtaaggtgcttaggtataattttacaattttaagagagaatgtgcttgagctaggaaccattgagagagagtagatggtggcaatagtcagtcaattgtgctacaaatacattgcaatggaaaatatacactacaaaattttacaaaagtagcaaacaaaaaactttttttttttaattttttttgaccaagtcttgctctatcacgcaggctggagtgcagtggcatgatctcagctcactgcaacctctgcctcccagcttcaaacgattctcatgcctcagccttccaagtagctgggactataagcgtgcaccaccacacccagctaatttttatatttttagtagagacagggtttctccatattggccaggctggtcttgaactcctggacttgagtgatccaccctcctcagccttccaaagtgctaggattacagacgtgagccaccgcgcccagccggcaaacaaaaatttacctatgattcaataaatggttttcccctaccagccttcccccaccacacatatacactttttctgattctgttttaccataatgatgacacaggtgcttaaccagctccgtgagctattggggtggctccttgccttgatttagtcttgtgcccacacactgacccatgcagacttagccatgcatccagcacaaattacgctattttacatgtttggtttaatgtattcgtacctgctagacattgtagccaaaagattgtttgctgcctaatcctagccagctcttagggtgactgcctaagcctgtattgctggcttcacaagtttttttgtttcaggtaaataaaaatcaaagagcgttcgaggcagccgcattgactcaccttgcagacaagcaagcagagccgcagagcagtgacccgtgcccagcgcctcgcagctagagctggattggaatccagggctttgcaggcttcctgcttcactcaatcctctttctgttgcctctggcctcaaggtgttggcctgggaggaagtagcagattaaattccatgggcacgaagtccgtagctgacgaatacttaatatgttgcagtttcacagtgaaagttggcaagtccagggtgggaacatgccccaagcagctgagtcttctggattttacttctgttctttgcctctcaatttttgattttgttatataaaaagcaaatcagtaactattgcattatattctgcagtgactcaacagcgacacttaattcagccaaccaaggtttactgaactgctcgtggtgccgggaaccgtgctgggataggatacagggaccaaccagtcctgatcattagcttagccagagaggtaaactgactgacaatcaatctgccagggatcaattactatggaagctcatagtgtgggcccctaacccagactgtgggtctgaggaggtctcctggaggtagtgctatcctaacagagacctgaagggtacttggaatccagccacagaatactatttaccatctcattttactctcatgagaattctccccactgtaggcaggatgggtgttgatttaaaagaaaaaaaaaaaagtagcctggcggggtggctcacgcctgtaatcccagcactttgagaggccaaggcgggcagatcatctgaggtcaggagttcgagaccagcctgaccaacatggagaaaccccatctctactaaaaatacaaaattagccggacatggtggtgcatgcctgtagtcccagctacttgggaggctgaggcaggagaatcgcttgaacccgggaggcagaggttgcggtgagccaagatcatgccattgtactccagcctgggcaacaagagcgaaactccgtctcaaaaaaaaagtaaacagaataacaaacttaagggtggccagcattagagctggaatggaaccctgatgtccaatgagctccctgtagagtggactttgtacaggaccatgttctcctaaagtgactagagagcaggagccacctgtcactcaatgcagcagcattggaccctcccagccaaaccccactcccacctcccatcctactggagtctctttcccttcgtcttggtctacttgagtagatagggtcctcgttggtgcaaacaatctgtgatttatgacccagatagtcctgccaggtcacagagaagtgtactctgcacccagcagtcctcaagacagacttaggctctcggttcctgcaaggcacccctagaggacagcctctcagcagtacccagcaccctgcacagggccacttttgtagcctccacctgcctgctcactccctttttctctccttggccttctccaccctgaatgcttgtgcaagcatgctcactctccttccccagcccctctgcacacactgacacacactcagctcccagctttcatcctctctcccacctcttgtggtgagttctgagcctctccatggccatcctcccagcccaggccatcctcccaacccagcctctccatggccatcctcccagcccagaccatcctcccagcccagcctctccagcccatggccagcctcccagcccagcctttccatggccatcctcccagcccaggccatcctcccagcctagcctctccagcccgtgaccagcctcccagcccagcctctccagcccaggccatcttcccagcccagcctctctagcccatggccatcctcccagtccagcctctccatggccatcttcccagcccagccccacctctccagcccatggccatccctcccagcccaggtcaggctctgagcccaggctctccagcccatggctatacttccagcccagcctctccatggccatcctcccagcccaggccattctcccagcccaggagtatttctggaaatgctcccagcccagcatttccagaaaaggaaaatacagccaatgctgagagtctcaaaggtcactcagttcagacctgcagaaatgtttttgttttatttttttacttgggatctttcaaccagtcagcctgatgctcttgtttgatttccatgtttgttgtagtgaaatactgataatcaaaaagttattctacatgatgagctgttcctcctacttctttacagtttctccattttccaaaatttctacaatcaagatgtattgcttttataatcataaaaagttaaaatgttaacatattctgacagaaatataggaattattaagacttttttctaggtggtggaattatgggtaactgttttttctttgttctgtatatttccaaatcatctaaaatcaacatatattgcatttaggtttgtgtgtgaggggttttttcccccatttttaaatttgtgtgtggttttttgtttgtttgtttgtttgtttttttctttttttcagatgggggatcttgctatgttgtccaggctggtctcgaactcctaggctcaagcaaccctcccatctcagcctcccaagcacctggtgaggtttttctctaaaaaggaaaaacatgtggaagacaatcagagatgatttttgagtaatgcagaacaactccaaaagaataagcagaatgaatgctcataaggtgaaagcatttcagaaaacctattacaagcaacaatggaagaaaattgattgaaactgtgcctaccttccctaacactctccaccttcatctgaggtttgtgatccacagactcaagccatcatggaccacgtcttcatagtcccacactattgtctgcatgatttatacaaatgcaaagcctaccattacttaaatggtaaaagaaatacaggaagcagagactgtgctatatcaaaatgtatctttctctactaccactgttttgcttcgtgctgtgcagaactgccactaagcattttcatagtcgagagagccagagacacagaaagagagaaattatggtcaaattatggcaccataccattaacgtacgagagattggtgccgctagtgtatgattactgcttttaatatgattttcgctttctatcttgtaaaatactgtgaatttactgctgagcctgtgtactgctactctcccaaagagaaaattacttcttccagaggatctgcttgcacaagcgtaaaatctttgcagctctctgagcagcaagagaaccacatcagacttgatatgctgatttggctcttttgagttacctgttccagagaattttgggcaaggatttttccaagatgtcattttctttatatgttattttctttatatttgtatccattcacatcatcaagtgtcttattgagtacctcctaattgcaaatgatcttagtggctgctgtgagagacacatggattctaatacagggtgcttggtttagagagacttgtaagcaccaactgatatcgagggggaaaacaagcagagggaacaggaagtgcaaaggccctcaggaagaaatgagcaaggccaacagggctgggaagatgaaggtagaggagatgagaataaagaggtgggtaggggtgcggtcttgtaacatttgaggagctgaattatattctaaatgtgataagaagccatttgaaagctttgagcaagagaataagggcatctgatttttttttttatccctctagctatgagaataggctataggggactaaaagcagaagcgagtaggccagttagtaggacgcaactgcagacatttaggctggagaagacagtgacttggacgagggtggtggtgtgaaggtcactgaggtgtgtggagactggaaggcacagagtcagaggacttgtcttctaactccatgatactgctccagatgatgaacaggcactcagaaggaacccaataaacatgtcttcctgaatgtatggctgaatgaagagtaccgaccccctcacttataagtaggagctaagttatgagtataaaaaggcgtaagaatgagataatgggctttggggattcagggggaaaggggtgagggaggtgaggaataaaaaacaacacactgggtacagcatatactgctcaggtgacaggtgcagcaaaatctcagaaatcaccactaaagaactgatccatggaacaaaaaaatcacctgttccccaaaaactattgaaaattaaaaaaaaaaattaagcaaccgaataggaatgctccactgattgtagatattttctttctttctttcttttttttttttttttttgagatggagtttcactcttgtcgcccagattggaatgcaggggcacgatctcagctcaccacaac

SEQ ID NO: 442 - DNA, 16818 bp, Homo sapiens
atacctcacattccccagcacggttccgacaggcccatgagtggggagtcctcatggcctgggaaggtggccgagaaagtttgaacagctgcagagcctgcccgtccactctctccagccacatttgtgtgtgtgtgtgtgtgtgtgtgtgtgtgttgtgttttgaccaacctcttaggcttatgtaacacacttggaagtcaagaagtaaggactcattactgacagcctcagagaggcttgcgaaacacttgctgtgaagaaatctttccattgagaaaaagttccctggtgctcatgctcccagtggctcaggtatgtggctgggggtgacggtggtgtgagaagcaggggtccccagggctccagagcccagcgccccctgccggagctgtgtcgcgcccggaaatggaattgagcatcgcttttgtcctctatgtcactgctcacgtcaccaccaacaaccgacgtcggtgactaaactctcgccgcgtatcaggcactatgctgggcccctgcgtttgtgattttcctgggcgcgtgcatgaccaagggctaggtgctcctacgcccattttatagaggaggacacaggcaaggcggtggggtcggggcccttgtcagcaggctgccaccccacacctccctgaggtacatgcaaaagcagacccctcccctccccacaggtatagctctatgtgggccctttgcatgagtgtatttttaagctacttgctagatcccaagaggaaatgagtgctcatcctgcagggagaggccagcattccactgggccatttcccttttcagagagctgatgtggaggattctgcgccgttcttggccatgccgtcatctggggccccaggaaccttacagacccgagggccagggtttggggcccagagcccagcagatagccatcttagaagcattctccccaggaccagggctgctaaacccaaccccacatctcccacacaaatgcgtctttcactggggctctggaaaccggagaccatgtaaatccaagaagatgaaattgtgtgggtctgggccgcagctacagactgagactcagcagccgaggggccccagcctcagagggaactcaatgaatttgtcagggaactgaaaacagatgatttcaatcagcaggggaaaaaaatgacttcatggccacagttgaccgaagcaagcggcgttcggctgccaggccctgcctgggaggcgcttccagaaagcctggcctcttccgcagcctctggccggggtcttccctgcgaggagccagcgccgctcgagccgcagcatggcccggcagaaggcacggcggccgtgatggggctggcggggcgcggtgataacccgggctccccgcccccgcgcttcctctccgctgcgctttcatgaatggccccgcttcccaaacagccgattggctgaacccccggccgcgacgcccaatcagcggctgtggccgcctggtctccgctccgcgtggggcctcggtcctgcagccatgaatggcgcagcctcagctgcctgcagccaccgcctaccttgcgggggccgcctccccccgagggaggaggagcaggggattttttctttcccccagactgttcagggttctggtgcaattgtgtcaatctgaggcttggctggagctcctgacaatagcccttgggcttccaaggttgacattcaaggtcttgtgacagtgaaagggcttgcatagttagaaatgaatttctttgcctatagcccgggctgattccagttccagggaaagaacggcagcctttccgtgtaagcaggcagccctgctggggacaaagacagggccgtgggaggaggtggggccccttcctggccagtgctggggggggcggacacgtgcaaactgctgggaacttcgcctgcaaaccagagggctttggccacccctcttggtcactggccttgtcctagcttcatatgccacgtgcatgaagcggctggggcccctgtcggggaacccagccattccgctgcatttcctgttaagtaggaaaacatgttctgtttgctgatgttataaagaaggcatgtgtttacaaatgctcattggggagagcgtggttaatgggccagcttccggcctcacctccccagatgaagtgattgtgtggctgacagaatgggcctgctcttcaggggaagaccccctactcgggaaaattagactcagcagaagccagaattcaaagctgtctagaaagtgcttttgcaaggtgggttgaggccaggatgaggaaggcctcgaatgccaaagtgaggaggtgtcccaagccctggggagtcatggaaggctggtgagatgcagagtgagattccggagtgtttcagaagcttgactcttccccggcagggacttctctgccaacacacctaccctgagcatggctggggtgaccttttatggaacttccaaattagaactgtgcaaacagcttcctgtgaccccttgatgagccccattttaaagatgagaaaactgaggttcagagtaatctgcaaagggtcccacaatttgggagtggcgagaccaggactggaccctatctctgcctgatgccataggggaaaggcacacccaggtgctgcacgcccacagggactggtgtgaggaggcttcagcaaaaaaatgcgggcagatcactaaacactggggcaggcactgactcattgctgcagtggttaggatcagaactggtgagaaatgtacctgctcccaaatttctatgagccagactctggtctcccaggtagattcgtgaggccatgagtatgcagcagggggcggcctgacaaattcatgtagatttccagttgtagcatctattttttttttctttttttttgagatggagtttcgctcttgttacccaggctggagtgcagtggtgtgatctcagctcaccgcaacctccgcctcccaggctcaagtgattctcctgcctcagcctcccaagtagctgggattgcaggcttgcgccatcacatctggctaatttcgtatttttagtagagacggggtttctccatgttggtcaggctggtctcaaactcctaacctcaggtgatccgcctgccttgagatggagtctcactctgtcgcccaggctggagtgcagtggtgtgatctccattcactgcaacctccacctcctgggttcaagcgattcttctacctcagcctcctgagtatctgggattacaggcatgcgccaccacacccagctaatttttgtatttttagtagagacggggtttcaacatgttggccaggctggtctcaaactcctgacctcagttgatccacccacctcggcctcctggagttctgggattacaggcatgagccaccttgcctggcctgtagcatctatttctgccagcctaatgcccagtatctgtttttaaccttctagttcagcagtttgtaaaatttctggtcttgggacccatttgcctcttaaaagttatcgaggaccccagagagattttgttgatatgggttttatctactgatatttactgagttagaaatgaaaacatagaaatttgtaaaatgcatgattctgcaagcatacattctgttagctctcagagtgacagtgtcatcatgggtcctatggcctctgggaaactccactgcacagtcatgagagaatgaagagagaatgaaaggaaaaaagacaattcatgcctcagtgtcttcatgaaattaactgcaacctctcagacctcctgaaaccacactttgagaactgctctacagagagcagattgagctgggcggcgggtgcctggcgaaagcttcatttcccagccttcttgtggctaggtccggccatgccataccctggctgaatggactgtgagccatcctccatggtgctgggcaacatgatagatctgtgagtgaaggagtcattgcagtggccacatcctgcctctgaccaatgagcttttcccttcttctccgccttccacaggctggggtataaatgaggcatgggtcaatttggccctcgtagacagggcaaccctcaggtgtgacagagcctgggtgaccagtatcatgctgccatatttgttttttgttttttgtttgtttggtttttgttgttgttgttttggagatggagtttcgctcttgttgcccaggctagagtgcaatggcgcgaactcggctcactgcaacctccgcctcccaggttcaagcgattctcctgcctcagcctcccaagtagctgggattacaggtgcctgcccccacgctcggctaattttttgtatttttagtagagataaggtttcgccatgttggcaggctggcctggaactcctgacctcaggtaattcacctgcctcagccgcccaaagtgccgggattacaggcgtgagccaccatgcccagcccatgctgccatatttgtcctggattgactatgtgggctcctgtgggaaaaagaaatcaacagccaggcttctgctactgtattttgcagtctttgctataatagcctaaccagaatcctgatcagtacatcattcttacacacctggcttcctgctcttattatgcttgcaagaagttggatgaaccatccagataagcccttgggaggagctgagtcttcagatggaagcatgaggtggtgaagcacccctgacagatcattcctttaacatgcgtttattgagatattcttgccatgagtccaacagagtccaggagaggaacatgaggtcacagctgatgggaggaggggacgctgggatggagcttgccagagtgtcgggggctgccatacaaatcaccacaccctgggtggtttcctacagaaagaggcagaaacgtactcttgcacagttctggaggctaggaatggagatccaggtgtcagcggggttggcgcctctgagggctgtaaggcaaagaacccatccctggttcctctcctggctcttctggtagcttcagccgcccttggcgttccctggtttgtggcctcatcgcttcaccctctgcctccatcatcatgtggccttgctcttcatgggcctctctgaggaaagcaagaggtgggagcagtgggcctgggccggggtcaacagccaaggtgtggccaaggtccacccaaggtcattggctccttgctcggcctcaaagccagcttgacgcagcagaccctctccccggtctctctttgtcctttcttcttcttataaggacacttgttattggatttagggcccaccctagtccaggatgatctcatctcaagatcttttgccttccctgcatgcacaacgattccttttgcaaataaggtcacactcacgggtttccctggccgtactctttggtgttgcgggggcgaatgggtgcagcattcagccactccagggctctaagtaggagggacaggcagaagccaccaccaggacaactggaagacttcctggaggagggggtgctaatttgggtcttaaggggagtcattgctgcgagaaaggggagtccacgtgggaagctcagatgcagggaggtgcaggaccttggcagggtgtggggcctccaggggaaagatgacaagtgtgctggaggccttgggggtggagggctgagtgcctcaggatgaggctgggagggccaggtgtgggaggtctcagggctttgttctgcagacagcaggagccagcaggggctctagggctgggagtgagagagttccctgcaggacaaaggtgggctaatggattcccactaggttcagggatgcagaggtggtcctgggagggggtgtaaatatgtgtcttgcaaggggtggagggggagatggagccttggggtggtccctgggaggaccctgggggcgtgtggggacgtctgtacagagtgcagcaggaaatcaggctggtctgtcttgctgtgtttccaaagaaaagaggcaaacccaaggggtaaggggcttccttagacgcagggcccagtgcacccgggcgctggcggtgggtctgggggctgactgtgtctgtactctctcctttgtctgcaggcctggtctgcactcagcggctgccaggacctcccgggagcgcccacacaccccacagcccgcctgtcctgggaatacctctccaggccctgaatacctgtcccccactccctgcctaggacaacgggggctgtcagggccatgggcaggcccaccccaccaaccagaccctacgtgggccccgccttggtcccggagccaatgtctggctgatcagggaacaagaggagccttcaacacctcaattctgggacggttgaggttttcacaccgggccacacctgagccactaggagccgggaggctctgatcgtctctccgcctgtctctctctggcatcgccagggctgacttcattccacgtccgcgcggaaacagcagggctatctcagtgcaatcctggttttgtattcagagcctcctctgagtgagtgccagggcgcaccgtgcaaggagcctggctttgcccactgcaatcccgtgccctcaccctagtcttttaacctctcacgactcaggttcctcatctgtgaaatggagctgtcttctttgtggggttagtggaagcaataagcgagaagtgtgtccacacaggcccagcctttctggggcctcactgtgaccagacactgcgctttggactaggggatgggatgcgacttaggggagctgcggccacctgtctctggaggctgaagtctccctgcggaccacccttcctcaggaccacccttcctcacttgcacgtctcccctgcagtcaggactcgcctgcccccacgccaggctctccctagtggatcaggctgtacaacctggtttgtatgaggaaaggcagccgctggggccccagtgcagcaagagaggggaggaggaggtgttcagagggaagacccctccccacccccgttggccccttgtcttcaaaggaagggcgtgacctttctgccccccagacccaccctgagggtcactgtggcggtgaagcctggtgccggcacttgtgcccgccctctgacttgcagtgtcccgagacatattcaggggagccaggtattcaatcagcaaggctcccaacaagatggggtgggtgggagaagcacccacaattctctagaaggctttcagggcattcttcactaaagagacacattggagtctggaacccctcccctagcagggggacacctccaagctgtgctcaaaactgggacaggatatttgggttggagtgttctccgtctctgcctctctgtctctctctctccctttctctctgtctctctctctctctccctctctccctgtctctctctctctctctctctctcactctctcttgctctctctttcctcctgtctctctaaaggtctcctttcctctaagggcaaagcagcagctgtcaggtccttagagcaggatccctggttggtgcaggcccagggccagcccctggtcccggcctttcttcccctgggggatgaacagtgaatgcagccgccctgggagttgggcgacctgcggggcttggagggaagggcaggagggcccagggctgacacagcacgcctggctggggtgggggcagtggtgtgggtggctgaccacattcctgggatgccgggctgcagggctgggcggctgtgtctacacctgtctgcccctgtcggctgtgagcaatgcagccagggacagggcagctagagccatgctgtggtctggccagtgggccaggcacgtgagctggttcatgccctgctgcaccaacaacgttcacctggagaggtcagtggcctcattgaggggaagaagggctctgtccctagagtctagcaagcctgggccatggtctgtggggcttgtcagggtgacttcacctctgtgagcctcagtttccctccctggaaagtggagcataacatgggtggggtccccggtgctggcctgcagagccctgggagacgtgtggagtacaagccccatacgctaggccaaaagatccgcagaccaggcagcttaactgatagaaatgaaagtccaagatcaaggtgtcagcagggcaggctccttctgaggctgcggggaaggaactggcccaggtttctctccttggcttgcaggtggcccatgcctctccacatcagcttccctcccatgcggcctctgtgcctgaacttcctcttttagtaggactgcggtcatattggattagggcccaccctaatggcctcctcagaacttggtgaccactgtaaaggccctatctccaaatcaggaaatgttccggggtcctgggggttaagacttcaacacaaacatcttgttggaggggggttgcaattcagtccacacccgcttccctcgtctcacttcgtccagcactcagcaccctctggccctgcccttagctgtgggtctggatttcccatctcttccacggtaagccctgtgagggcggcgtctttatcccatttgctgttacacctgcaattcctggggtgccggcttgttctcatcatttagcagaccattgctgaatggctaacaaatccaggatacaatttgtaggtgcaccaagccaggcaaggtatctgcgtcacctgcccgtcagtggccccaggctgggaagaccccttgggtcatgcttggacactctgcaccatgggcagccagaactcctggccgagtggtcagcggccgccacaccttgctggagcagaggcacccctgccatcccacaggcaagacggacctagctcggtttcccaacactctgttgagatggggctgcccagaagcccacacaagcccacacctgggggaatcccagccccacgttctggttcaagtcgctgctggtttgggttcagagcccaaacatgagctcctgctcttcttggtgtgatctgaggctgtggatatcctgagaacatctgtctcaacagaacaccttcctccatgttgcctatatcccaaattcactcccaagtggcttttgtctggcagattccggtggattatgcaaagagggactgccagagaatctgagctgttggaagacttctgaaacgtcactgcggtggcggaggcactgccccggggggacaaaagtcttgtctcttcctccaaatgtggaggatcaaattagagttgacttgtgtgtttccaaacccgttgtcgtcccagcattcaactaatttgaagataccaaaagcctcagaagagggtggcagaagaagaaagggacaaacacaaaaggggaaggacaagagggcagaccgttaaaaaaaaaaaaaacctacaagaatgcagtttgctcctgggtggaccctcccaccccgtgcctgccccgagctggcccctgacctgtgccggcagctcaaattcctaacatctggcccagggtaaggatatgggcaactctttaaggaagcgtgtcctcgctaggtgctgatcactcactccaagggactttgctcctggatgcccaggctcagagagggctgtgagcctcccatggtcacacagcagcagtccaagtgcctggggcagtccgatgcccacatcccccttgaggtcccaggtgagggcatggtcacaggatgcagacccctgcctgggtaggtctctggtcttctatggcacctacttgtaagcctccccagcaagttcaatgtggggctcccagcaccggtccttgggatttgggggttccttggtttcttctcttttctctctacccttcttctccctgggtgacctcatctgttcccctggatgaggtgtggtcccctcctcagttcaatgctgggagccctgcactgaacctggagggaaccagcaggctctaggtcccgacttttggagtagggcctgccccttccttcctgcccctttctctagggagtgctgtgaagggtgcatttgggccctgggggcccatgagtttgggcctccaggatagctgagagcacgtgggcctggcctgcccactcttcctgaagccccccagcttcgccccactcctgggccctgaccagcctcctgcctttgcctttgtctggccttgggtttcccaggcagtggcagctttgctctttttctcgcaggtctcaggtgtcacctcttgaaaattcaaaggaggatccttcgaattcatgaaccagcaacctcccaggaggtgggtcttcccaccctgcaccatccggccttaggaattcagtctggagccctccctccccagggcctggggcctggaagtcggagccagccagagcagggaagggtcgggccctggaaatccagagtggcctgcctgggccggggtggggctgggcatggggaggcgtgggtcctgtcggggttgggaccagcgctccagcttccctagctgatttgagcatttaattttaattccacaaatagagaaaaagaaagaaaactcctgaaagtcgcggcagatcctcacggctctgcagatgtcctgcggaggttgagcctctgcactttggcctcagctgcccaggtaccagtctcagctactgtcactggcggtgtggcctgggcagccatgtcccctccccaggcctcagtctcccagtgtgtcaaatatctgccccgtctcaggtctcattctgctgcttcccccttgtgatcataccctgcccctccccactccccaaggacttcttggccttagcccacaaacctatgcaggtggttccatcagagactgtcccccccagccaccccagccctcatcctaagtcccatgctcccctcccctgcaggaggccactccgtcctcctagtactctcttctcccagcatctccagttctccactgcccgcttttcctgctgccccacttgctggtcccctggagtcccccagacatcatcgctcctgcagtcagcaaggatttggtgggtgcctgttgagggggccgctcctctggggctggagtgcagcgatgcgtgaaacattatgatccctgatcgcctggggcttctggtcccatgggatttgagggttccttggtttttttctctttcaacccttcttctccctgggtgacctcatcagttcccatggattgaaatatccttatgccaatgacttccaaatttgtctcttcagccatgacctctcctccaaactctggacccatatatccggccatccacttgacatctccctttggggtctcccagacatgtcaagcagatcgtgtccaagctggtgtccaatcctttcccaggcaactcaactcccatcttccccatctcagtaaatcccactgccacccctccactagctccatccagaaacctctacaatctccttgcttctccctgtccatatccacgatcaggaatccatccacagacctgtgcatcctgtctctgcagatccacagcctcacccccatcagcaccccggtccatagagagagacctggtgacacagatggtacttcagagagaggacatgaatggtgtctctagtcatgagagtcagggtttaggttgaagctactccgccagggagaagtggagatccagggcccatccagggacacgcagggagaaaccgcttcccccagcctcagggtggagcccctggttaccctctgagccccagagccttgtgtccccagggaggcagagggtggaaaagactgatgggtagagagagtgagagcatcaagacccctctacactgcagtacaagaggctcccttttgggtgggcgtgacaggagacatcccagtacgtggatcccagcctttggacttggtgactgtgatcagctaagagtaaaactgttcttgctttattcttctgggaaagggctacacctgctgggttccacaccaggtgaagaccgggcaggtattctattcaaaagggtgtggctttgccacccatttgacaggagagaaaacggaggcatggagttaccaggatgtgagcagcacagcagagcagtcctgttcagggcctcacactccctccccacagcccccttcctgaccctacagcccccgttccaggcagttcctagcaccataaggtaagtggacaagcctcactctggaaggagagcacagggccctgtccctcctgggggcccgctgagaagcacagtggagttctccagggaccaccatcacaccgaggacacgttaccataaagaaagggcccctgctcacacacatttcccagtcactagcagtgagcacgtggcagcctccagcagctcggattcctccaggccacaccctagacctggccacccacattctggcttctcagggcacatggagcagccattcccctgggctctgggccccaggcacaagagacccaggcttgcagctgttttgcagagagtaagggcaaaatggaagctgcagtgatgagggagaaggtgctggggagagggagagagatagctggatgggcagggccgctgttgctgggacctcagccccaggacgggcatcctttcagcaaaatctttgctgggcagctatggtgggctagacactgtgaggtgatggcgtctgggcaagacctacaggacaggggacgcgcagcccagtgggaaagacagggaatcagctcaaccgtccaccatgggccatgtcagatccagttatcctaccatccagaagcagggggccaggaggttaaatgacgtgctggtggccatggtgtgggggcagaagggccagggttcaaagccatacccctttgaacagaacaggtgtagcctatttacccgcctctccctccatccatctgcacattaattcattcattcattcattcattcattcgctgagcacctgctatgtgctgggccctgctctcaagaagtttggattctggtggggaggaaagaaaaaatatccaggttcatcagacaagcaaataatacaactacaaaagttgtcaagagtctcctggaagagaaggagctggctatgtggggcctgcacacacacgtatgcatatattcacatgcatgttcatccatgtacacatgtgtgcatgcatgtctgtgtgtgctttgagcatgactgtacctgtgtatctgtgtgtgcacagatgtgcatgtgcacgtgtctatctgagtgtgtctgtgtgcaggcaggtttcatggatgtttctgtgcctgcatacatgtgtgtgagtgtgtgtgcatgtgtgaatgtgaatgtaattcccaacagaggtatgaacatagctcagaggtgggtggactcagtgggatgtgctttagggaggaaaagaggcccagtgtgccaggggtcagggcgtggggcattgaggggtttcgggaggaaggagcacgtggaggccaagctgtgaaaaccctgtagaccatgagaggaatttgagttttattcaaaatgcaaagggagccaacagaggaatttccacatggctagaaaaaagcacacagccatgggactgtggggagcacggagtggagggggtgtgagtggaggcagatggccaggccagaggccagcactgcacctgcccaggtgagaaaggctgggagatgagaaggaaacccacactgaccaagattaaaaacaatacgatacaaggaattaacagcagatgagacagtgtaaaaaaaaataataataatgaacttaaaaacacagtcatagaaattctccaaaatggaatacaaggagaaaaaagacttaaaaaaaagacaaggaagaacagaacagcagtgagttctgggacatcaagtagcctagcataggtaactggagtccccaatgaaccccagtgagcgtgacccagtatccgcctagtaggacgctgaaataaaaatgactgaccgactcagtgccagcgaggacatggggccactggacccctcccacaccacgggtaccagctctttggaaacctcttctgcagattcttccaaagctaaatatccatctatgtgtgactcagccattccactcctgggtattctccaaagggagattaaagtgcacagcctccccaaatctcgtacacaaaggttcccagcggctttatttgtaacagccccaagctggaaaccacccaaatgcccatcagcaggtgcttgggtaagcagaggcctggggtcaccgttggttcagctgttggcctctccttctgtctctccaagcgccctagggcaagtggcatcttcaagctgagccttggtttcctttcctgtgaagtgggtctagtgagtgggcctgatttgaggtggtgggcaggatcagcgtggcatcactggggaagctcgcagccgagtgtgaagggcccggcatggaggggtggaagatgtcaggctccaagcagcccccgacgctggcagtgctcaggctgacccttggctgcctcagctctgggaaccccatgcagcacgaggcgtcggggcaggtagtggggccataggaggcggcagggcctgggctgtggccccgttccctgaagggctccgtgtgttccatgcagcgggcagggtcaggggtcatgtttaaacgcgggggagcccagggcagtacctccaggccgcatgctatccaagtggcgtgggcaggcggccccttggatggtctcgggacagcacagcaaggccctgggcactcacctgaccagtcacgttggggccgcctgagggaacaggcaggcagatccaacccatggtggggggctgggacttaggatggtttgaggggtgcgccgaaagcctgggaaggagcctgggtgggagagtggatgcccggcacacacactcgagtggaccagaggcggttggctaggccacagctatcccgtgcccagcaccctggtagccagttcagagtgactgtcccagccctagctgagggtatgcagccaaagcagggcacacctggtgtttctggaaacccctctccccatgccactgcgtgccagctccagtggcccccgtgtcggtccttaggactctggccacccacacgctgagctcccacagggcaggtccaatgcccagcacacaggggaagctcagcccatgtgccggcggaacggtgagatgggtgtgaatgaacaaatgaagcatctctctccccctcccctccccagcttctcaaccacagaatctgtgcctggctcaggaaatgtacccttcgtgtgggttttctattgctgcgtaacaaatggtcaccaattgaaaagcttaaaatggcatttatctattgtcttaaagtttgggcaggtcaggagccaggacatggcatagctgggtcttctgtctcatggggctgcagtcaaggtgccaaccggagctggggtctcctctgaggtttgggaccctcttccaagctctctcggttgtggaagattgcatttccttgcccctgttcctcatggggctggatctccaaatcctgcaggagagtctctgacttcaaggccattttgaaagggctcacctgattagcttgggcccacccaggatcatctccattttgattaactcaaggtcagctggttaggaccttaattacacctgcagaagtccggcacctttgcgatataaagtaacctcaccacgggagcacatccaccctctttgcagccctgccacactccaagttggggagtacacaggtgtgtagacacctgggggcagggatgctggaaagcgtctgagtctcctcccaaccacgctctccttggctctgagactgagtcctggccccaggtaggtaatgagtgaagctttgcggaatgaatacacgagggaatgagtgagtgagtgaatgtgtgagtctggcatcttccatcaaactgtgaccttcccagggccagggtccacattggactcacctctgaaatcgccatgccaactagtgctcctggttacctatgacgctttgaatgctcacctgagcgagtggaggagggagtggcgcccctgtctctcctcaaggtcagtgtctgtgcagagcagctccaagacccattcctctgggagccaggtacagggccgcaagctctgtcctcggcaccatctcctctggctcctccatgcagctgaccctccagtgcacagcagcagcccccagggcagcactggccacacagggaccagtggaggcaggctcctggctgtgagaccttgggcaaggccttctgtcccgaccctcctggtctccatcagcaagagaggggtggcaacacctggctggcgtaaggatggagcattccccgcatggccagctctcagggcaatgcctggtgccgtccagatgcccacaccgttgcctcctttcatccctccaagagcatcaccaggcaggtgctgtcattatgcccattttatagcttggtaaactgaggcacagagaggttaggtaatacatacaaagctggggattgggcccagacagtctggctctagccatattggaagggcattccccctcacccctgactactgggttcctgagtagtgagttgaagaccctgctcgtcagtgtgctgtgtgacgttagcaagccagctgtcctctctgttttggccactgtgttgggcttcctggggctgctataaccaagtgccacaggctacacggcttaaaccacagaagtgtatcgtctcacagctctggaggccagaagttcaaaatgaaggttgggca

SEQ ID NO: 443 - DNA, 2058 bp, Homo sapiens
atgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaaaatgaaaaaaaattatttaaaaaatttagatttgaaatgcttagaaaacaatcatttatttttttatgtcaaaatgtccaagtaaattaatggattaatttccatgcttctggtgatgtaacaccacttggtggtggcgctgaggaaaccctgggaagtgtttttctcttctgtgtaatgaaagactcactgacaaagccgtcggtatccagaatgactgctcttgaaatgatattttgatgatgatgatcagggaagtagcctatgctgatttatttatcatccccccaccccaaccccacttttgtgtcacaaacatttgaaacacccagtgctcaagaatgctgcttttccaattctgctaatatcctctctccccatctggaaacaaagttactaaacctagttttgaaaaagcaatggaaatgaaagtgtccagtgaacttactggcagttgtgcaagttgaaagcttattccttacatcctgagcctaaaagccttattccttatatccggagcctaaaagtttgctcaaaagtagaaaactttccagacaagatcacatacaaaatggttaacatgaaatgctaatgaagaaacaaggcaagaatgaatacaagagaaatggaatctggggaaaaaagtaggttctctaactggggcagggatcttgcttcttgggggcatatggttggatcccaggtgggccacgaaaatcatcttggatatttgtttacaggctgattcctgagtttccctccaaagattctgagtccacagatctagggtgtggaccgagaatcctcattgtaacaagcaccctctgcccccgggacattttaaggtagatggagaactaaggtgagagtgtgccagctaaatactctttcctttgtccctgtgcctcagtcttttttgtttgttttttttcatgtgacactcagtaggaaagtctagttcaagaaccggaaactgagccgggcatggtggtgcgcacctgtagtcccagctactcaggaggctgaggcaggaggatggcttgagcctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaatta

SEQ ID NO: 444 - DNA, 2724 bp, Homo sapiens
tatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcactgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttattagagcctatgagtaggttaagagtatatatgtgtgtgaaaagttaaaggtgcaaaaccataattgtttgttttatttgagatggagtctaactcattggagtgcagtggcacaatgtcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctcctttt

SEQ ID NO: 445 - DNA, 2321 bp, Homo sapiens
tttggacaggaaagttccaggcttcagctcccagaaaccaccttccttcatgtggagggacgcagcctcataagggctggagtgctgtggtgccatcatggttcactgcagccttgacctccagggctcaaatgatcctcccatctcggcctcccaaagtgctgggattacagatgtgagccactgcacctggcaagaaacttttccattaaaacacaatgctccgaaaggtttgttgcaggtaacgcgttccttgtattcagcaagggcggtatatctgcagtgtcttcttcctgggcctacactctgtgaaggtcaatctcatactcaacccagtgtgctgagaaacaggagagtgactgatacaaacaacttatttgagcatatttacctgaaacagtatttaaaaaactgagcatatcttatgacaagaatctcatgctttaaaactctaaactatatccctatgcaaattactgacaatatacgttttaacatcagcattgtacttttaaccttaggtctagggttaccaagtgctgtggcactgctttgataccttatagtttccagttctagtttacaaacataacatgcctttatagttctcagcgctccttaaatatgtggattggaattctaattcctttaaatttcatgttgagttctcagtttctctgcagctactatagctgctctgagttgatgtaattcaaagtctctttaaaagaagctagggcatttctctgttatgcaattccttctgttgcattggagaaacaccgagtaatgcagccacgttgggaaatgctgtcattcccaaatctaagtatcctttaatgggacctactgaaaaaagaagaagaagaagaagaaatgccagtacctttcttccactgaattgctttggacacatgctgctgctgttgttgaactcactgcttttgtatacgaataataagtttccaagctgtggggaggaagacccccctgatgacttacaacccctctcagatcccatgaccctactgcctccaccatcagatcccacagcagcggacttcggggatgccgtgagatccaggggtgcctgggaacggtttgcctctccctctgtgccctgcccagccctgcggcccacgcgtgtgcgtgtagcacagtttgttcttctaaggacacgttccagaattactggagtctcctgaatgctgagatgaatagactgggtgagctttaggtgctgcacctgtccttcaaaatgaaactgaacggaggcccgcagagtctccccgggaaatagggactgaggatgcgttccatctgggttatgctttcatccctgcagcccctggtctgcccccctgtcctcagaaacagctcagtcctttcggtgaaatcggtgaaatcggtggttctcatcttctgtttcttgaacacacgtcttgttcccacccatcggttatggttggagaagcatttcaagaaaacacctgttagggctttttgtgtgtgttaagccgctgtgctggtgtgctttagaatcatccggaaggtttgttaaaaccagagtgctgggtctcttccctggagtttctgagtgtgcaggtgtggaatagagctcaagatctgcgtttctaacatgttctgagctgctggtcccagtactacgctcagccaaccagccctccagacttatatgcaatgagccctgtggctttacacggtatcttgatgaagaaaatgttatgtaaatcatgctctaaaacaacgattggatttcagtgcaattacagaaaaccttttcatcaagatgtctatgaatgaaatactgattttaacaggctgcccattttcaacagcataaaatcacgcattcaaaaccatgatgagccccttaaattttaggattgagtttcacttcctcactgacattttgtgaaaaataacacccgcaagaggcctaaacagggcgatcggaaccaagaaaacttaaggaagtatttgcacgttttgatgtgtttatttatttgggatgcgcggaggctctgaatggagaaagtcgtcgatgcctgcactggtcttggcctgttctttatgttccgcgcggtgacagctttaagatgaaggaggaacataaagggtttcatcacaggaaatagaactattgctttattcaaacatttaaaaaataaatacaataaatcagggatttttcccctttccgagtattaaatacagatgtactgtatgcatatgaaatttttgattaaaatgtctttcaccagtctgtctctttaattaaataaagcctgtttggtatt

SEQ ID NO: 446 - DNA, 13477 bp, Homo sapiens
acagaagtggttgggcgtcgtgaggaacgcatcggcggcagaacactcaagcggctggttgttgagagcacgccagctgaagagcacccctgcacactggcaggccatccacaggtgtcagaaactcagctcagctggaagaaacttgatgtaccaggtatcagagtagcaagtaaagccacaagccaaaaatgaaagagaatcttttaagtgcttatcgtgatggtgtaagtaattgtccaaaagaaacgccgattccttctgttccatttttacctgtggattgtggattgaaataaccattggaccatgaggagagactctgaagagagagactgcaatgtgctgactgtgcaccaagtctgttccagagagggtgactaccttccttgaggactgtcaggctagtgatatgtgatataatactcttttgtgacgttggaccatggcagtgagccgcagctcccagtcagcaatgcgatcccaagaataaacaaccgattcttgacagtgtcctatgttgccagtcgattttgttcaacagtaggtacatgcaagtacaccccactcccaaattaaaaagattgaccttagccaaacataacacgagagagaggcagaatctcactctgtcacccaggatggagtgtggtggcgtgatcatagcttactgtaacctcaaactcctgggatcaagcagtcctcccacctcagcctccaaagtagctacgactacaggcaagcaccacctaatttaatctttttatttttttaaagacaagctcttgctatgttaaccaggatggtgtagaaatcttggcctcaagcaatcattttgcctccacctccctaaatgttgggattacaggtgtgggctaccacacttgtcaaatgatttcctttcttttggacatataaacatcaatgggatttctgaataatatggtagctctatttttacatgtttacaggaaccttatactgttctccatagtggctgccttaatttacatttctaccgtcagtgtacaagaattccccttttctacctcctcaccggtatctgttatttttgatacctttttgatataaaccatttcgatacaagccattttaactgggatgagatgatatttgattgtggttttgatttgcacttctttgatgattagtgatgttgaacatttttccatatatgtatgggccatttgtatgtcttcttttgagaaatatctgctcagatcttttgccaatttttaaaatcagattatttgctttttttaaaaaaaactattgagttgtctgagctccttatatattctggttattagttccttgtcagatagatagtttgcaaatattttctcttactctgtgtgttgtctattcacttctctaattgtttcctttgctgtgcagaagctttgttagattgatgtaatcacagctgtctacttttgctttggttgcctggggttttcaggtcttaaacacacacaaaaaatctttttccagagcaatatcctggagttttcccccagtgttttcctccagtagttttatagtttcagatcctacatttcagtttttaaaccatgttttactttcatttattggttggtgagatacaggtgtctagttttattcttttgcataaagttatacaaaagtctatatataccagtaccatttactgaaagtacttgcctgttcttggtgcctttgtcaaagatgagtgggttgtaaatgtatggatatatatctgggttctctattctgccccattggtctatgtgcctgttttcagtccaatgccatgatactttggttattatagctttatagtaaattttaaagtcagatagtgtgatgcctccagctttgttcttttggttcagaattactttagctatttggggtttctttcttatggttccatataaatttggggattttttttctctttctgtgaagaatgtcatgaatattttgataagattgcactgaatctgtaaactgattttgatagtgttgccatttgaacattaatttttttaattcatgagcatgtaatatcttttcatttttctctgatgaaaaagtgctcaacatcactcatcatcaaagaaatgaaaatcaaaccacaacgaaatatcaacccaccccagttaaagtggctcatatcaaaaagacaggcaataatagatactggtgaggagatggaaaaaggggaatccttgtacactgttggtagaaatgtaaattagtaaatccactgtggagaacagtaaattccattgacatattttatctatgttcatcaggaatgttggcctgtaattttctttttgttttgaagaaattatatttctttcatctgagttttatagtttttcttggatagatctttcacatcattagttagattcctacatattttatatttttgtaactattgtaaatgtgattgctatcttgatttctttttcaaattgttccctattggtgtgtataaatgcaactgtttttgtatgttaattttgtatcctgcaactttactgaatttatcagttttaacaggtttttgcttttgttttttctggaatctttaggtttttctagaagatcatgtcatcttcaaatcaggctaatttgacttcttcctttccaatttcgatgcccttatttccttttttgcctagttgctctgccaaagacttccagggttatgttgggtaacagtggtgaaaagtgagcttccttgtctccttccactatttataggaaaggccttcaatttttccctattcaaaatgatgttaaccatgggttcatcatatatgacctctattattttgatgtattttccttgtctttccattttgatgaggatttttatgataaaatgtgttgaattttatcaaatgctttctgatggcatatattgaaatagaaatcatatgatttttgttcttgattctgttaatgtggtgtattatatttattgatttgcatatattgaaacatccttgcatctctgggacgaatcccacttgatcatggtgagtaatctttttaatgtgttgttgaatttggtttggtagtattttgttgagaatttttgtatctatgttcatcagggatattgacctgtagttttcttttgttgttgtgtccttgtctggttttggtatcagagtatgctgatctttttgaatgagtttggaagtgttccttccttttcaattgttttggtaaatttgaggtagaattagtattggttcttctttaaatgtttggtggaattaatcagtgaatctaccaggtactggatttttctttgagattttaacatcaggcttaaatctcctcattattggcgttcgttttctatttcttcatggctcaatcttggtaggttgtatgcattcaggaattcattcgtttcttctaggttttcaagtttgttggcatacagttgatcattataatctcttagcctcttataatgattctttgtatttctgaggtctcagttgtttgtgtctccttttttgtttctaattttaattatttggatctctcttctcttttttagtctatataagggttcatctcttttgtttatctttttagaaaaacaacttttcattttattgatcttttctttggagaagacaagatgtttattggtgcttctccttgcacctctatttatgaaagcattcaaaattgctttgctgatatgaaagattaatttattggtttctctgacgtaagcttataatttatttaaatctaaattgtgcaaagacaatccaaccttcgatgaacttttaaaatgaagttgtttgaggtccggttttcctagatacaaaggatacatttctcaggaatattttaataatggtttaatgaaatagcgtcacttaattcttatgttttatataagatattttaattaagatgtgccaaaacagttgaagacaataattaacacaggaaaactacttcaaatatatctaacatacataaaaccaattttaaacatgtagacatttatgtttcatagtttacaaaagtgatggtcatgtgaaagaaagtgtaatgtaattaaattttcactttagtttaggagaatagtatctataatattgaaatctttgtctaaaaatgctcagtaccaagtaaaattaaatatctgtaaaattatctcaaatatcttaatattgtctgcaaagcaaaaggtgattaactctgcatatcatttttatttttaaattctaacttgtaaagcgtagtaaaattttcctgtgcaacacacacatatattgtcatgcaatgtaatatttattcaaaaacttagagagattcatcttttattccttgaggcagaaaaatgaattatttgaactaaaagaaaaatggacatgtgctcctgtatgaggaatatttaaccccatgtctctgagggtgtttctgtttaaattacatcactacagttaaacatatataatataccatggtaattgtgaaacacaaaattcatacctactgaaccatttccttgataatttttctctttgtacccctatatatgaaattctaaattctcttacagatattagagattaatttattaatttgtctgccaaacctgagtttataatttattcaaatcaaaatcaatattactatatattactttgttgtctttcagagatcagtaattatctgtgagagtatagtatttagttttaggattattatacatatagttaatcataatctttaattaggtgcagaaaattgtgtagttttaaattcatatatttggctgcattagttaaaaggcgctaggcattattttgttcaggtactttaggaaaatatcacaaatgattactttggaggatgataattgagtaggcacagtgtgaagacaatcagaacagtagtaatagaaactagaagggcctccctataaagggagagtatgagggactgcctggagatcatgcttggtcatagtgccctgggaagactccctaactacacaaaaggtacacacttacgaaattacataattactgaaatgacagtaaattcaaagagaaatgaattgcattctatgacaaaatgcatatgaagtcgagcatcctatccaacagggaaagggggcttctttatattaattcaagcatcaatagcatttagggtactctttccttttattatttatttaaggtttgctattttttttctttctgatatactctataatttgtctaacatacaaagaaagattatacagttttctacctctttgactatgaattatttatatcattttacaaacaatttaaattacaactgacagctgctaaattacatagatatatcttgatagaaacaaaatgctccttgaaataaatgacatacttagatgtatttctttttcaatacaaacatatgttttgtagtacttttcgtataatcttatctgttaaacttgagcaagtagaagtgccttttattatagtagtagaaatacttgtattttgtgaaattctcatacattgatgaaagtatcatagttgtctattatttttattataatctttctattctagcataaggctaagcccaatatctgtgctcagttaattactgttaattttttgttgataggtaaaatttgtaaattcaattttggttttatttttagaaaacaagtttctcaatgtctgtggttaattgcgttatacttgtcttaaaataagtttatgataacactgatgtataatacataattaatattttacttcagcttgagtggaaaaatgaaaatcattatatagtttaaacattgttttggtagtcttgattaactgacatcttgccattatcacaattacaatagtaacagtaaaatttttgcaaaaagttacaatttatattttcaactataattattcctgtggtttaataggttttactacctctccctgaactgaaagagaaactcactaataaaaagtttgcagtgattaattagaaacctgttgtaacccatcttttgaagacagataaattgtcttttcattttcctcaagataaagttttatagtaatttattttttcttccatggcaattcatggcttggaaagttacttttcttgttttaatatagttcaagtttacagataaaaataaaaagttcaatttggttttatatatgtgtatatatgtgtatgcatatacacaaacacacagacacacacacatatatatatttatttatttatagagatatccatttatgtagaataaactcactcaagcttatgttctgttaacttgccagaatatctgagagcaaagaatgtccagtgctccctaaaacttttcacaaagtcattcactggaagagggtctttaggaaatgagttatggtgctaaagaaaaaatgtgagcagcaaatcctctctcaaatctctacctatatttatatccatatggtcattaataagaaggattccagttgtctttctcatcatcagtcttaagtaattgtatctaaatttaaatgtaaagcccttttaaattattttcaagcttttctgtttttcaaaattatggtgtcagatggtaaattcattacacttacatggagaatacattataaacgttaattactgtattttgctttacatgaaaccaaaggttttgcatgccttggttgatatataatggcacttcagtgatgaaaaagataattatacaaatctgctggccccgacctcaacgtctgcactgaattatttttctagatacaataccatgtaaatacaaacaaacaaagcaaacacatcaggtatgatattgaaaaaaacaaagaaaacaaaagacaaaaaatagacaccttccaaatattttattctctctaaagaatactttattctctcccaaaacatttgggagagaataaaatatgtttcttggttggatcacaaattacagttcaagtatcttgtcccaatgcctaaaataacttttttttgaaatttttatttatatgtactcttgacaaaattgtcaaaatcaaacacataactcattaaagacaaggactcaaattgtgtatactgatttaatctcaataggtgtgttactaatttaatgttcacttcatcatctacataagctttttaaagtggctaacatcaagaataaaataaaatatgagacaaatttcttgaaagaattatattatgtgaagccaatcttgcttttcttcgaaacaaactggtattttagtgagactttccacatatttcacattgaaaaactgactttataaaggcaaatgttttgacatttaaaatatgatcaggaagagatgtgggtaattcactgagcattctgtgtctcaggtttttctctgtaaaatcagaacattaagtaaaattatcttatgtttttttgccagcactcttccaattatggaacagaccagttgagtagctctaggaaatccaaattgtttctcagttttctcttttgcaaatccctgttccatcaatgtcaaaaacattttgtgaagataattatgattaaataagtgttaacaattttttaatgcctaaagatgtgataggaaatggtaacaaaattattttctataaatttatttataatttttatacttataagttaattatgttatttaactttttaatataaaacaataactccaaatatatttttccattttactcagtaaatttaatgctatttaataacaaccatgttctgtttgttatgctagttatctccatttgcccccaaaacaatgtatctagaaatacagtgatacaagaacaatttatttcttcaacaagaagaatgatctactgtttgtatcaactgtttaccgtctataatcacttaattttccatctatgtttctcatgcaaattaaagttaatttccaacagtttatttctgggccagacctctctcctgtatttcagattcatatgtccaaatacctatttaacatctccaattaaatatttaatggatagcttatatttaatataaccacaactgtcaacattttcacctgtatcatccaccattttactaagataattccatttttgcagttgttcagtctaataaatttagagtcatgcataattcttcttaagcattcaataatcaatcaatctatgggggaatcttgttaatgcaaaactatgtacaatctattttttgtccctctacatctccatctacccccatgtttcaaactaccatcatctcttacttagataatgtcatatttttcaactttcacactggcccacctcaatcgattatcaacaaagaaaccaaagtgctgatgatattattcaatcggtactccctacttactttccatctcactcaaagtaaaatccaagattcctggaaaaactcataagttcttctccacaatctgacatagcgcatgtctcatttcctctctgccatcactcttgagatttttccttcacttggtccactgaagcctcagccttgcttttcaaattttccagacttgctaccctgtactcgtttcctatgagtgcaatgttctttctgatatccacatgtctcaccaattttccttgtagtactctctacttactttccatctcactcaaagtaaaatccaagaatcttacgatgactcataagttcctctccacaatctgacatagcccatgtctcatttgctctctgctatcactggagatttttccttcatttggtccactgaagcctcagccttggttttcaaattttccagacttgcttccctgtactcatttcctatgagtgcaatgtcctttctgaaagccacatgtctcaccaatttaccttgttcatcattttgttcaaatgttttctcaaattgttgccttccttaatcatattactagaaatattccaagcactccctgtttttcttccctgcttcattttcctccttagaatcatctaatatcctgtatatttttactaaaacatagtttattgtttctctcacccaccagaatataaattctatgagactagaaatttttaactatcatgcttacctctaatgccagaaccgagatcagtgcctggcactgaaacaaagagagattattctaattatttttcttttaaaattcttctgttgattactagaactgcaaaactcatctcaataaaaagtctatggcagttaaaattatattcatattgctttttcttcttagtcacttacagtgatttctaatataacaaaatcattttaaatgtgtattagaatatggatatactttctgtagcagcccgaaaagaaatagaaaaatatcacagtttgaaaccatataggtcgttttggttgttttgtaatttttattcttaaaagacattacattattataaagacattgtaaactttacccataaagcttgcagaatgttgtgcattaattcgtaggatcagaattaacaataaaactcaagcaccatatttgtctagaaaaaccacctctcagctaaccagtgaacatggatataaatagaccctgaaatctgctcttggttaattcactgacttaaagcactgtgacagataaaacaagttaaacataattaagaaggctagcatattatctgggattctagtgcaaaagaaatatgaagataacctcaagaggatgacctaggaggaagacaagactctagccaggattttgagtgcttactttataaagctgtctgtaacatctgtagcagcaatgttcacaatagcaaagacttggaaccaacccaaatgcccatcaatgatagactggataaagaaaatgtggtacacatacaccatggaatactatgctgccataaaaaaggatgagttcctgttctttgcagggacatggatgaaactggaaaccatcattctcagcaaactaacacatgaacagaaaatcaaacaccgcatgttttccctcataagtgggagttgaagaatgagaacacatggacacagagaggggaacatcacacactagggcctgtcagggggtgtgggtctaggggagggatagcatttgcagaaatacctaatgtagacgacaggttgatgggtgcagcaaaccaccatggcacgtgtatatatgtaacaaacctgcacattctccacatgtatcccagaacttaaagtataattttaaaaagccatctttagaagaacttatgaatggtaatattatcagaagataagcctaaaaagcttaaatgtcttaaattcatttttagttgtattgtatgttatatactctggggaaagaaggatggagatcatgtaaaatggactaacgattttccttctctgcctcaaacactttttgtcagcattatcacaataagtatagttagttgtatgttgtgctaaacacattaaagtcttcttattaatacccattttaaccttatgtggtaggttttattgtcagtataaatctaggttaaactttttaaccagagtagatgatggtttcagggccaacactagtctgttgtcctcctaagccctcttgaatattatagtatattcttcccatgggagtccaagaaaagcctggaaaaaacaagggatcaagggaatggaggaagatgttttgtgggaagaagatatatgagttgtacttgagtataaatcatgcatagtggtgtgctatgaagtctctccacacatgaccgagtttacctcatagagccttcaacaaaatttcatatctgattttctttgaagtagtctgagtattaaagaaaagaatggaaatttgatccagggttaattgcagagataaccagagatggctataaaaatactataactatttttaagctagacagctatttgtcttttaatataaactcagtaattgatatgcctaaacattctgtccaatatcagtgaatatttttctgacttatgatttattattttaactgacagataaaattctatacattatatgtcttaaattatatatacatgtggaatgactgaatctagctaatagaaatatgcattacctcacatacttgtcatttatgtggtgagaacacaagtgttttaaatatgtttgccaaatttcagttaaaaaacagaattaaatttaaaatgcctataattcacaatgtggccataaaaattaatcggatcaaatggatcaaagccattcaaatatatccttattaactgttcttgatatggtaaaatgtagctcatattgtttcagaatttgattttttagatgtggttataattctgccatacaaagaaagctgcatggttgagagagatttcaattccaaacttgcagtacaaaaacaacactgccacttaccagccctgccacaacttgcaaatcacttaagctttctgagctccattatattcatctaggaagtaggatcaatgcacaaaatattttcagtgaatgcagagtaggagatgacaaaaagagccatgctctaattccactccacatgaacacttaagatatttctctccagaaatcacctgtagacaatagaaaaataaattcatacccacttagttaactgtgtgagaatgtaaatttaaagcatttttgactagggaaactttatcataataaaatgctttaatttccctgcgcatgaaatatttcccccaaggaatgtatctattaatggcatgctatgattaattaattggttctgggaactattataccatattagtcactttcacattagtgttcccaagagtggtgaataaataagacagtcactgcacttctacatgtccattttctgccaagacgttttgctgatgtgcagtttctgtgcagtttcccacagtgtacttctcggctgacttagttcaagctttgttagtttaatgcttagaaaagcctcatgttcttgcagaaaatcttttgctctcattacttttttgtgatattatggacaacaatttccctagggagcatggcaattgatcccagcaggattatttacggtgacatggtggcactgttgccaatgggggcattgtcaaagggtaggctccttcaatgtcaattttaacccagcagcaaattctgcagtactaaataattctgtctattttctttctagtcaggtaactgctgtcaaattaaagaggtcttcaaaactcacagcacagttttgctttttcattactacatctgcaatttgattggtgttatatattttcttgcatgaatgaacatcaattaaaggagatgaacatttataggaaatttattcaactagagagggttgcaatttttacatgtcaaccatctgaattcatattgcagtgatatttttggaaaacaagaacttgtagattaaataagttttattagtatttcaaataaaataaaataattttcttaaaatattaaagcaaaatcactgatatatgcctattaaaatattaaattaagtaaatatggtattactactaaaataacttacatttctgacacgtcacttacattttaattcagccttcctaataatccaactatataccacatattgttatgatgaggtaactaatcctcagagatacagataaccttttcgaattagtgtatatattaagtttatgatggaagtttttgacactacatttaacattttttttctatgctacgttggtcctttcccttcaaaagctcttgaagaacattgaaagaaggcaacggccttcatctgcatttcaaccatcaaagcaaccatcacccttgttcacatacctatcgtgagacaaaaagaaatacttacattaatttctaacatcatctcacagagttaatattttatttgtgaacattttacatccactgtcagcatttttcaagaacacaatatattggtaactaaagtcaccatgttgtaccatagatctcttaaaattttattcctcctatctaactgtagttttctatcctttgatgaacatctttcaaatctcatttccaaccactccaacctctggtaattacccttctactgtctacttatataagttaaactcttttagattccacatatgacagagtttatgtggtatttgtcttcctgtggctggatttttgacttaacgtaatgtcttccaagttcacacttgtcacaaatgccagaatttccttcttttctgtggttgaatagtattccattgtgtatatatgtcatgttttctttatccattaacctgttcatggacacaggttgactccagatcttggctactgtgaatagtgctacaataaacatgggagtgtggatatctcttcaatacactggttttgtactctctctctctctctctctctctctctc

SEQ ID NO: 447 - DNA, 8098 bp, Homo sapiens
agacttttgagatggacttttgaaagagtgtttgagggaactgttaatgctggctgtactgacctgcagaagatggtgcaactgggtctgaaaggtggacactgctgcctccggaccgctgtcaaagcaagaatatcaccgtgaagcaggctgaaagaaatgctctgaagggaaagctaagacattttgatgaggactatgtttctttctgctataaggaaaagccgtggaaacacacccggattgaaatgcccctggcccgcctgacccgaccctaggagaagcagccgagttacccgacatcgtggtcagcaggagctgggtcggtggctggatgctgcagcagcagggactcagcgcctgggagggctcctggggcagggagagaagcagagatgcaacatttttaaaatttcacaaagcatccggctgcacccaggtccctggaacaggagacaaacagaattaatgttttataccttcgggtataggtttgagttttttccccctcatgccaagtatttaaaacctctagaaacccatgatttgacaatcaatgattgcgcgatactttcaatttgaatattcaaaggcttaacaaaatggactatcttctgcagaaatcctgcacacaggcaccccacagagagtccagagaaacagggagtgagacccctttgggtcctggcccttgcttttattatagtttgagcattttgtcctccttcccacagatagagcagatgtcctcaaagatgctctgtatttcagccttcagggcagctaagaagccatgagtgacttaggctgccctggccatgaacaccggagccagactggctggccagactgattcccgcatcccccatctgtgttttgaggggaaatctcaggttttgaggaatgaacatggcagctagtgggtgtggcacagcaagaagtcgctctgggcccaggtggcaggccagcggcctagcagaggccttcgctctgcacctcctatttttctggctccgcctggctaccagcgggcttccctccccctttcatcccgctcttcctgggcccgacactggggtttctgctcagaatgactgcccattaagaccctttcctcctccccacagagctggggatgccaggagcctcatcctctggagactttctgactctgggtttcaccaccgcactgcgaagtgccctctttgctttttcgccttctagagccacccctgcctttttgctgtaggagcacatgttaggaaacaatgacaagtttggctcctgctcattttaactgaaaggatgtggacttaggttcaagccttctcccattggggtgagaagggggagggacttgggatcaggcttcccccttggtccaggcccaagcccctcactaatgacttgggattctactgggtcatcttctgtgagtacttactgtgcctcttccatgtgatttggaaggtgaggagacaggaatggtccacagagggagagagtgccaggccaagtcctctcatagccacccgccccctccacagaaggggacagcaagagaagagagaggcatggtgaggttccttttgcaaataaccaagatatttccaggattcaagaccagtccatggttttaggcctctgctgtttattctctgagttctcagaaatgcaaaaagtgtagtttagccccagaggcctcaagaaaaagattggggtgcccccaaatgtgtcaaatacagagggaaacacacagagcttagggaaagggcaactgagaatgacaagactgataggaattgcttggcagctgaagccacatctctgggggagaggagcaggcctgggaacacctgaggtggcacctggcagtggagggcaggatggatgtattgaaatctgacagcttctggaacttctttctacaaatgcccctgagcctgtgtcctaggtttccctgatggaccagacctgaggaggggaaggacaatgggggtggagatggcacctcccctccctgcatgccttcttcctcgctgtgcctaggccttgccccctctgaaggaacagtgaaccaagcagcttggaatctagggatggtctcttgtcctcatagcgtcttccattacttcttttcttcgctgctctcctcctttttgttatactcttattttttgatttgcttttaaaaaccttctttgttgcatttttgtttatttctttctgtgtttctttgtctctcttcctgtcattgctttcttccatttcttatctgtactactggttttctccctggcttcacgtgtctctgtgttcccctatgctggggtgtcctcccagtgctttcaggcttcatctccttcctaacctctcctttctattttttttttttttttttttgagatggagtcttgctcagtcgcccaggctggagtgctaacctctcctttcatgtggagatggacagggatggcaggagcactgagtgctcttgacaacaccattgaagatgatgctgacgatcagctaccctgtggagaaggcaggccaggctgggtgagaggggagctccttggaagtcagggggtctgtaaggacagcaaggatctctttgtcccaacctccagcagcctttatgggtgcttctgtgttggccttgtttctgggatggccatctcagtgctgttgctggctagcgatttcagaaaactagatttttctaggcctgagccctgttttgagaaagaagcttccctctggtttgtagctcaacattaatgagttttggttcctgttgtttctataattacaaaaccccagcacaggtatttaagagccaaaggccatgcttgtggaagtaagggaggatctttctaaatggatcctgcaaatcctccttacagatctgagtggatgatcaggcccagagcaaccctgagaccccaggtacccacagcattggctgttcttcataggagactcagagaagacttcataggagactcattattgtttactggacatcaggtgctatattgtatagcattcacattccacaggtgaggaaacaggctcagaggaataagtggcatgccaagatcactgagtatatcagtagcagaattaggattcagactttgttaggcctaactccaaagccctggctttttttttttttgagatggaatcttactctgtcaccgggctggagtgcagtggcatgatctcagctcactgcaatctctgcctcctgggttcaagtgattcccctgccttagcctcctgagtagctgggactacaggcatgcaccaccacgcccagctaatttttgtgtttttagtagagaggaggtttcaccgtgttggccaggatggtctcaatctcttgaccttgtgatctgcctgcctcggcctcccaaagtactgggattataggcatgagccaccatgcccggcctttgctcttaactactgatgttgtcttcctgatcttttctacaagaagcttttaaactttttggactttaacctacaataagaaatccattttacatgttcacatgtatctataacaacatttatatttctaaaacaaacttttcatgaaacaagatatacctacatatgtcaggcactctgatattttctattctagtccaccttttccatttcattctatttatgggaaatatatgttggttgggagtcactgagttaatttaatgacccactaataggctgtgagtggcattggaaaaatacctgcttgtaagatatgcgaacacacgtttcaaggttgtttgtgcatgtggaaatattttggggtgctatctgttttaccatcagtttgtacaaggacactaagacagtgtagcctgctgacttgagaatgttctgtaaggactggaaacactagaatcttgaagaaacgcctggctagaggtgagggtaagctgttaattacactgattacagtttgtgcctctcagactgagaactcttttcttcttgctgggggcattgctatctctaggatgtttgccctgaagtcctgatagtctctttggggttttaataaatggctgaaaaaattgttgtggggtttcaacaggcgttcataggcacccttgcttggcaatataacatggcttttgatgtttgggtgttggaagggatctttgaagtgctgagagggactcagtctttttccaaaatctctgcttgtgtctgtccagcctctggctccactgcttggctgagatcctggcccatagtagaatctgtgtagaggaaacgagagctcactatttgtgaggcagcctgttccactattggactgctttaaatgtagtgatcagtgattatgctataatccaatcatgtattaattgggcaccaactatgcactaggcatggtatcaagtaccaggagtacaaaaataagtaaaccttgatttctgctatcaattactctcttctcctacttctgtactactgcttttctattgtgagtttgtttagttcattaattggtttattcattcattcaacaatcatatactgattagctactctgaccaggtccagtactaactctgaagaagttatgcccatcccatcttcaccccaagccttctccttttgagactcctcatccagtttctttagttcttcatatatcactgtttttcagatctctggctatccttgccattgacctcagaaatcctgtatttgaccttaaccttcttatacccagtccatacccaaagtgatggaaatggaatagatttctttttaaagttttaaacgaatattttgactgaaaaattttggcagtcttgtatgcaaatgacactgcagagcattgttttctcccccccacgtaggagattttattcaactaaggcacaggcatattaaaagactttcagtataaggaaaaggggtagtttattccctccaaatttgactacagctcgaaattgtctttattaatgcaaagttcttttgtcaccttgactttgggacactgttaccaaacctcgtgggaaatatcaagttccagaagattgaatacatgcaggaaacaaatgttttttgggccctagagtgaacatttggtccatatgaaaatgaccaggaagacaattaggtgaaggttttttaatgatttgtgctacgtcagtctcttcccataagacatattcaaagttttaacttttccttaagaggcttccatggggagcaagcatttgataattcatcctttaagaaaaacaccaccgtacactgcttgaagagttcctcttctattacttaaaacgtttttattgtgcaacatttaaggcatacaaaaacatataaagaataccatgatgaaaatctatgactgtattaccaagcttaagaaataaaacagttgagtgatctctcatttatgactaaattaacttattaaaaccattaaaacttttggattattcctgttaagatattttcttttttttattattatgctttaagttctagggtacatgtgcacaatgtgcaggtttgttacatatgtatacatgcaccatgttggtgtgctgcacccattaactcgtcatttacattaggtatatatcctaatgctatccctcccccctccacccaccccatgacaggtcccggtgtgtgatgttccccactctgtgtccaagtgttctcattgttcaattcccacctatgagtgagaacatgcggtgtttggttttttgtccttgcaatagtttgctgagaaagatggtgtccagcttcatccatgtccctgcaaaggacatgaactcatccttttttatggctgcatagtattccatggtgtatatgtgccacattttcttaatccagtctatcattattggacatttgggttggttccaagtctttgctattgtgaatagtgcctcaataaacatatatgtgcatgtgtctttatagcagcatgatttataatccttgggtatatacccagtaatgggatggctgggtcaaatggtgtttctagttctagatccctgaggaatcgccacactgtcttccacaatggttgaactagtttacagtcccactaacagtgtaaaagtgttcttatttctccacatcctctccagcacctgttgtttcctgactttttaatgattgccattctaactggtgtgagatggtatcttattgtggttttgatttgcttttctctgatggccagtgatgatgagcattttttcatgtgtctgttggctgcataaatgtcttctttcgagaagtgtctgttcatatcctttgcccacttgttgatggggttgttttgtttttttttcttgtaaatttgtttgagttctttgtagattctggatattatccctttgtcagatgagtagattgcaaaaatgttctcccattctgtaggttacctgttcactctgatggtagtttcttttgctgtgtagaagctctttagtttaattagatcccatttgtcaattttggcttttgttgccattgcttttggtgttttagacatgaagtccttgcccatgcttattcctgttaagatattttcttagggggaagtttagcaggtatatctatcaattttcctaatccaaaagagctaattcctagatactgtatgtttggtccacatttcattcctcttggaacttctaacattttttactgttcttttttttaattgtactaacaatgacattgcatattacaaatgcacgtatgttatttatcagagattataattagaggatactttttttttcttttttgagacagggtctcattctgtctcccaggctggagtgcagtggtgcaatgatggttcactgcagccttgacctcctgggcttgagcaatccttccgcttcggcctcccaaagtgctgggattacaggcggcgtgaactgccacacctggtcagaggatacttccatatcaaaaatcaaatataatataatgccatcatttgcaaataactatagaatattttaatgtttatttagcttgacctttggggattcttgttcctgatttatcatacttgttttagtcacaccagagataatgatcaaacattaaataacttttatttataagatttcttagcaacagatcatagtacatgtacatactaaatgaatatatcaacatttttctgtgctatttcaaaggttcagtaattttatttcataaaggtatctaaaaagactaaaccagtcatcttaaatatattaccactaaagcccaatatccacctactgtctgaatttggagagagtatggctaatgttagatactaaacatggtgagaatcctctcagatactggtttcagagagctgtcacccatagaaccaagggctaaaaagttactcatctttatggtataattttacttcaatctaacaaaaatttactgagcatctacagtgttctgggcctcgagccaggtgctgggacacagaggtgagccactcatgagtcctccccatgagtctctttagctggagaaccactttgtctagagtgtgtgattttgcacttaacctctctagagtctatggtgtgtgagatgaacagtgtaatattgttttgcatagagaggatactgtagacagaacccagtgatggagccttaagtaaagagtataattttggtgtgtggttggtagaatcactataatgtaatgtgacttaaaccttagacatcaatcattattttggtactttaaatataactgatgttttattccttgtgactacactatttagatatttacattaaatatcgaaaaactgatcacaaagatactataatacttttatacatgtgtgtacgtatgtatatatgtatgtatgtatgtcaatgtatgttttactattggcattagtaattattttccctttatgcaatttcttttagagtgcttctgtcttctcctcctacccaatagtaccatgaaattgtattattaactgagctatagcaagtcataatgatcatttgaaatcatttattaaataaatgaggtaaagatgta

SEQ ID NO: 448 - DNA, 1453 bp, Homo sapiens
gacgactgccgttcagcacctgcgtaagcacctctcggccaggactggcaacactccagaaatgatggagacaggatacatcaacctgtatcactgaagatgatgtggagcagagcctttgtggtcctaagaaacatgtataagataaaaacttttgtggtttttcaatcatttgaggttttaggattgttcattgtatcaacacaacttgcctattctgactgctaaggttgttcactgggttattcataaaggcaaaatgaggttgtgagccacagaaagagaggacaggatggttccatggtgtccccagcttattttttattgtttcctgtttattgatctcatccattggagaactccatgaaagcacatatctatgccacactcaccactgtattatagaactcaaatgtcggttgcatgaataaaatatgtaacaggaaggccactatacctggccctgaccaattacaaatttagtttttcatgaggttttttaaagggcatccagcacaccacagaaccctgtgcacaacaaactacccccaaagttagcggcttaaaacactttctcccaattctgaattccgctgggtcgttctgcttagtgtagtatctactaagtctgggacatcccagataatttcttcatgcatgtctggtgctcagttggcatgtctgaaaaagctgggtttggccagacatctttctgtccacctagtttctccagcagagtaaccagacctctctacacagtagcttagggtgccaagagcaaatgttccaagagggcaagccctgatgtgcaaatccttaagcctctgcttgacaaatgtcctctgggccaaatcacatcggcccagagtcagtgtgggagaggactaactacacaagagtgcaaataccaggtatggttcatgggggcccccagtgttaacagtctacccaatctggtgatcataaggcagacaactgaagtcatgatgcttcgttttacaaataaaaaagcaaaggctcagaaatgaaatcacttgcccaggataacacatgttgtaaatggaaaacaaatatttgtttactggtaataagtcaaaggctagttaagcctttcactatatctcattgcccctaatctttaaactccactttccttttccttattcttagccaactgtgaatatctgtgttcaagaagttaacaatgtagataatccaaaatgaagtgtgttttgtagcattatctgagcagtagatattagatgactaatgtagtatgctctggaaactcgtaacagttcaaaggaaataaagccattttataatgaaaccactttaaaaatcctccactgttttcatcttcacgagaatgacaaagcaccaacttaaagtaaaccaactctttccccttctctgagcttgctgtatttcctaagaaggaaggaaaaagtca

SEQ ID NO: 449 - DNA, 2074 bp, Homo sapiens
atatatgtaacgtttcccccccatcgattgctttgcatcgcttgtccctcaaactattttataagcatccgatgttttggctgcagggacgatttccagattagtctcgattacatttatttctaaaggatctcggtgtgttctgagcacacgcctgagagcggagccgggtagagctgagcagagcgcggcgagctaagttttctcacgggctcctgtccccctgaagcccccttggcgcctgccctgagcgttcgcaggcaaccgaggcagcgttcttcgggatgtgccaagcgccgcccgcccgctcgctcctccagctcggccccttcccctgcaacagaccacacggttcaagacgacgatgtgacagagagaaaacaagccgctctcttgtctgtgacccgcgaggcgaccgcggcgagcgggcaccagctccccactccgattaggcaattagctgattgctgcctgcccgcagcccgagcgagcggtgcgcggggatctcgctgcctgcccacctctcctgcaaacagaggcacgttctccgactttgatagctccctgggttcctgtgaaaaacaaccacagcgtttccagagtgtgtttctcaaataccagcgtcaggggatcgcagaattacagcagcaaatgttacgaggttgacactgctgttcaggtgaaggagagttcagagtctcagagagcagcagcagcttgtgcttctgggaaaatggaaggatgactcccaggcagccgatcctgccactccgtaaaatggaagaaccttggctccccgtgtgaattctctttgtgatttggaagacaaatacctctgctgagttgtctatgaacagatgctaagataagagtcgatggtgccgtgaaccaaggtactgacatagcagctggagagaagtgaatggatttcaatgatgtaagggagatgaactgacaacaaaataattgttgataagatctggagattgagagaagaatgacagaatgactgtaggatcttgatttgcgccaagtgaatggatgctgctcacttagaagaagatttttgttttggaaaaattctttttagatgaagcagtagagacggagtttcaccatgttagccaggatggtcttgatctcctgacctcgtgatccacctgccttggcctcccaaagtgctgggattacaggcgtgagccaccgcccccagctggatggtatcccctcaagcattactggccttgttccactatgtcaaatgtatgcagcagagaaaggggatacaccagcagctggagtggctgagcggaaggaaggacactagaacatattaatcccattttaagcaacaggcactgtgttaagtgatttcagatacaataccacatttaatcctcataacaagcttgcaaggagaacattgtcacgactgtattcatacatgaagaaactgaggctcggagacattaagatttgagccaggatctgtgttcttccaaagcccatgggtcagaaatgccagctgattctggttccagctagaactaccagacatcttaggccaggtctcaggaatccttgaggcaaaaatctgcataacattgaggccaaagatgagcctaatggagttggacctacccatttagtggtagacttctttattggcaaaatattctgtcaagatctcccctgatggacaagtcaaaattctttccaacataacaaagacctattgtcatcatgggaatgctgcgatcttgctctttcagctcaaaaatctactttctggaaccaggtcatggacttgcaggactttccatctacaattttgtttagggaattgagatcagatgaacagggccgaggaagctgtaggcagacagaattagtgataattctttcccacaatactgcactccattcttctaacatacctcaagtgcatgccctcggccaaaacagatctggcaagaggaagattaacaatgatgacaaaaatagttcctgacttgataaaacaaatatcaactgggacaagaacaagaactgcccataaaccaaccttgggatc

SEQ ID NO: 450 - DNA, 962 bp, Homo sapiens
atggtaaaggtccaagtcaccagatttgtccacatagagcacctggactctagggcggctttaaaacttcaacaaagagtcatcatcaatgactccttcattgtataaacaacatggtgtacatattccagtatgatttaatacatggcaatttcagtggcactgttgaggctgagaacaagaagcttgtccacaatgggaaggccatctctattttccagaagccatatgctgcctacatcaaatgggttgatgctgtgctgaatatgttgtggagtccattggtcctggggctcacttaaatggtggagccaaaggggtcatcacatctgtcccttctactgatgccctcacatttttgatattcccaacttcaacacagtttccctcccagactccaagaaccatgagaagtatgacagctccctcaagattgtcagcaatgcctcaagtatcaccaattgccttcgccctctgataagtcatccaggataactttggcatcatgaagggagcaaagttcttatgatcactgataccagaagactggtaatggtccatctgaggaactggcatgacagggtggggctgcccagcacatcatctctgtgtctcctgaatctgccaggattgtgagcaaggttacgccagctgaatgggaagttctccaacttggctttctgtgtccgtgtcccaactgtgttggttgtggacctagcctgccatctggagaaagctccaattgtgatggcatcaagaaaatagtacagcaggtatcagagggcctgtaaggagcatccagggctacactgagaaccagattgtctcctttgacgttaacagtggtgcctactatttatcttttcatgctggggctgaattgttctcaaggaccactttatccagctcatttcctggtataataatgaatttgattacagcaagagtggcaaaccttatag

SEQ ID NO: 451 - DNA, 3968 bp, Homo sapiens
tcacccacttaaatgctggcagtaactggacctcctgctcagctgggtgggtgcattgactaacagaaggggattgtctgggctcctccaggagcagaggggagaggggtctatccaggctgcctgctttgagcaactgcctaactccttcctcagtccctcggccccactcacctccagactgcagtctcctttttcattttaaagacaaaacttcccatcgacaaacagcatgtttatttgcagcttttacagctagcaaatcctttggtaccagggagcgcaggacccagtgggggaagagttcaggcttgggctgaatgcccaggactcagctttgcaaccagccaagagcctggaggcccaactccctgaaagggccttttctgggttgctctgatctgcctggtacccataactgtctgtgttttatattatgggcagacaaacactcagatgacgcatggcagcccaagttatgcttgtttgaaaatgcgtggcatttcataatcctgccggaacacactcttcttgctgcattaggatccaactggaaaacataaagatgaattgctgtaggctggaaaatcaattaggaaaaagaggtaaaacatctggtgttactcttagaatatgaaaattcattttgcacatttaaaataaatgtgttgagttgatttaattgcctgttgaactgtttcgtggaaaatactgggaagttgcattgatcctgggcattttgcagtaaggggcattgtcttgagttctcctttaatcttaatctttaatcaatctggattgtatttctaaggtctttttcacgtgagtttcagtagacttggaacttcagttttcaaagtcaagtgtgtattagaattacacggagggctggttaaaacacagatggctgggcctaaccccacagtttctgatccagtaggtctgggctagggcttaagaatttgaatttgtagcaaggttctaagtgatgacaagctgctggttgggaccacactttgagaactactggcttcgaataagggagagtccttgtcagtgtacagagtagggaggtggtttcctatgaaaatagattaaattccacagacttatggtgctatgccctgcagtcttgacttccttacacaacggagtacatagcttccagagagctttccttctaagataagccacacataactcctatcttctcttccctacattcttctgcaaaaatgggtttaatgcccttctagagattcatttctttctttcctttttaaggctggcagtaactggacctcctgctcagctgggtgggtgcattgactaacagaaggggattgtctgggctcctccaggagcagaggggagaggggtctatccaggctgcctgctttgagcaactgcctaactccttcctcagtccctcggccccactcacctccagactgcagtctcctttttcattttaaagacaaaacttcccatcgacaaacagcatgtttatttgcagcttttacagctagcaaatcctttggtaccagggagcgcaggacccagtgggggaagagttcaggcttgggctgaatgcccaggactcagctttgcaaccagccaagagcctggaggcccaactccctgaaagggccttttctgggttgctctgatctgcctggtacccataactgtctgtgttttatattatgggcagacaaacactcagatgacgcatggcagcccaagttatgcttgtttgaaaatgcgtggcatttcataatcctgccggaacacactcttcttgctgcattaggatccaactggaaaacataaagatgaattgctgtaggctggaaaatcaattaggaaaaagaggtaaaacatctggtgttactcttagaatatgaaaattcattttgcacatttaaaataaatgtgttgagttgatttaattgcctgttgaactgtttcgtggaaaatactgggaagttgcattgatcctgggcattttgcagtaaggggcattgtcttgagttctcctttaatcttaatctttaatcaatctggattgtatttctaaggtctttttcacgtgagtttcagtagacttggaacttcagttttcaaagtcaagtgtgtattagaattacacggagggctggttaaaacacagatggctgggcctaaccccacagtttctgatccagtaggtctgggctagggcttaagaatttgaatttgtagcaaggttctaagtgatgacaagctgctggttgggaccacactttgagaactactggcttcgaataagggagagtccttgtcagtgtacagagtagggaggtggtttcctatgaaaatagattaaattccacagacttatggtgctatgccctgcagtcttgacttccttacacaacggagtacatagcttccagagagctttccttctaagataagccacacataactcctatcttctcttccctacattcttctgcaaaaatgggtttaatgcccttctagagattcatttctttctttcctttttaagagacagggtcttgctctgtcgcccaggctggagtgcagtggtgccatcatagctcactgaagcctcaacctcctgggctcaagcaatcctcccacctcagtctcctgagtaggtgggactacaggtgtgcccagctaacttttaaatttttttttgtagagacaaagtcttgctattttgcccaggatggtctcgaactccagggctcaagcagtcctgttatatcctcctccgaaagtgttgggattacaggtatgagccaccaggccccaacctatttctgccattcctgaattcagaatgcaacagcactctaatttaatcagcgttggcacctactttgtgaactctgatgaggtgggaatacaaaagcaataaaacacagtcctccccctccaggagctcattcacagcctggtggccccctggcagttgcaagaaggcatccaccaagaccacaattatagcatgatgtaatggaggcattaggcaagggcacgacaggagcctagggcacaggtacctatttttgcccgggaagatggggaaggtgtcatggaggaggaatcatttgagctaaatcttaagcaggagtgggtgatgtgtaggtggaaaaaatcttgggggtggggtggggagggagataattgggccattggcacatcgaggatacatacagcttctttatgttactgtagggcctcgcctctgggaataaagctgtcttgggtgagaactactttctacttttagtccctctagcgtatatttcttcagtcaagaagagtggtattacctagccaagtaaaacacagcctctcctcttcgctccctgttcacaaaacaaggagcatctatctggcaggccaggagagggggttggtgatgaagatttcattgtttcctctgtgccttccagggatgtgattcagacacaggactagctttgtgatccctgtgctccggagaaacctccaccctggcctcaaggaggctgtgaaaccaaaagggaccttgggtgccagcttgctgggtccttacttacttggtccatcttctggctggaaggagcacctgggctctcagagtgccccccgactctcagcagctccttttctggcccaagaggtaagagtctggaggaccccagttcagtttcttcctgtttattcttttatcgttgactataagattgtgaacctagcacaatgctaagagcttgagatacagcagctaaacagacagccactatccttacccttttggagtttttagcatagtggtgtgcctaaacaagtcataatcatgatgatgatgagagggtattacacagggcatgactaccagaaggtgggctcattggaagccattttagaagcagctgaccacagtctctctggggcgggcaccatta

SEQ ID NO: 452 - DNA, 1380 bp, Homo sapiens
ttcaaattcagagaatccttctggatttttggacttttttctccctcaacgtggattaaatgttggacttttctcactcaacttggattgaatgttgtcatagagatctaacagcaagtgaactaatgctgattcaaagacaccaagagagggggcgaaatggaaggtgtgaaatcacagaaaccaagggaatgaaaaactgcaaataaataagccatcacttgatatcctgctacatctccaggaataaaaagctggaaataaataagccagccaagaagattgatacatgactggagcctgaatggtagaactttttcagaagtgaggagtctgttggcccagaagatctgcggtaagatctgcctcaacataccttactcatttttttcaaagagactctagagtctaaaatgaacaaccaatcaattctacaaacattgcatcatgaggagttgctgcacctcttctccaggatttgcaaaacgtgtagtccaaatcgagttcggctagaactggtctgtcatcaagatatggctcatgaaagagattggtgtttaggaggctgggaaaaggaaatattttgagagacttcatgtgctccgcacatggaggtggcttccttttgcctcaggtgaagggagcttcaacaagatcactcagagtttgatcaatgatcttagaatttgcagaacatagggactgccatttgactcaccctttagaagtcaggaggaaaggttacgtggctggcacttctcatgtctgggaaggaacaactgtgaagtgctgacctagacgaatgttgcacttccgctgatgagtaggcaatggcgaatgttttccagggtccaaatgtggacccggcaacagagaggctgtctgtaatcactttataagagacactaacaacaatgaccactgggactaaagagagcacaacggaagtagttctgccagaagggctgaggagagggctgagcaaccaccctcaggggaggcagacccacatcaaagacatctcagcagtccctttcccatgaaagaaagagctagaaattgtccatttgacacacacacaaaccagatcccagattgcaattgattcagataatgaaaagcttgttcttttcacttgctgttctagcctaaccatgtaggtgtcagaagcagttgtaggctaggagagaagtcggagcaatacagaagccagttctgcctttgcctcaagatccactgtccactcagaggcaggctggcacatgggggatgagaacattccaagaaagatgtgaatctggaattttcatttatgcagtagatggggatttactactgaaaggaacatgttttggcaactaatagtgaccaaaagaattt

SEQ ID NO: 453 - DNA, 2042 bp, Homo sapiens
tctcccacctgtgttaagacagttaaatatttcttgatgttagcttgaggaccaagtgagccatcttgccagttaagcaagtcttatttcagaggaccaaatggttaaaagaggagaatttgtacatttgttgagcttccccatctgaagcttgggttccgtactatcctattactatccatcttcatactgaatgaaacaaactgaaagggaattcataatcttttttcttaactgaacaggaaaacttatgaaaatcaacaataaatctgaattttaattttcattcaacagctgaaaaaccatgtctgttgaccacattggactattgcctagttaaaatccataaaattctctataaaccaatgaaaagaaagtagtctggcaataatttccaactttttaaatcctaatttttagttacaaagaaaaaggatagaacgaggcttttcaaggaattcttgctcatcccttcaataatttggtaggcaacacagtcctagaattcagcttcctttttggttttattactattaaatagatactttcatataaatggaaacatttttcctcaaaacatcaattcaaaacatactccttatattaatggctatggcaccacatttttggtaaattccctatgtgtaactttttcctgttggtatgtgatttttttcatttaatatgactatctgctggtgttgggggcaataggtttgtgaatattctgtggatatgtccatgcataggtgtatatatatacctatatttttccagctaatacctcaaatgtgtgattgtttaatatataccacactatgtttgcacagagcagggcttctattagcagtggatatttttatttcttttttttttttttttttttttgttttgagacggagtctctctctgttgcccaggctggagtgcagtggcgcgatctccgctcactgcaagctctgcctcccgggttcacgccattctcctacctcagcctcccgagtagctgggactacaggcgcccgccactacgcctggctaattttttgtattttttgtagagacagggtttcaccgtgttagccaggatggtctcgatctcctgacctcgtgatccacccgcctcggcctcccaaagtgctggaattacaggcatgagccaccacgcccagtggatatttttatttctaactttgaaaatcagtccacacaatttcattggtgtgaattctttctgttgctctttttcatattttaatgcagagattcctcttacaaggcccatgcttcaaacacaattatatctttctatatccagccagctggaaatatataggggtaagaagtatttcttgaaaagtccttgtttagtaagttagtaacaactgggatgactagttgccaagatgtcttgtaactgcctagcagatgacacctgccgtggcaagtctcattcacttcagtacaagactctgtacatttcaatctgatattctattttgccatttaagtacgccattaaaatcatagagattttcagtgacattggagtactgtaaatattagtttcaaaaagaattattttgaataggatgattaaaccaataagaagaaagaaacacacagaaatgatattttgcagtttatctgtattaagaaatgcttcttgccaatttctggttttggtttttggattgctacataagactttctttccatttactttatgtgtttttaaaagctgcaggtgatttttaaggtttgatggaattataatgggagccttgtataagttaaatgaaactggtaaaggagagcttactttgtctataatgctttcaggattataacttagatttaaaaatgaaatgtctgacttgtaaaatatttaatgttatatcagacttcaataaaattttctgcgagaactcaaagtaaatgcattagatttttaatgaatgttctgaatgaaatatgaatttttgtctttcagtctctgtagtttatctcaatatattaataaaaaggtctgttctcactgt

SEQ ID NO: 454 - DNA, 1588 bp, Homo sapiens
tgtatgtctgtagtcctgactacttgggagactgaggtgggaggattgattgaaccctggaggttgaggctgcaatgagccattattgtaccttgcactccagcctaggtgacagaaggagaccctgtctcaaaaaaaaaaaaaaaaaaaaattcagtctcttctttttgacctccttaatcacttcagagaaattgatgcagcttttatgacttacctacccatcccctatttaaacttgcagaaagttagagtggaggcataaaaaaataagaaaatattttggagtagctaggtacctggaaaaaatcaatgagttacttagtctaatttttaggtgaccagagcctagaatggtaatagaataattttctgcagaaaggacatttaaaaataatctgtttttgaatgccagacaggaattattttgtagcaatcagttttcaactgttgttttcaaagctcctttaccaggggaagctgtctgatcatctcccatctctagccagtttcaccctacatcatgagctgtctttgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagttagtactacttactattagttcaaaaataattcctattccctttaagttttagacttttcagagcactttcatttttgtcagagcattataacattcatgtgttagtttttagagagctcactatcctcattttccaatgaggtcactgaggcagaggcagccacacttctccaaggttacatgtaatccaaaactaaatgcctagactctgggcccatgattttttttttttttttctaaatgaaagtcttcgcccattggccaggtgcagtggctcatgcctgtaatcctagtactttgggaggctgaggcaggcagatcacttgaggtcaggagtttgagaccaccctggccaacatggtgaaaccccgtctaaaaatacaaaaattaggcgggtgtggtggcgcacttgtaatcccagctactcaggaggctgaggcaggagaatcgcttgaacccaggaagcagagattgcagtgatccgagatcgcgccactgcactccagcctgggtgacagagcaaggctccatcttaaaaaaaaaaaaaaaaagcaagtctttgtccacatagtattctatatcctgaagatgataggtaatgtctagctttaatgaactcagaaagcatttgtaaatgatattgcaatattttaaaagactgttgatataggactgtaaaaataggggaataagaaaggaggccaggtgcggtggctcacgcctgtaatcccagcactttgggatgctgaggtggacagatcacctgaggtcaggagttcgagaccagcctggacaacatgatgaaaccctgtctctactaaaaatataaaaaaagtggtggggtgtggtggcgcatgcctgtagtcccagttacttgg

SEQ ID NO: 455 - DNA, 6275 bp, Homo sapiens
agaggctgcgggccctgagccgctcggcgcccgcgccggctccccaccgcggcgctgccccgcccccaccccgtcgcccgtgcaggctccgagtgaatgaacttgattccagggattttgaagaaggcggttcgccttgcaccctttctgcaccccccgcccacatacacacaccgccccccaaatccagttttctgcttggggtggatggggacgagggggaagcaaaggcctcccagacaatggagggaggaaaagtgagcgcctggggctccgagtctacctagctgggggatccggggggcgctggggctaccgggtcctcgcgggcccatccccagggcggggccgccccgcttccacgggtactgctggggcgtttcgaggctcgcccccgattccccggtcctctttccaccgcttcccagctcgtgatctgtcccctcaactttagcccctctcactccctctggtttctgtccaccgtcccctcttccctcccccagcggacctggaggaaccagtgactttttccttcaccaagtgggagttatccacatcaagcatttcacaacgacacatcaagaaaagtaggcaggttcaagtcaaccatgaaatggtcactttttaaccccgtcctgtcctcattagggaaatgctcaaacacagtccgttttcaaagagcgctcttaatgaggcgagcttgccaagtttaccagctgcagcccccgtaaacccagagcccaaagaagaaaggcgctggggggtggggagttcgggaggccggggacgggggctgctgggactaggaagacaggtaaagtcggggagatcgcgcggacccctgcgagttaaccctttcggccacacgccctgggagcggcctccctgcggtccccgcccctgccccggcaaatcctggagtcagcgttctgacaacgttaatttcctttgtgcgggtcatttcttctttttgaaaagctgggataaagttggcagtctttatggatgaaagaaatgaggtgacagggttaatccaagtaaatactcatttctctcagaaattttaggcaacctcatcttagattaaacacacacagacacacacacacagagaaaccaccagcacgaaagcatcactttgtattgcacattacactgcatcccctttctcaccctcaccagattctgaggggagggggtggggaagctctactgataataccagctttaactactgcagtttccctttgaacaaatattcaatttaactggagttaatttaccataaaagacattccccttggcaggaatgcactaatatccttgaacacacctctttgaatgcctggactctcatagaagccattatttcggggtctctttaaaaatcgagcgcccatctctccttctctccctccctcccttcttccctccctcctcaccacaccacccccagtgaaatcctggcacccagagagcactcctttcagcctgagagcccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccagaaaaaggaaaatgagataggagtatggtgaggcgaggaaaaccaaaaaggaatgaagagtgagcaacagagacttcctgaaaaagaaggtttatgggggtgctcagtttctatggctttgactgtcttctcaggccttgcagccatgtggagaatggctgacaccccccaaaacacttcttcttgtccagccaatgccaaggtcattgcaggccttccctggaagaactctagggagttgtttggaaagagggactggtggatttcggtgcatgggatgcctggcttctcttaacacaacacttgtccaccacctttggtttgaaaatctcaatcttttaaatcccaggtagaaggaggaactgagaaagtgcctgcattgtattcactttccattttttctagcacgtctgtgtcgtggtattaagagtggaaatatctctgaaaagcttctgatagtatcaaaatgggccaaacacttcttaaactttggtacttaccaatcctaaactcttcatctctccctcccacactgagagggttaaaagcactggtgtgacaggccactttcattcaccccaaaacctggctgaggaggcagaaagaagtgaatgattctctcagcaacaggaaactctgttatttcagtattcttaaagatctcctccctagatctccttgctgccttataagggaaaaaaaaaagtttcctttctaactaacagaaagtttattgatttctaaatagaatgccagtgcttcagctcactggatttttcaaaacccagttgtatatttgaaataagcaacgctaccacatttgagcctttcactacggatctccagagaggagcttgacatctcaagtatctaatattgtttttcttttaaccttttccttcctaaagaaattgcagcgacaggttgcaaatcctgggcagtttcatgaaagatttcttggaacttaacaaagctgtcatttccaatacactcgatgcctttttttttttttttttttttttttggctcttgcatgtggtttgcaagaaggttcaactattctacacaccctggctgcatcaccaatatcaatatttaaaaactaaatgcaaaagagacagatgacctcctgaccccagaaagcaggcctgcaaaactgcaagtatctactgcaccatgccctgggatctttcctttttccaaatgaaccacaaaaatcatacatgtgtagtctggaaaacacaaatttatatccacaaggaggaacaccaaaaatccactcataaatgcatatataaacaatcaagaagtattgaaagtgcctgtacttgatgagaattgcaaaatcaattttaccagctcaggtaatcaaattacccagctcttaaactactactgagtactactactactgtctactactcttaaacaaaaaacaaaatcatacccagcccttaacgtactactgtcaaattagggtagtaattttttccccaccagagaattcacaactggttagtttccccacccccattgctagccctttgcactgaaatgaataaataaccttggacctttttctcctcctctgggagctatttggtgtcccctgaggacaaaagtaaatgagaaaaatgacgctgttaataatgtcactgccgaaatgcctctactccactgtttaaaaaaaaaaaaaaagcatcccactaagtgtgtctacatttctagcatatttacaagttataatacagttctgatctcaacaccaactgagccagattcctccactaaggttatccggttttcacttctcaacagagatgaggccagtgcatcaacagagattcccaacactgtaagacacttgcttcacagattacaaagtcagcagttgccctgtaacttttgcatgatgtattttaaactttgaaaatagaggtaatagttgcctcacttatccacaatgttacaaaggttccatatactctctcacacagtgtctcttgtctgctgatattgagagagttgcagttattgctctttttcaaaatagctgacctataaagtaaaactatatgaccattttatttctacaggtaaactggcttctattacccatatacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcctcatcacttaggcaggaatctgtagtatattgcgtcagtgagttggagtgcttgacctttgcccacatatgatttaatagggacttttcagcgctagagctttctccatctctcataccattaaatgaaaacatcaaacctcaaatgtaaaactggaaaccacaacgttttgtgtttcacaaactctttgcagtttttacttaggatgcttaaaggtcagtttctttgcctcacaatgcttttcttcatattgtaaatacactggaaagtcacactaattctgattttgattaaatcttgaactcctcagtcatatacacacatacaccctgcttatttacacgtgcattcttttctaaccacataagcatgcgtgtgttactttctggacttattccattttagggctgatttaaatgtctgttcaagtgtgggatcaaaagttaactttttcccgcctattggaagttaaagttacaaggatggtgctataagatccgttcaaagaaagtcagagttaatcttgtgtattttggcgccttttccctgccagctactgtacttggggggtgggggaaaaatacttagagatcttgtctgtcctgtctcaagttcagtggcagttcttccaacccgagcagaagatggccatgttcacagccctaataataattctgatcacgccacttcagcatcttgtgtcaaagtcgaaactggcttccccgcccccttcaatctgaaagctgccaagtcctcacacacttcacattcaaccacaacttaatggatgggatattgtgcattaaaatgtgtctcagacgtattggggaaaagaagacaaggagaacgagagatagagacacacataggaagaggaaaaaaatcggcagcaaaaatagcggggttggggggaaactattaacaggagtggaaagaaatccatcaaaatcggttttaaaaagttggtggggggtgcggaagaaaggctaacaataggatgccacaaattcagggatgaggggatgggggttaggactaaactttagaatgaatactgactttaaacattccaacacaccaatcagagttaaatagtacttctttcacttaaaaatgtatttttaaatgagaatatctgtgaattaaaatggagaaaagaatgcttcaagaggagagaatggcctacaaggtagaactaaagtatcatttgaacagtaatttttttccaccactgaggggagaggggcataaagcagagagttaaagcagaacaaaatgctagattctgcaccgtttggaccacaatgttactcactgattcccgtcataagagtgtgtcacatgtactaaagttgccaacgctaaataataatgcatatttgcaaattagttctgcaaatgcagcactatagcccacaacctgtaaaacaaaaatgacatttaggaaaggggtaaaacagccactttgcaatccacaaacaggaaaagaaaaactgtgccagggataggagggggtgcaaagaacgaataaaagaagcaaacaaaacccatcagttcaaagccacataccatcgcactgtattgcattaaataaaagagatcttgagtctgtaacagaaccctgggccgctgacttgacgtgtctcag

SEQ ID NO: 456 - DNA, 1601 bp, Homo sapiens
tgcccctttcattttgggcctctgacaatgcttcagaagttgtagtccaagcacacacaaatagtgccaggagtcgagtttccaataacttctggctaaaagcctcagagtcagtcagcctttcccagtttctcatgcaaaacgtttaaaattaacaaaagccacctcaaactacaattttcagaatctgggaactcttatatccaagagcaagatggatacacttggattgaaaaatgcagccaagacccacaaatgccaagtccttgccacagaacaagctgtccagctggaagaaactagaggaatccccaaaccatttgtcctctgactcaagaacaccagaattataccaagacaaaactgtgcagctatcactgttctgcacaggtgtaccgccttgtgaagtgatccgggagacttctgtgttaccaaaccctcctcacatacactcactcccactaaaacatctccttctatacaaattagaaactgaggctcccagaaaacaacttgaaaggaatgtagagaaacttatgattgtcagatttagcaaataaaaatacaaggatgcccagttgaacttgaatttcatacaaactacaagtaatttttaatataagtatgtcccaagtcttaaaagaggactacaaataatttgttagtgtgagtgtgcccgtaagtatttgggacatactcacactaacaaattatttgtcatttatctgagattcaaacttaactgggcattctatacttaacttggcaatttgaggaagggtgaaaaaagagaatacattattacattgcatcatggagatacagaccttaaaaataaaaatgttgtaggctgaggccaagacacagaagcctttgcagcagtgctaattgggcattataagtttatatttattaactcttttcagaaatcataatcttgaaggaaaatatcccaaatcatctcaatacagacaatatccgtacaaggatactacttgacatattcaatcaaaacaatatgaattcttacaaactaagaattggactagaatttagaatgtatgctcattggccttttagctatttatagctggagtcccacagataccaaatgtcatgaatggaaatccacatgcccatcattgacaatctaaacagaacttgtttgattaagaataaaggaggaggaaaacaacaaaggaaactatatttcagaatatgggaacgtgattactatcccaagaatataaaaaagtatttttatactatctgacataaccaaaagaatatgaattacatgaaacaagagccagaaggtacaaggatgaattaagaagcttgttaggcgagttaaagacatttcaagaaattgaaaatataggagtattagagtctttattgaaatcagtgaaggaattgacaatgtctatcatcgaattagagtttaaatatcagatgctgtctcagaactcataagaaaaatcaatgataaagagatgatagctctaaaatggtaaaaaaaaaaaaataaagtacacgagttaatttaaaaaggaaaaaaaggtttgcataagatttgccttctgcaacaataaattcca

SEQ ID NO: 457 - DNA, 1933 bp, Homo sapiens
gtaaaaagcgaggacgtgaccgttttggaagcattgttcttttcactgttagtgaggagcggtcaaggatgcgtattaagaaattactcttagaagaaaggaagcattgagagtaaggaacaaatgccaatgatgacaacccaaacactatgcctcatcggagcacaaagttccaagtgacttcaaagggttttctgtacttggagcagctctatgggacatggaagatgagaaatgaaccgacaccagaggtgcaatgaaaggtaaaactcatagcatcaccacagctcttagggctggtgaattaccagatctccgtcaagtgcagtaaccagttcaagttggaagtgtgtcttttgaatgcagaaaacaaggtcgtggacaaccaggctgggacccagggccagctgaaggtgctgggtgccaacctctggtggccgtacctgatgcacgaacaccccgcctacctgtactcgtgggaggtgtggctgactgcacagaagtcactggggcctttgacttctacacactccctgtggggctccgcactgtggccgtcaccgagagccagttcctcatcagcgggaaacctttctatttccacggcgtcaacaagcatgaggatgcggacatccaagggaagggcttcgactgtccgctgctggtgaaggacttcaacctgctttgctggcttggcgccaacaccttctgccccagccactatccctacacggaggagatgctgcagatatgttaccgagtcagggtctcactctgttgcccaggctggagggcagtggtgcaatcacagctcgttgccatctcgacctcctgggcttaagcgatcctccccactcagcctcccaaatagctgggaccacagacgtgcgctgcctttccagggtaaattttaatatttttttccccacgagtcagagtcttgctctgttgcccaggctggagagcagtgttgcgatcttggctcactgcatcctctacctcctgggttcaaacagttctcctgcctcaccctcccgagtagctgggattacaggctcatgccaccatgcccagatagttttcttctttattttttgttgagatggggtttcaccacggccaggctggtctcgaactcttgacgtcgtgatccacctgcctcggcctcgcaaagtgctcacaggcttgagccaccatgcccagccctaatttttaaatttgttgtagaaactaggtcttgctatgttgcccaggctggtctcaagcgcctggtctcaagcctcccaaagtggtggggttctaggcgtgagccacctcgcctggcacttgcactgttttcctgtgcatgcatctctactcccactgcccaggacctgtggacttagatttgagtcattactgagcacctagcacccagccccgtgcctacttcccacctcgcactacctgtttgcttgatgcattgataaatattccacctgaatccacagcccattcactcctgtgttcaagagctatttcaggaagtgaacctcattttcggcagtgttcagtccagtgacctcagctgtgtgtacctggcagggtggctacgcctctgggggaattggattcagaggtgggggagaaagagtgttgttagagagctcggtctaggactagaggaacgtgcccttatgtaaaacacatctcaagttagggaagaaagcagcggctctgtgctttgtgttttttttttcttttctttctttcttttttgtttgtttgtttgtttgtttgttttgaggcagggtcttgctctgtggcccaggctggagtgcagtagcctgatttcggctcactgcaaccttcacctcccgggttcaagcaattcttgtgcctcagcctcccgagtagctggagttacagatgcgtgccactatgcctggctaat

SEQ ID NO: 458 - DNA, 2109 bp, Homo sapiens
gctgtgggacttccaggagtccgagtcccatgctctgcctctgaggctggtggctggggtaaagctgggcagggctgagccaggcagggctgtactcaggctccccaatggtaggtacaagcaacggccataacatggatcagaaggcagtgctcaggccactggggcaatgcttcaaggaggagcataacaacttattttgtgccaaagagtcagcatgggaaaagagaagcagtttgtgttccacaacctagcagatggtagtgacacctgcctcactcccacacccttgacccagcaaggctccctcccataacccactcctggcagcaagctgaaacagtaagtcaagacacaagcaatctgtcttcagattacaaaactgtcctatgccacaaaactccctgccagggacaaaaacttggactcccaggccacacccctccgactccagtcctgcatcctgcagtgggactgcccaacgcttatgcccgtgtttcaaacccatgctacactcatctctcagatctggccatggggctcttcctcctcttaagactagattgcaaatctcattcttgagattctctaaaccgatgactaatgcttgttctggatgacagatttccgcacagccccctatgagttaagatcaggaatgatctcctattagcatcaaggtctgggagcatgtgcaaagtacttcctgctgcctcttctcacagtctcttcactgatcccagaattgtatcagttggaagagtcaaggagctcctctgtggcctggattgcctgactcccaagtggaaatgtatactgtgaagatactcttcccctctcaggaacttggaactcacagttttccgtcagacccacagtgtggtctgctgcccaccatatttttcaaagtatccaaagtttgtttcatttttatgttgagcttcctattctttccttgatcacaatgtgaatctctgcacactattttgctatttccaagtgaatgaggttcgctaacaaagcctctatgcctccatcttggagaaaaaaaagctaagtatcgatatattttgttttcatttttatttacttcaaaattttaaatttttactgagacttctattttgacctctcacttatttagaaatgtgtcaattttcagatatttggagctatctcagttatctacatgttactgacttctatttgaacttcattgtagtatgagaacatactttgtattaattctattattttatatttttaagatgtcttttatggcccaaatgtggtcaaccttgaagaacgttccatgtgatcatgaaaaaaatatatatatattctgccattgtggatgtactttgctaaacatgtcaactagataagttagtgatagagatgttcagtttaaatatattttcattttctgcttgttgcatctgtcaattactaatgggtaagtgctgaaatctacaggtataatagtgcctctgttagcctatttctccttcagttttatcaatattactgcatgtattttaatgttctcttgtatgaggcatacacatttaggattgttatgtctttttggaaaattaacccttttatcattagataaagctctgtagccctaataatctctatctttcctgatgtctgctttgtctgaaattaatgtagctcctttgctttcttttgattagcactttgtgtgtttatctttttacttttaacccagatgtatctttatatatttaaaatgggtttcttgtaagtgacatatagctaggtttggttttgttatcctcttcaacaatttctatctttaactggtatatttagaacattaacatctaaagagattattgagtgatatagttggataactatctactatgtttataactgtattctatttcttgtagttttttcctagtttattttttccttccaatttttctgaattctgtgattttaactgaccatgtataatatttaatttatatcatatattagtgtattaattgtacttctttttttaaaaaaaaaaatgatcactgtagaatttaccaaataaaatgtaagttaatctgtctttacctcaaacaa

SEQ ID NO: 459 - DNA, 1691 bp, Homo sapiens
actatgttgcccaggctggtttcaaactcctgggctcaagtgatcctcccatctcagcttcccaaagttctgggattttaggcatgagccactgcgcccagcccaatattgtattatataagcaaatcttgagatcaactctcacttctttaatataggaacaatgacaatgacagtttcctaactgaatacctgaccacaggggctagactacatgatcgcctaaaatctgttccagctctaagatctggaatttattatctgatccttcacacctgattataaagcttctgcttgaacatgtccatctacttcaaattctattgtttgaaagctttaatcattttttttttttttagctgaaactgtcatccttgaatttctcctcaggacagttctcctattctccaggagaccttcaaagtcccttccaactctgaaattttaagattctatgaaatgtagacgtatggagtgaggtttcaggcagttttgaaaggatcataactgtagtttccatttgcattaagtgtgaattgtactgaagtgggtgttctttggtgtaccccataatatctcaaacattatttggtatacagtacatactcattaagaattatagcctcattagactatgatatagattagtcaatctcaattctgatcatttaaactccattatatgctattaccaaatattaatcttttaaacaacagaaataattcatatatttgtaaaataaaatcaaaaacatagataggaaattgttaaaggtttaaattaaactctaaattccacgagagttgttgggcaagtcttcctttttctatgcacaactccctctggagtttttaaccctgtaccatgaaaattcctgatgagcaaaaacttgaaagcaaggtatgggaaagagttacaaatactctggtccaagctaaaatcacttgtggggatgatgcaacctcaatttaacagaaactacaacatcttccccttagtatgacaataaacttccagagaaaaatgcaagaaacaagaatgcctagagctgagagggagagttgggttaggagtgatggctaaggagtgcatggtttctttttgaggttattaaaatgttctaagagtgactgtggtgatgaatatataactctgaatatcctaatgaatatataactgtgaatttactaaaagtcactgaatttgtacacttcaagtggcaaattatatggtatgtgaattatatctcaaagctgatttaaaaaaaaaaaaaaaaagaaaaagaaagaaagaaagaaagaaaagcaaatatcctttaagaggtacttgaaacttacctccttctccagatccagatccattatctgagaagaaaaacaaagaatgaatatgaacatttttcccggaaatttcatcttatcaaataataaaatttcctatcaaaaataaaactgtgatatccattctcaaagagtccttttctcatatttttgatatcttatttattcttacatacttattttatgctgctcttaaaatataaattgcttagatacataatcatctatatttcatacatctttgtatcccattaaggacatacccagatgctttgcacagagtaaagacaataaatactgtaaagtaaaaggctaaatataaataattaattttaatccactcatttaaa

SEQ ID NO: 460 - DNA, 2669 bp, Homo sapiens
aaatatttttaaagcgtatgattaatacacttgcctattgctgcgtggactgtgctgggggggtcagggggcagataaatgaaagaggatagctgcacgcggcgttgactggctgattaatcactgcctgttttctataactcatggcagatggcaggagctggctgcaggccctcgttgggaatgaggtgctgcaggcaggatgaacaggggtcgggggagaccctggaaggccccagttgtgtcgtgttttttttcctcggccctacagacctccgtgtccaccccaccccctgcacttcgtggcaattcccaagttcaagagcagtggcgtagcttctgggaagacacaggaaatctcatttctcccttggattttttaggacctagataacgacactgtcaattttgggaatggtcaactttggggtggggagagtcaggtccagtgcaatacttgtatatattttatcttcaattctcccaacaaccccattttctagataggaattgtgaggcttggcaaggcagacacaggtattgttcccagctggtcccacccaaagcctgctcctcgctgtcctcccttttgccctccccaggggagcatcatcagcccaaggcccagaagtgaaggccctggagctggcacagctgccccctccccgggacctcggccctctccatccctgggggccactgcagtcttcccctggtacgggacacattctccccgtcaggcctgcatggctattgcccacctcaccgtgcacattcaatggtgtttttgtctcttgacttgtctttcccaggagatgatggatttcctggaggcaggaagtgtggccaccaccgggagtagctccaggacccggcatgggttaggctctggggtggtgtgacagatgtgtgtccggtcagcctagctgagctgaactgcagcacccagaactcccttccctgcacaggcttgggttatctggggccccaggggaggggcagagggagcagcagtcatgtcttccttttacactcagaaggcgagaggggccagtgcctcccaacacacaggggactcgcaggtgctgctgatctcaggagatggatttggtgtccaggcagctggggcatagctcttccagcccagccagagcctcctgtggccttcttgactcccaggccaggtatatgcttagttcatgaaagtgccggcttcttccacggggtgcccatcctcgaaggtagaggcttagagcaggggacagattgacttggggtctgccacttcccggtgggagttccagctcagcctgtcaggttccgtttgtcctcctaccccacttcatggtcatccccttttccccacgcccgccctgccagctccacgcaccggagaagcagcagttcccttagacggggtggccagtgcccaaggtttcacaaggccaagtccctgtaataggtcgtgtgtgtgtgtgtctgtgtgtgtctgtgtgtgtgtgtctacgtgtttgtgtgtctgcatgtgtctgtgtgtatctgtgtgtgcgtgcgtgtctatgtatctgtgtgtgtctgtgcgtatctgtgtgtgtgtgcgtgtctatatatgtatgtgtgtgtgtctgtgtgtgtgtctgtgggtgtgtctgtgtgtctgtgtgtgtgtctgtgtgtatacgtgtctgtgtctgcgtgtgtctgtgtgtctgtgtgtgtctgcgtgtgtgtctgtgtctgtgtgtctgtgggtgtctgcgtgtgtgtgtctctgtgtgtttgtgtctgtgtgttggtgtccgcgtgtctgtccgtgtagtgcgtgtgtgtgtctgtgtatgtctgtatgtctgtgtatgtttctgtatgttcctgcatgtgtgtgtctctgtgtgtgtgtttgtgtctatgtgtgtgtgtctttgtgtgtctgtgtgtttctgtgtgtgcgtgtgtgtctctgtgtgtttgtgtctgtgtctgtgtgtgtgtgtctgtgtgtgtgtctctgtgtctgtgcgtgtgtgtctgtgtgtctgtgtgtgtgtctgtgtgtgtctctgtgtctgtgtgtctgtgtgtgtgtgtgtgtctgtgtgtgtgtgcgcgtgcatgtcctctcacgtcccaatgttccacttctctgaactctgactggtgcaggtggcagagcctgtaggaacggaatgggaggagatgggaaacccttgtgggatgggaactgtcaggtcgggttctgcagactacgtgggaaagtggaacacagtgatcctggcagagggaacagcatgtgcaaagaccagggggtagtggggcacagtgcctgagcagccgtgggttcctgtcccgcccagaagagaaaaggtctgcagaggaagcagcggctgcctgagtggagcccagcccggcaatgggcagtgggagccaggctgggctttcctgcaggaggcaccacgtggttgctgcagatgagagagggtgatgcccccaggaactccaggctggcaggggttagggacggaattgacgtgggctgtacggcgttggcctagttccttgttggggatacaatcaggcgggagcggcctgtcccttaggatacaatgactgggctatagcagtcgtgctcttgatcaagttaaaaagtggctgctggtatcactggcccc

SEQ ID NO: 461 - DNA, 6804 bp, Homo sapiens
cggagagagcgcagcgcggggcacagcgggcggtctccgtgccgcgcgcgcgactggaaacggcgtgcagatcctaaaacgagggttccacagagggccacgaggggcaggagagagtccccggagaactctagctccccgacacggctacctcttggcaaacgagcgagaattggggcgcagagccttgggagggccgttccctcggcgggagcggcccgagcacagcctcacagcagatgcgagcgcggcgggcgctttggtgacgaagtagcgggacctgcaggaggcagaggcctggtggggccgtggacgccacgccgagctgcccagacccttccagaagacagtggggactattcaacggtttccagcagaaactaagccaggtgttcgttttacggagattgctcggctgcagggtggaggctggatgagaacaggcgtcctctcaggtaggcgctcgtggtggtaacgctgcccaggaggagggcacgggttccgggaagacttgcgaggttaaaccggcagctccggagaactgagcgcaagaggtcggtgacacagagaggagtccgggaggccgcatgtttcaggctgaagtcacttggcggggacgtttattgagatgcgaaacacaggaagggatagaggctgcgcagagggaaaaggcgatggactcggttttggaaacgctgatgtgaagtccctacgatgaaaaaagaaatcttccgatttctccctttgaagtctttgcttcttccgttgcaaagaacacagcctatgacatcaggttgaaaccaagaatgtagttctctgaaaatactgtgtgtgggggagggagtttatcttgtctcattccttacaaggatactttgctctccgacaccttagctccctgaaagtttcctagatcgtccatcttttcctcattttttcgactgcaagcaatgaactgttaattttttacagtttggttttacagccacacactttattcttctttgtcaagtttaaagtattctagggcttgtgccttcccacataaaatttagaataaacttgtctgtttctacaaaaagccatgttggtatttcgagaggaattgcaatcaacctatggatcaaattgagaattgtatccttattatgttgaatcttccaacccacgaacatgggtggagagagagttagaatgaaggcgaagtttcctacgcacataaagctcagtgagaaagcaattccaagagtaatggaaggaaaacgactctcgggaattcagtttgaacactggcgactgagcccataaacatctttctggaatgaggtttgcagaagaaagcagcggtctaacctgtggtagcctgtgactctgacattaacaccagagcggtgggtctcaaagtgtggttctcagacaagctgtggcagcctcacttgaagacttgttgcagatacaaattcccaggcccacactagaccctctggagcagaagctctggggttgaggcccgcaatctgcgctcccatgccctccaggcgattccagcacaggctgaggtttgagaagggtgctgtgaaaggggcagggaagccccattatataatgtttccagcaaggcagcctcacgttgcttcaccgaagtcactcaaagaagcctctgcccctcctgcttttccaagagtcgtgtcatttcaagacttccgcactggctgtagagagtggagacagccaggctccgagcccgaccccaacggcttccatgtttcctcgatagaatgtctgtgactaccaagaagatacccatatagtgatggtttattttattgaaaaatacactagtaatattgagacaggtatcttttaggccatctggctgataatcaatatagagctactgatgaccatactggctcacatttgccttgtccatcactgttcttggatccctgagaaccacgtactcgataaccttagagaaaagccccggctgtggttttcaacatgctttctcatccattatctcagttcacccttctcgcagatctccagaggaaaagggcagcagcagagcgatctgaggccccccgaaagggacgaagctgcggctctggactccaggcccctgccagaacagctctgcggaacgggagggaggaggaagcctcgagacagacagggcttgactgcaccctgaggcccaggaggcatggggacagagagtggggaaagcagcgatcccgcccccgttctgaagggaagagaataacctctggcaatttttaccttctagaatctggtggaccctggagtcccgcacgtactgctgaacagcgtaatccttcaggtagccgtagcccccgtgcatctgcaaggcctggttgcagatctgcagggagacagggactagacgtcttggactctgggaagactgtggagcaagcagcttcccttcctaccccagcccacgatctggcagcccgccataaacccatgaaagaaccacaaacagccaagctcaaagagggcctccacattctgtatggttagagacaagggaagttcacctactaaacttgtcagttccccccagacaggcgactcaaagccctctgcccctctcccttattacctgccaggcagaagctgcccacagccaccctggctgggatgataaaaagctatggttccccctagtggcaatgcagcctgacaatgtaaacatggcagagtgctaaattggggctgctgtgaaccttccaaaggtggtttctcgcctagaacacaaccaaacaacagtgacataatgaagtgtataatggcatgcagcaggcctaaaagccagcgatgagagctcccacataggccgctcatgagttcatttatatccttaagcttaaggtgatccttgtgggattccaggagggctgggttccaaatctgactcatgtctctcaagacccctgggcctagcagctgttccctgtccatcccaggagagccagaggaatcacttacggcaaagcattcatctgtagcaaagagcttggccatggagcacaaggccactgcatccttcctctcctcctgcagagccactgctgcattgcggaccatcagccgcgcggccaccagccttgttgccatatcagccagtgtgaattgcaagtactgcagcacagggagcagagaaccagacaagactgaggggcttagaccagcacctggtgcaggagcctcggtaagacatctcggaggcgccttttctaagtgatccaaagcttcaaagtctcttgctttttctatagaggaaatttattgcttttaagtgctaagtccacttcactcacccgacactttaatatcgttaaagatatcccaagaaaagatggacagaaataaagcacaagctctggctaggacagtggtgggactgacagaggaatttcctggcttctctcctggaaatgtgggccctagagcaggtcccgggctgcaaatagtgcaaagccatgtggaggcaaggcagaggttacctggttactggccagaggctctccaaactgcttccggacattgaggtggtctcgggtgaggatgacagaggcgtgggcagcccccagggagcaggaagctagaggggaagagcgccgacgttccaaccaagctggaaaacagcagtgcctgtcccggaccgctacctccctgccacacccctgcgtatctcaccaatattgatcctccctccgttcagtcctctcacggcaatgaggaagccctgcccctcgctcccaattctgttggccacagggacagcacagtcttcgaagatcacagctcgtgttggctgggagttccaccccacctggcaaaaatcagggactgcgtggttgcccaacaatccagcaggtagggcggccttccctggggacgggagcctgtgaggtatgggtttcagcacccaagacttagacccacaagaacttaaaatgaggaaaaagaaaaagttcaggtttaaaggcctgtcagcactcagaaagatacctgtttcagctaaacattttctaacttattaagagaatctactaatgtctactctacctgactaacctacaaacacttctcacaacttcttttaggattgtgacaccaactgcccccaatttcagtgcctctaattgaaaaccacaaactatctacaatctcccagttcctctctggctctgaaaatagactgcctttacatcatttccttgctctcttttgttgataggataaactccatttctaagccttttactgaaggtcttcctgcccaggagttagcatgggcttcacacacagtagaagcctaggaaatggttgctgtgttaccaaagagaaggggatgctaaaatgcataatgccttacagttacagaggatcaggaaggatcctgtaggaaaatacagaaacccgaggagctgtgagaaagaggtacacttaggggtcatttcattacctgccttctctcacaaagtccccccataacagtacaaactagagagagatgactgctttgagcatctggtctaaaaaatctgaatgggtcttgagcccttattaccaattacggttacatgatcacaagtctcctgttcatgccctggccatggcggctcttaatcctagaagtatcttacttttcaaattacttacagtacctaagtgtccttcttgggttgctgaaatacccacaatcatctccaatgagttttactttatttttaatcaaagaagcaaaagggaccacacgccttccattactgagacttgtggccaacaccaggtcttctctaagcgtctcttcctggagcaacaaagtgcaccaacgtaagcagctggataaggaacacaggccaaaagcagaggcaggagaggtcagaacactcacaggtggcttgaagaatttactggcaaacattgtcactttccccagaggcctagtgtttaataatgccctgttgtatttcatatgctcctgttgaaaatcctaatagaagcaactgcttcaaaggtaggttagcaagtatgcaaacctgttttctgaaatagagcaggagttgggctggcaggtggcagagtctcataacctgaattgtttcctgtccaacagccactcacctttttctccttcttgccaaagctgaggccaggggtccccttctcaacaactatgcatgagatgcccttggggcctggtcctcctgttcggcacatgaccacatagatgtctgactcaccagcaccactgatgaaggcctgtgggggtaaaaggggtgcaaaaggaccagggaatgcttgagttctcacagcgtctgggaacaccactgggtcctcctgacaataaggtccaatggcacagagactgacaataaggtccaatggcacagagactgacaataaggtccaatggcacagagactgacaataaggtccaatggcacagagactgacaataaggtccaatggcacagagactgacaataaggtccaatggcacagagactgaggtgaggtaaaaggtcgctgcagtgactgcagatcagagaggcagtccaagagagtataaaaaggatagacaaaagtcaacgaaatgatctggaatcagattaggagagatacaaacagtgagaataaagaaagagaaatgggtcagaggttctcttcccaacacataaaaatcctatgggagtattaacccgcggatgtgaaggaaccagaggatgtcaggaggaagctgggaacaatctccaaagtgctctgggaggacgcacgctagtaccttggagccattgaggatgtaatgatctccctgtttcttagcggaggtcagaagagaggcagcatcactcccacttcctgaggagggatcaaaaggcagcagagagaaggtgagaaagtcagtgaggtcgagggagcccagcacaattctatcttctaggaaatcttctctaaacagaccctgctcagagtgtgtcactgcaaaacccaagtggccaaaggaactctctgtacttggtggaaactgctcataccagtcaggccactgcctacctcccaacacaccagataggcttcttggtccttgtgacatcaggtcacaggactctattactcctcaaccaaacagctagataaacagtggctcgacatgtcaagaggctggaaggagtgctcggtaatgccatctgagcaggaagcatctctccctgctatatctcagtgcagtgtggcaaattcacctggttcagtgaggcagtaggaagcaaacttctccatggtacagagcggtgggcaaaatttgtgcctctgttcctcatttccgaagctatcaatcatccaggcacacatgctgataggtacaccaagaagaaaagacaatgacagaaataaagatggaaaagaaaaaaaaatgggggagaaggggaaagagaacaaagggcagggcagtggagtaaagcagaagagtgggaaggggagagtcacaattgggaagactctttaaaggcaaacggtggattaaaacatattcctggaataaggactacccagagataaccaggctgaggtacttctcaccagcacgtttgtactacttctagttaggttacacgagcctctaaaaatcagagttatatgtgctttctattagtagtttctattacttcctcaaatcactggcagttccatctttggattgaggaaaagggtgagaggggccgggtgcggtggctcacatctgtaatcccagcactatgggag

SEQ ID NO: 462 - DNA, 3341 bp, Homo sapiens
gtccggctgaggcgctctgtcccggctgggtgggtccctgagtgctcatttttcgttttccgtcagaggccgacctttttctctggaacgcacaagccaggtccaaaagttccttcagggcctccaggaaccactaaccaacgtccctgttgacctcagtttctcgcctgtgaaataaattggaactggaagttctggaggctgcctcggctctaaaaaagcccatttctggatgtcggacgtttatcctcagtctcttgcaatttcctttgagaacagccagttaaaaagaagtgagtggcaggtagggcaacttttttcagaaagtcataaatagttcgagtccactgctttcctcatcaataaagaggattcagttcaaccagctttcaatatttgttttttttttccaaaaagatcattactattcatccaaaaaaaaaaaagcttgcctttctttgatttcaacctaatactgtaggctctaactaatccttttcaaggctgaatcacgctactttttgtttcttaaaaagattttggccaaagatgctttgagattcttcttgttttaaacggctcatcagctgatgtctttaaaatgtttaattacataagaccttaaaaaacaaaaaacaaaaaaaaccaaaggccgcacggtggcttaagcctttataatcccagcactttgggaggctgaggtaggacgataatttgagtttaggagtttgagaccagactgggcaataaagcaagacccgcatctcaaaaacaacaacaaaaaacgcttcattctttatactgctgcacagttttatttggtattgttaaattaatagtttattttcctattgatgggcatttattaccaatttttctgctattacaacaaaaaagagctgtagtaaaccttattcaagccttgtttggataggattagtaggctgcatataaaagaaaactgactttttaaggtggtttaaacaagataaaaggttttattgtgattgacttttctttcacagaagcagtgtaaactcgaaactagggctggtatagtggcttctcagccatctggtactcagcctcttcctcatccttctatcatattagcctgtggcttccaccctcaaggtcagaaattccaggatggctcctggagctccagtcatcaagatgacattcaaccagaggaagggagaaggcaggccaaaccaagcacacctttcaagtggagtcaacttcttttaagcagcctacttgaacattgcatacatttctgtttacatctcattggctggaacctagctctccaagggaggctgagaaattgtcttctagctgtatacattgtcatctcaaatgaaattaggattgttataaagggaaaagaataaagtggaggttgagtaggcaactacgcctgctttccttcactcttaggaccagtgcaatttaaattctctcacaccgtaggagtggctgatattctacatattcatgcatgcatctgtatgtaaacacgctaagctatgacctttcctattgacgttgagcagaaacaactcataagaaaaagattttttcttttgtgaaatcataggggaaatgtcatgagctttctccccagagcacattgctccacccagtggcttggagccctatcctagtgcagtcatactaaaaaacatgcacagctgtggctgatcatgtgctctactgggaggggtcaccctggtaattcatattgccagcttcaaagttaaggggcaaacgtgttgggattcttggcccacatatctagttatagagaataagatcattgaaagttttacagaaattgttgggaatgtgtagaaagtttcagggctactgactttcctctaaggaggaaatcaattcggcatataatccactgatatgaaaacatctggatcaattgcattttcaacatttggatatttgaaacttactttagtgtttggaacttgattccattcaacttggggggaattttatttaccaaagacctattgttaaccaagaatcaggtgaggcactgatgcaaaaatgaatataacaatatccttactctggcagagcagataaacaatatgcagtaaatttcatgcagattacaggagatccgggcccaaagggatgatgtgatgatgatgataatctctccaatttaaataagaggaaatcctggttttacaattacacaatttgtctgaggctgcacagctagtgcagcggcaaggcaagaatctaagccgaggtgtactggataacaaggtccagtcttcttggagtccttcttccgccacagcaccatctaggttaatcagtgaggcactcaggatggttaaattgggagccaaatggaaaatgcattgaaaagtctggagcgaggagcactcagatgggacaagagtctgtgccaggtaccaggtggtgcagtgtagactggagaggacagatgtgaaagattgtgtgctcatggcctaagtgaagccacaagtctcttcagtgctctggggttaatactaaccccacctctaagtgattcagtgactgtggatggtaaagttgaatctcagatctaattagtgtcttaacctgagctcatcctggcatgcatcattccacaacagaggagggtgaagcaagactttctagtactatttggaagcaggcgggggtaatattcaaaatgttgaaaaactggagtagcacaattaccagttaatcagaactgaggcagatgagctgatgggtacagtcaccattgtgccaaacattaaccctctaatgactgactcatgggaaggcataggaggagaggcctggggatgggctgagagaggtaatgagtatttaccattttgcacttttgttgctttttaatccaatgtaagaatagacgtactgcatacttcctgggttttaccagcccctaaatttactcacttaaaaaatttaattacatagacacgaatcattcattgtagttgctaaatattggtagcaactaactcgttgccttttgttggaatttcagattttcagtagagaatgtgactggcccagtctgaggcaggtgtccattcctggtcaccaccattatttttgggcagaagagcatactcacagagttaaacataataattaaaattgtgttttcctggctgggcatggtggctcatgcctataatcccagcactttgggaggctgaggcgggcagatcgcctgaggtcaggagtttgagaccagcctggccaagatggtgaaaccccgtctctactaaaaatacaaaaattagctgggtgtggtggca

SEQ ID NO: 463 - DNA, 5191 bp, Homo sapiens
tgatgacaagatcaaatccgcacatatcaatactaactttgaatgtaaataggaaatgacccaattaaaaggcacagggtgggctgggcatggtggctcacacctgtaatcccagcactttgggaggcccaggtgggcagatcacttgaggccaggagtttgagaccagcctggccaacatggagaaagcccaaatctactaaaaatacaaaaaattagccaggcatggtggcgtgtgcctgtagttccagctactcaggaggttgaggtgggtgaatcacttgaacctgggagccagaggttgcactgaactgagactgtgccactgcactccagcctgggtgacagtgcaagaccctgtttaaaaagaaaaaaaaaatgtcacagaatggcaacctggataaagaagcaagacccaatgacccaatggtatgctgtcttcaagggacccatctcgcatgcagtgacacccataggctcaaaatgaagtgatggagaaaaatctaccaagcaaatggaaaacagaataaaagcaggggttgctattcctaatttcagacaaaacagactttaaaccaacagagatcaaaaaagacaaagaagggcattacataatggcaaagcattcaattcaataagaagacctaactatcctaaatatatatgcattaacacaggagcacctagattaataaagcaagctgttagagacccacaaagagacttagactcccacacaataatagtgagagatctcaacaccccactgacagtattagatcattgaggcagaaaattaacaaagatattcaggacctgaattcaatactggaccaaatggacctagcacaaacatctacagaactctctaccccaaaacaagagaatatacattcttctgattgccacatagcacgtactcttaaattgaccacacaatcagacataaaacaatcctcagcaaattaaaaaaaaaaaacataccaactacactttcaagccatagcacaagaaaaataaaaaatccatactaaaaaaattgctcaaaacgatacgattacattgaaaattaaacacctgttcctgaatgactttggggtaaataatgaaatcaaggcagaaatcaagaagttctttgcaactaatgagaacaaagatccaacataccagaatctctgggacacagctaaggtagtgttcagatggaagtttatagcactaaatggccacatgaaaaagtaagaaggatctcaaattaacaacctaacatcataactagaggaattagagaagcaagggaaaaccaatcctaaagctactagatgacagaaataaccagaatcagtgctgaactgaagggaattaagaaacaaacaaaaaacatataaaacatcaacaaatccaggagttggttctttgaaaaaattaataagatagactgctagctagactaataaaaaaaggagggaaatccaaattaacacaattagaaatggcaaagggggcattaccacttacccccagagaaatacaaagaaaaaaacacacacacacacacacacacaaaacacaaaaaacccagacagtactatgaacacctctatgcagacaaactagaaaatctagaagaaatggataaattcctggacacatacaatctccaaagactgaaccaggaagaaactgaatccctgaacagattagtaatgagttccaaaatttaagcagtaataaaaagcttactaaccaagaaaagcccaggaccagatggattcacagccgaattctaccagatatataaagagctggtaccattcctactgaaactgttccaaaaaaatgagcagggactcttccccaactaattctgaggccagcatcatcctgatacaaaaccaggcagagatgcaacaaaaaaagaaaaccccaggccaatatcccaaatgaatatagaagcaaaaatcctcaagaaaatactaataaactgaatctagcagcacatcaaaaagttaatccaccaagatcaagtagactttatccttgggatgcaaggctggttcaacatacatagatcagtaaatgtgattaatcacataaacagaactaaaaaatttcccaaaaccacataattatctcaataggtgcagaaataaaagagatgtgaataaaattcaacatctcttcctgttaaaaaccctcaataaactaggcattgaaggaatatacttcaaaataacaagagccatctatgacaaacccacagctgacatcatactgaatgggcaaaagctagaagcattcgccttgaaagctggcacaagacaaggatgccctctcttaccactcctattcaacatagtactggaagtcctgtccagagcagtcaggaggaagaaataaaaggcattcagataagaatagaggaggaagtcaaactctccctgtttgcggatgacataattctatatctggaaaaccccagagtctctgcccaaaagctccttgatctgataaacaacttcagcaaagtttcaggatataaaattaatgtatggaaatcagtagcattcctatacaccaacaacatccaaaccaagagccaaatcaggaacacaatcccattcacagttgccacaaaaataattaaaaacctaggcatacagctaaaccagggaggtgaaagatttctacgataagagttacaaaacactgccagaaatcagtgatgacacatacaaatggaaaaacattccatgtttatgggtagaaagaataaatattggctgggcatggtggctcatgcctgtaatcccagcactttgggaggctgaggtgggcggatcacgaggtcagcagattgagaccatcctggctaacatggtgaaaccccttgtctactaaaaatacaaaaaattagctgggcgtggtggcaggcacctgtagtcccagctgcttcggaggctgaggcaggagaatggcatgaacccgggaggcagagcttgcagtgagccgagatcgcgccactgcactccagcctgggcgacagagtgagactccatccaaaaaaaaaaaaaaaaaaaaaaaaaacacagaatcaatatcattaaaatggccatagtgccaaaagcaatttacagattcaacactatttctatcaaagtaccaatgacattcttcacaaaattcaaaaactattttaaaattcatatagaactaaaaaagagccagaatagccaaggcaatcctaagcaaaaagaacaaagctggaagcatcacattacctgacttcaaactatactacaaggctattgtatccaaaacaacatggtactggtataaaaacagacccattgtattagtccattctcacactgctaggaagaaataaccaagactaggtaatttataaaggaaagaggtttaattgactcacagttccacatgactggaaaagcctcaggaaatttacaatcatggtggaaggcaaagagaagcaggcaccttcttcacagggcagcaggacacagtgagtgcaagcaggggaaatgccagccacttataaaaccatcagatctcgtgagactcacccactatcacgagaacagcataggggaaaccacccccatgattcaatcacctccacctggtcctgcccttgacacatggggattatggggattacaattcaagatgagatttgggtggggccacaaaacctaaccatatcacacatagaccaatggaacagaatagagatcccagaaataatggtacacacctacaaccatctgatcattgacaaacctgacaaaaacaatgggggaaaggattccctattcaataaatggtgctggactaactggctagtcatagacagaagattgaaactgggccccttccttacaccacatatgaaatcaacttaagatggattaaagacttaaatgtaaaacctaaaactataaaaactctgggagataacttaggaaatgtcattctggacataggacctggcaaagatttatgatgaagacaccaatagcaattgcaacaaaaacagaaattgacaaatgagacctaattaaactaagagttgttttactgaaaagaaactatcaacagactaaacagacaacctacagaattggagaaaatatgtgcaaactaggcatctgacaaagttgtaatatccataatctgtaaggagcttaaatgaatttacaagaaaaaaaaacaaccccattaaaaagtgggcaaaggacatgaacagacacttttcaaaagaagatatacatgtggttaacaagcatatgaaaaaaatgctcaacagcattaatcattagagaaatgcaaatgaaaaccacaatgagataccatctcacacagcagaatggctattattaaaaagtaaaaaaataacagatgcaggctggctgctgtggctcacgcctgtaatcccagcactttgggaggccaaggcaggcagatcagctgaggttcaggagtttgagaccatcctggccaacgtggtaaaaccccatctctactaaaaatacaaaaattagccaggtgtggtgccaggtgcctgtaatcccagctacttgggaggctgaagcatgagaatcacttgaacctgggaggtggaggttgcagtgagcctagatcatgccattgagctccagcctaggcaacaagagtgaaactctgtctcaaaaacaaaacaaaacaaacaaacaaaaaaacagaggctggagaggttgccaagaaaagggaatgaagggactgcttatacactgttggtgggagtgtaaattagttcagccactgtggaaagcagcatggtgattcctcaaagaacttaaaatagaattaccattcagcccagcaatcccatttttgggtatatacccaaagaaatataaatcattctaccataaggacacatgcacatgtatgttcactgtagcactattcacaatagcaaaggcatggaattaatctcaatgttcatcagtggtagagtggatgaagaaaatgtggtacatatacaccatggaatactatgcagccttaaaaaagaatgaaatcatgttcactgtagcaacatggatagagctggaggtcattaccctaagcaatctaatgtgggaacagaaggccaagtactacatgttttcacttacaagtggga

SEQ ID NO: 464 - DNA, 1951 bp, Homo sapiens
ttgagagaaggttataggacaccattttaaaaattctaatagatactagtacaagccagttgaaagtaagctattgtgaatgtgaatttccatctttttctttacatgttgattgatggagtttgaagatgaaatcccaaacaaacaaaggagtatcaaaatgttctgattccactatgtcatcatcagatcactggcaaatatccagtcactgttccaaagtactattgagtgccagctgactttatagaatgtgaaaaaataaagcaactcttatagtcaaatgtaatttcttagccaccataagcatgacagaaaactattcttttaatcattgaaaaactcttgatcaatgagccctaaagacattgatccaatccagtgctaaatcctcctacaggaaaatgtgaacatgagatttttccaataagggtccactggaaaaaaaataatagtaatagttcatgaagcgctagtagcagaaagctaacactgtcgagtttttctcaacatacatggtatgtaactctgtctcccctcagtgaacccattcagacatggcctcaacagaaatttgtggaagtatatttccacctaggcatcactgaaaagctagtactcttcattgtctatttcagcgcatcaaagatatattacattatttgacctaagcaattactacatgtttcaggatgttttactgctgatagattatataaagaacaccctgcaattcactaggcagtattggaaaatgcatgggtatccactattctgtgtgtttatagggaaaacaatataagaggtagcaagttcaacttcatattagatatgctggcatctttttaaaaatgtttggaggattcaggctcatgttcataatatatagatactaatatctcaagtgataatgaaacaacatgacttcctacaaatcagcaacatagaaagattaaaagttgtaggaaattggaacttccccaaaattcaaaagtcaaagataaaccagttcctccagtgttcctggcttaatagagtggctttatataacaactgctcaacagaaaaacaaactcaatgcattaaatctcaacaactgcagttttctggctttaccatcttgctgggtatacttctcaaaagacaaagcctaaacttcatctcaaagcaaggtggtctttctgatcacgttgaaatattctatcaaagagcaaaaagcttttgaaggctgcagtaagttttaaaagtaaaagagtgaacaacctggtactatccattattgttttaatgtagggcaagcaggtaactcttgctgctggtgggcatgaagaaaagatcatttttaatcctttgtttcaaagaatgtataagaatgccatttattacaatagccatgataaaaggaaagtggtcctccagtaagaactggtcatctctttgactgaatcattttcaatattcttgaatattgtgtcatgctgaaaatacagatcatgtgggttatccacgctgtggtataaaagcaagaaatctgtaatagagacaggccagctgtagacctaaatcagctgtctctcaatgatattaagcatcttctgtgggatattcgccaggtttaactgaatgggagatggtgggtgaacaagcaccaaataggtgagtctttgactataaccccctctgggctctatggccaagtgtggcagatcccagagtgaacacacaatgataatgttgtagctggggatcatttgccacagcaaacaaccctgtcgtatttgacaatgtttgagataaatttctctccctttattgaaatatgttgagaaagactgaccagtttaaggacacacagaacattgtgtaattcctaaaggttgtatcctttgtactggaaagaaaccctgagctagaatttcaagaaaaagtgaatctagacaaaatgacaaaa

SEQ ID NO: 465 - DNA, 6164 bp, Homo sapiens
gggttcatggatctgtcctgagaggaggacgaggtgtctccaatgccaagcttcggcagcagaagcagcagccacagcgtacacaaaagcccgaactgttgggaggcggagggtggagggatcctgagagagggactgcggccggatgcccagctgtcggagccccggccagtgtcttctgcagttacattgccttcactggtcatgagaggaggggctgtggtagggccttgaaggacgcctgtggagccagaggccattggattgcaggcagccaagagctacctcgcccctgctatctgctgtggccctcgccgggatgcgatgccctgacatgggttgcctggagctgtgcgcaatgagcaaggggacggctgatggccctcccagatctgcatggcctggaaaccataaaactcttgggaactatcacatcttccccagctacaggaagaatagaagtagtgttggagaagtcaaggggtcagaagtactgggggcgttcccaggttcagccagaaacagttcacaagagagttttaaataaagtgtacctgtggctaaatatgacctactgattactcttaattttttcgccacatttattgagctatgatttacatattgaaaagtatgtatgtttagggtgtacaatagagtgcttttagatgtgtatatatctttaaattacctcaagctggttaacatatctatccccacacatagttaccttatacgtttctgtgtatgtggtgagggcacctgagatctacttttgtaaacaaatttcaagtacaggttattattagctatagtcaccattctgcacataaggtccccagaagttttttattatgtaactgaaggtatgcacccttcgatgggtatctccccacttttccccaattcttagcccatggtaactaccattctagtctctgtttcattttttctttctttctttctttttctttctttctttaagatttcacattaaaatgagatcaagcagtatttgtctttctgtatttcgcttatttcacttagcataatgtcttcaaggttcatcaacattgttgtaaatgaaacaatttcattctttattaaagctgaaattatctctttctcacagtttacctatttatttgtatcagaggagtgcaggtacgcttggtgatactaattttatgtctattggctgtatactccaaattgggattaaagatacttctagtttaaaaattttaaggaacctccctactggttttcttgtttgtttttttgtgttgtttttttgtttataatggctgcaccagtgagcatgttcagcaatggtggacaaatattctcctttctctgcaccctaacactttttgtattttgaatttttgataatagctgtgctaacaccacgatgaggtgatatctcattgtgattttgattttcattactttgataattagcaatgttgagaatctttttatatacctgctggccacttgtatgtctttgggaaaacatctattcagatattttgcccagtttatcaggaaattggtttttgttttgttctgctgtgagtttttttttccacattgactagtgttatgtatattttggatagcaacatcttatcctacatatggtttacaaatattttcttccatcccatatattgtctttatattttgttgattgttttctttattgtggagaaagtttttactttgatatagctccacttttttatttttgcattagttgcttgtgttctttctgtcaaagccaaaacatcgttgccaccaccagtgtcaaggagctttctccctgtttttttttttagaggattcattatttcagttctaatgtttatgtctttattttaaactcatttttgtgataagagaaggctttacttttttgtgtgtgcatagctagttttttctaacaccatttcttgatgtgtctatcttttcctaatttggtgggatcagtttactgtatatgtgtgaatttatttctgggtcctctattctattccatttgtttctatgtaggtactatactttcttgatgagtatagctttgtaatattgtttgaaatcaagaagtttgaggctttcagcctttttattcttctcaatatttggctatttggggtcttttgtggctccatactaattttacaaatgtttgttttacatttattttaatggcattaaaattttgatagaaatttatttaactgtagataactttatgtagtatagatattttaacaatgttaatttttagaatcgatgaacacaggatatattttccattttgtattcttcaattttttatcatcattttatagttttcagtatgcagatctttactattcttcgttaaactcattctatttaatgacttaagtatttaattctatttgataatattgtaaatggaattgttttctttattcctttctcagatactttgttgttactgtacaaaaatgcaactgattttcatgttaatattgtatcctgtaagtttattgaatttgtttttcagctataacatggttttgttgttgtttttggcaaagtggtgggtatttttaaggctagttatactttacatggatagttgctactatcattctttaaaatatgaccacaagggtttctgttgtcatgacttcagtggaattcagatcttcccatttgaaataattttgtcggttttgcctgggccccgggatgggtgggggggccaccccacgggagtcgggagattcaggataaggagggagaagcggtcagggaggaggctgagcgcggaaagcagacaggctccagggacagcagggaggagagggattcctgtcagtgacccagtggggagagagaatgggccagaagaggggaaagggtgggagtgggcatcaggactgcttcctgacacgggtggggggcagggaactttgctaaaactgcaggccccagggaacagtgcaggtagggtgggagggagtagagaagaccaggcggaccccaaagtcatttgagaaaggggtatttcccagttccttcacctctgcccagcgttctgtgggcatggaccccagggccagggtaggggaggaggcggctcctggcatgcagggagagctgaggagcgcacacccgctttgtagggcggtgtgatggtggaagcaagtgaaggctgaggataccgttggctcagtggatgggctcggggggcaggggtggggtcgagctcacagggcccagcacccggacctgcaggtggccctggaggaatccacccgcccgtgccttccaagagaccagtgtgcgaggcgccgcggacacgccttttctagctggaacatttgtgaggctggaatttaagctctggcagacaggcggcagaagaaggactggaagaaacccaagtgcaaagtccagcccaaggagaggaagcggaaatgcctggcctggtcaaactgtgctctgactagaagattctgggctggatggtcaccgtcctatagagacgcaggctcagtgggacttcgaggagcaccagggacccagtgcagcaaagcagagcgggcggtgaggacccacagctactgcttccctgcacagttcgccttctccaaggcccagcccccagctgagcccagcagtgagttgcatggagcctcctggaacactgcctcgggtgaccggtggaagaccccacctcccagggagaggaccgtactatgtcctcagacaataaagcagctcctccgaccagaaaaataaataaataaataaaatataaaaatgttgtttgcttttcgaaaataatttgtatcctgtttactggtcaacatactgcccatttctctatatgcctaattagtcaaacttttaaatgaaattatttaacattacgatttttattatgaaacaaaacagtaaattttgtaatggttttaatatcatctaataggattgaaaatatgtcaatttgtcattgccaatgaatatttgtgttatttattttatactgttagatattctgtctacaaatgtctaatggcttagaatcttgcttaacatattgtatgtgctaagtcctaactattccaattcatcaaattatctttttataccattcttaaaaatacaatattattttttatttttattaaagttatttttctaatataaatatttatgaaaattataaagtctattcagtctgccctcttgtcagttgccctcttgtcaaaactgaaaaaaagtcagtttttttctctttattaatacactagagggtataaatgtagcttcattacagggacatgttgcatagggatgaagtgtgggcttctgtgcaacaatcatctgaacggtgctcattttcccagttaggtattttctcattcctaacccctctaccaacctcccatatttgtgagtctccagtgtctatttttccaatctctatgtccaagtgtatgcattattgagctcccacttgtaagtaagaaaatgtagtgctttatgttctgtttctgaattatttcacttacaataatggcctccagttgcattcatgttgctgcaaaagacatgattttattctttatggctgagtagttttccatggaataaatgtatagtacattttctttatccaatcattgactgataaatttaaactgactccatatcgttgctattgtgaatagtgctgcaataaacatatgagtgtgggtatcttctttatgtaatgaattattttccttcgggtagatacccagtagaggaagtgcaggatcaaatggaaattccatttttagtttttctgaaaaatctttatactgtttgccatagaggttgtagaaatttacactccctcgaacaatgaataagtgttctcttttctctgtatccttgccagtatctgtcatttttctgctttttaataattagccattatgaatggtataaaatggtacttcattgcgatttttaattggaatttctctgatcattggcaatgtttaacattttttacatgcttcttggcaatcattgtcttctatttgaaaaatatctgttctcattctttgcctgctttatagtgaggttacttgttttattcttgttgtttgatttccttgtatattgtagacattagttctttgtcacatgtatagttcacaaacatttttctcatttcatgggttgtctgctcacctgctaattaaaagctccttttcaggaactttttagtttaattaagttccatttgtctatttttgttattgctacatctgcttttgagatcttggtcatgaattatttgcccaggccaatgtccagaagcatttatcattgggtttcttctagaatttttatcatttcaggtctaacattttagtcttttaatccatgttgagttgatttttttacatggtgagagtcacgggttccatttcatacttctgcatgtggtaatataatttttcaagcacaacatgttgaatagaatgtcatttttccatgtatgcttttattgattttgtaaatgatcagtacgtggctttatttctaggttctctattctcttacattgatctgggtgtctatttgtatcagtaccatgttgtgttggttattcaagctttctagtataattttaagtcaggtagtgtaatatctccaactttgttctctttgcttaaatgtgctttggctattcagactttgctatggttacaaataaatttaattcttttgctaattctatgaaaaataacattggcattttggtaggaattgcatttaatatgtagatttttggagggcaatatggtcattttaatgataattcttccaatccattagcagggatgtttttctcatttgtttgtattatgtacaatttttttcatcaatgttttgtagttttccttgtagatatctttcacctgtttgattaattgtatttccaggtacttttgtagctattgtaaaaggaattgactttttaatttggttctcagcttgatcattattagtgtataaaaatgctactaatttttctacattgatttttaataatcctgaaacattattaaatttcatttatccaatctaaaaggtttttg

SEQ ID NO: 466 - DNA, 3231 bp, Homo sapiens
tgaaagtttgactcggtcttttccttccaacagttataaatctgtgaaatgaaagtctttgtttccttaaagggatttcaagaatttaacaaaagggttggggaatggaacctttgctgtcactatgcctgtctctcaattctaccctaaaggtaaactaaatggaatccttttatggtgactaggattaggatgttgattccaaagcctttccctaaaatctattccttgctccctggaaaggataatacaggttctggcccccactgtaggtactgacagcccaaggcagaataggttttgctaggctttagccttttattctttgacataggtcagtcctgcaggcttcttttttctaagtctcctgcctatccaaaaccagaccttttctcccacctccttctgcttcaagcctcttaataatccatatttctattttctagcaatagtaatagtttattatttagtgatgtatacttgcaccccatttactccttttcaatatttcaggatacatctttgtcctgtatttctgtaccagttcacagaatttctacagcaagatccctttaaatgtatggctttccttcataggttgcaaggattactttatacaagtgctactgtaactatatcttttgtggagtacaattggtatgacatgctgtgttcatagatgaaaatgctaagtgaggcactctgaagcaagttaaagttcacagacattcttgcttgcccaccacccccccgaaccccgccatggaatcatcaaataagaaaaataagacagattttcagattggtgatggcaaagtaagacgctggtattttgcactggcgcagtccatttagttgttgaatttgttcagcatacctggatggtgagtgagttagctttatttttcattctcagcagggaaactgatagactaggcagtttggggaattttcccattgtctactgtcatgggtccatagtatttaagtttacagactacaacattgtccacagaagccatatttatccccttggagggaagggaaaggtgtgctaacttagatcataaaaacaactgaattttaaaacaaggcaaatgccacagttcaacttctccataaaaaagttaagttcatctctccattcttttgcatgcctacaatatttccatataacaactgtaaaatactcttgcctgctgcaatccaaatgttatccggatcacagttcttgctgtcatttcacaggcatgcaatgtatctatagataggtcatatcatacctgaggaagatcagagacagcaagggaacattttccccacacttgagatggaaataataacaggtcagtggctaataaaaagaaacatgtatgactttgtaaaaccctaaaagtgatgttttcaagaaatttaggtttcttttttttattttataaaaaaaatgttgacatgcaatttaattctatttcaatttaggtgctgcaacctgtactggatgtttggggatagaaagatgaatgggacatgatttgtgtgctccaatgagctcagtccagtgtaagtgtaaaagttaaagtgccatattgtttattcagagtatatgttatagtttgtgaaccttatatcatttgttaaatgaaaggtttttataaatcaacagtaatattgccatcccatgtaaaaatcctttgatattgccaggaaacaactttaaatcaccagaaagctttaacatcaaataatacttttagaaggaggggaaaagccttccacctcgacatcgagcctatgaagtattccctaaaaaagaggaactaatctgagaaaagtttacacatttttaatactctaagttgtagataatgaaattgatttaaatcaaagttaactagaataggattcatgtgtcatgaattatattgtctattgtctcataagcaacaagtgacacttattatcttggctgacaaaatcagctaccatttaatgaaccaagttaagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacac

SEQ ID NO: 467 - DNA, 8083 bp, Homo sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagagcccttgggacccatcctcccccgtcctttatttgtgtagtcttatgaagaatccgcagcgtaagaattactttctaacaatggcatctaagagtggaaagtttaactcatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 468 - DNA, 7975 bp, Homo sapiens
actcactgggatttctgttccagcagcctctccgttctagttgtgtatccactacacacatttttggttggtgtctacaatgcctcggctccatgctgggcactgaggacactgcaatgcaccagaaatgatccctgccctgcaggagctgcaattgcctcttggtgactgtttctgacacactttatgtggaagttggttcaatcaggaaagagacacctctttggacccccatctctcacccagtccacacttcctggtggtgactggtcggctccctagtttcctggtctggcctgagcagccggatcttctcctacgtacctgcttcatttttcctgctgcctgaagagacatccagcaaaacagaacatggagactgaggacagaaaagagaaagaagcgtagggcaagacccctcctccaaattgcagtcctttaggaatttctggagaggtaacctggggtctccccaagcttcctgcagcccaaccaaccaacccaccaacctggctgatgcatatgtggaatatcggcttcctgttctctgaagggcaaaaaggacactgaagtatagcctacaggctctgcggcccaaagctcattaagaagataatagatttaggccagccgcagtggctcacgcctgtaatcctagcattttaggaggcctaggtgggtggattgcctgagctcaggagttcgagatcagcctgggcaacatggtgaaacctcgtctctactgaaatacaaaaaattagccaggcctgatggtgtacgcctgtagttctagctactcggggggctgaggcaggagaattgcttgaactggggagacggaggtttcagtgagctgagactgcatcactgcactccagcctgggtgacagagcaagactctgtctcaaaaaaaaaaaaaaaaaaaagaagaagaagataatagatttagaagacacacaaataattgtttaaaagaatggccctaatgtgctgcagtctgaggtggaaggttagtaaggtctggacttcctcggaatatgactgagttttcagatcacgtgagacgtcttcatggaagacattgaggtagttaccacatcttctggatgtcccacagccaacagcatatcaatttgggctccttcagacattaaaagcaggaattggattagtgtagctgccggaggtttcccactgtctccactcccagtttccacgtgcatttcctctggtgctcatcaagtgtacagtgctgctgtggtgagaatttgtcaaatgagtctccagtctcagaaggtctatgtaaatggggtttcaagtcatcacagggactgaatttagtctcaagtaccataaagaaaatacttttaaagctcttctaaaaataaagctcctctgaagagatgtttggcctgtggctaatgtgtttggaaacatgttttctgtaaaactcaaccttattcatctacttgcaaatccagaaagacaactttcactacacacatcagggcttgtcccaaattttccctactcacagtggaagatgccggggtgtgaaccattggcttaaggtgcctctgcctccctttccccaaaacagtttaggaagggagggtttgggtctagtgtccagcctgggctcagctttggatgctggcaacctggacctaggcacaccagggaggctgctttctttgcccttgtcttgccacttcccatctcccatgtcataggaggagcttggaaggagctgaaggccgtcaccttcctacaaagcagagagatcctctctccaagaacggcttttgctgccctctgggtcctgctatttccatggctcctgaagaatcagcctctgatatttcaattgccccttcatcagaactgtcaaacctggtgaatctcttctctttttctctggctcactctctctaaaacacgcatcttaaacaagttttaaaatccctgaagaatggcagaaatacaaagaactcaattccaaataatattgtcatgttctgctgcatagttgaggtaatcaccgttaagtaagtgcaggtatgggtgactctctaagacaaggatgaaagtacagtggacaggtgagcccatggcccaggactcaggcactcacagcctcccacgtttcttctctatttcacaattgctgatccaaggcgggaggggtgccattcatgtgtggcattcacatgagagaggtgggcattgtgggtcctcagtgcagggcctgttgtgtcctcaatgaacccaggattgagtcccacagtggacagactttgccaacttttataaatctctctcaagacactctcctccaatattgcaccttgaactgatgtaatttcttgtagcgaaaaaattaaaatctatcctttttgaccttcatatgcaacatgcatatcaagagagttgtcttagcagcagcaattttatattgggagatttgagcatggactggctgttgggagagctttatgaggcattccatgatgtcttggctttaattttgcttttattttgatgtgacaagatgtgttggactgagatgcctttgggctctagccctggaatttacaaaaagagaatactgcagggttatggtgggggtgaggctggaagatgttacccactcacaaagcttcagcacagcaacatatgttagaagaataaactaacattggaacagtaaatacacacatacacacacacacacacacacatacacacacacacacacagagtgggagagagtgagagagagtgcaaagccagtgttaaatcctggacatccctgcagggtcctcatgcctgcctttttctcttagtcttgtgggggtggggaaactctttggtattctcctttctcacttgtaggaatataaggaggaaaggaaccagaagtaaagtgtctgggcctctctcagccatgcttttcatttccacttattatctaaagtaattcattactacttctgtgctctcttttcatcttttccttgagcctcccctgagctcccttgaaggtggcaggtgacaggctggcttgaccagaacaaagacagttatccctggctgccgcctgtttcccaatgggtgcctgccctgtcttgttacacttcctctgtgtgtctaatttacactgcaagccctctgggcagtggctttttttttcttttttaaaaaattatctgctcttctctgcttacgactgaagtttaacttctgcaccccaactcctcctcattcttaagaaaatgccaacagaaaaatattaaaatgattgctgctgtatgtaaagacagaagggtaaaaccgaggcactggaggctttgggtgggtattgatggaggtctgggagcagctggtgattgacagggagaagagctgaattagttaaggaagggtctcctgggttttgctgggagtggtggccagacacagacaaggacaaggaagaaggccaggacctctgattgcttttctcagaacagaaaagatattattatttgaacctagaggctgggcagtttcctgtcatagaaaaactgactggcctcatggccagagaaaggtaccaactactttctttggtatttatggttctcgtatccaacgtaggaagttagggctagacaacatctggaagtatctggtagaagtatctatttatttaaatcatccatccattcatctatccatccattcatccactgatccatccatccacaatgattaactgcagtgaaagagaagacatttttagaagataaatgtggtcaaatgtcctaaagttttattcgcttgcatgcaagtaaccgtgatgtgtctggaggactggagggctggaaatgaaaggagaaaagcaattatctgggcccatggatttgggaagcagatatggggatcctctcactgctgacagagccccagtaaagcatctggaagggttttaaacagaatgagggtgtaacaatgacagacgtattcttcctccttcaaaatccacaacaaaataaacaaccaccaccaaaaaaaaaaaaaaaaaaaaaaaaaaaataggagaggtcaattcaggaaactttcctagaaaagtacatgaggtagaagagaaaggatagggaggagaccaagcattctaggttgcaaggaagacctaggggatgcctgagggtggggatgaagggactgacaaacatgttccatgggccatctatgggtagggcactcggtcgtgagagtagtgatggcacctgaggcagggctacaggaatagatgaggtagggagccctgtcagggtgcagtaagcatcccatggagaaggcacgcactgtgggcctggagcttactggggaggtggaacaagcagggaagcagtccttggtgcaagcaaggatgcacattccacatcaggctgcccgcccacgaggagggcctacacttgtggctctgaatccatgtggaggcggaaacggtctggttaagatagtgacaatgtgctttgtgtttgtgcctgaagggccagggaccacgctgtggcacaatgaaggcattgagagtcagcagtccccaagactaggtgtcctaacaagatgccaagacccagagagacaagagctgagcccttgccatgaaggtgccgagagctgtggtctcagcccttggaaatatcatcaaaagaagctgttccgagcaaaatgcattccatgtgttggccttgcccatgtgtttcttgtcaatgaggccgatcttcctgggttcagaagggtttctgtttgaaattttatgagccttggctgggaagcagaacttatccctgagtttgtgggagttaatggccttttctggcggcacaactctgggggcctcagggaattcccaaatgccaggaaagaagaaacccatagcccgtatttcaactgaaaattatgctttatttataggcagccatggagaaaagactccccagaacacttctccagcgtcacctcagtgtggtgtgtctgggctcacaggcccttccttggggtgacccttacagctcatgccagcactctgtggaaaagatatgcctcactccccagtgccaaataaagacatcagcctacatccagagcagaaacagcatttgttcctgagtcttccatttttgccatttaaatagagaagtcaaactattccttgatacactcttgtccccctaatttacttcaaccaacacgtatggggcacagactgggaactggtcattttattgggcatcattatgagcacaaagggacagatatgagatgggcaatccagaaggtcttggttcaagccatttccttccattgtctatcaagttctgtcaccgggacaaatcatttcccctccctggacctctgcctcctcatttgtcaaatgaggagcttggaccaatgaatatgaattctgaagaaattcagtgtaagaggaagagtcttaaaatactagtcctaaaaggttaattgaaggagattcatggaagtgatgcaaatattggtgttttgtatgagtgacacttaactgcttcttgtctatggcaaatgatattcctggggtagctaagaaagaccctttcgctgcctggcgtggccctctgtgaaccctgctagcctgacatgtcatatcagagctccctgcagaggagttgctgttcacagcaatcatctgggccaggctcttgacctgtacccctgtcagtgctttgctgtcttggcctgacccttggccttagctgttctctgccctttggacttggggttgctattttctcttcccatcttgattctcagttttccctcaaggtcttggctgagacccacccatggactcacctttcttttttcaaactacctcagataggatttgagtgccctgtttgatcccttgtgactcaatttctgttgctggacaaagaaaaaagaaaggcaagggaattggaaactttacagtataatactctgctcagcagtaagtattgcaccagaattttagtcaaaaggagtatgtataaaataaaccatgttagatcgagctaaaatatgactcactgagaattccaactctaggtcttagatttttcctttgaggttacacatgaacaagcctaattccttctcatatgatagatcttcacatatttaagtataatgatcgagcccccagccttcggtgaccaccccctctcctgccaagtcagttcttctctaggcaaaacaagtcaatttctctagcattcctcagatattttggttttgaatccttttgccgacgtgacggctcttcctaatccagttcaactgatttctgttcctcttcctttgaggtgcctgcagcttcatgcaacactctagacaggctccagtcaacccagggaactgaaatcttttgccttaaattgatgcttcccaaagtgtgttccattcatccaagcccctgtgacatgctctggaggtcaagggtaggtggtcacttagtttcacagtcaaatatgtttgggaaatcctgcagactaatatccctcttggagatttcagaatctgtgttagagtactaaaggatctgagtagtcctgtttacctttacttcatctaatttttcccgaattattcgaccactgagccgtttgttaaagtattactcattaacctccctagtgtgccatgaagctttgggtggcactgttcaacttccatttaagccatctgaaatcatttatttttttcctctttccctccctttctccgttcttttcttccttcttctatcacactattattacatattgattttagtgtcaatcaaacctcctacatatttttcaaacctgttgctgataaatcatatgtaaagtccttcacccttcttccctttatttgggcagctgttatttgatattcatcacttatgtattaagcatgcctttatttaagcccttaataaaaatgaaacttcataaatatttgttgaataagtacaggactgaggcctataccctttggacatggtaattcaattagctattaattatcctaatcacactaatattcagcccatgtttctctatgcttgtccgtgaggctatcttgaaatgcttgtcaaatgctttgctgcaatcagattcactatgaagttagatttcataatctaccagtctagagccatcttgttgaagcaggagatgaaattaatatggtaggactttgtacttcaggttcctgcgcaggagtttagaaacacaggtgagccttgatgggagggtaggatttaaaaaatggaggggatcataaaaaggattgtgggctggttggggtaagcatgagtaacggactacaggcaagtgtaaacatgttgggaatggttaggataaatttaacaatatttatccagtgttcactattgtgaggttttatgcagggagctggcagcaagggggttggttgagatggataaatagctaataattaactttataagtaccacttaaaagataaaatgtgatgagtgttacataaaaggaaggagtaaagtaacatagaacatttgttctgcagagtcagggaaggcttcacaatacaggtggcccctgagcagctatgaagattgggcagggctctgccagagaatgatagagggcttcaggattcaaaactttgatgatggaacagatctgtgaatggaggtgtcaatggattaacatgacttccagattcatgacctctttcttggacctgggcaaagccttgtggcattttagatggagctgggtgactggcactatgaccttgggctctgcctgaacctcacgtggatcatctataacataaaggtagtagtatgacagtgggggtgaggattgcataaacagtggaagtaaatctcccacatatcaggggtgcttactgaacctccttcctctcatctctcccagcc

SEQ ID NO: 469 - DNA, 10138 bp, Homo sapiens
ttctgtagctgagctgggtttgggctttactgttaatttagtaagattctgttcaccacagacttcatgtgatttgaaggccaaatcagaactctccttttcttgggctcaggtgcctgtgggctccatcttagctcccctgcctttccttgggtgtcgtctggctcctgacatctgcacctgggggaaccctccaccccctccccctccctgtggtaaacgccccctgctttctggggtgcctctggggcttcgctcggccttggtccctgcccttagactgcagcaggcttcgtgtgcctgcgcccgagaggtggggccctctgcttccctgtctctctgcaggcttcatgcgcctgcccccgagaggtgaggtccactgcttccctgactctctgcaggcttcatgcgcctgcgcctgagaggtggggccctctgcttccctgtctctctgcaggcctcagaagaaggcatggggtgtatgaagggctcgtcccccttcacgtatgtgcattgtagtactactcacaatagcaaagacatgcaatcaacttaaatacccatcaatgagagactggataaagaaaatgtggtacatataaaccatgaaatactatgcagccggaaatcaaatgtttcagaaataattaagcaaatcaaagcatggaactctctaaaatcattattatttataccatattttagtgagagcaggaaatgattgacgattccaaaattacacagaaacttttcttttatataattcttatctcatccttcaaaaatgtctttttgttatgtgatgtgtataacatagtaacagttcttgtacacaacttttaaatacgtgtgcatgctcattgggattcacgttccgaatttcaaaacgtagttcttgtttcaggaagttcagaggttactcttttggaagatccattcttggatgtgctggcaaaagcactgttgtagagatgcttttgggggaggctgcacatcattcatgaataagtcccaaaggcagcatttctaataatgcgttgtctaatatgtattagagctggcttggaggtgtccctggggagcccctctttccttcgcatccatcccggaagctcctcgagaggtgcctctgaaagggatgtggtgccgtcatccctctggagctttgaagccatgcagccggacttcagcaagaatggttgcatggactgttcaaacccgcacctgccggccagcggctgaagagcccgtgttgaccataagggacaggaaagggagcactctctgcacagcctcggggccctgctgtggcccttacctgggagggctggcctggcgcaggcacaggctgctgaggaccagctgctggccggccctgcccgaccaaggccacctgtgttttcattcccaaatttattttctggttatagggacaatgtccctataaccagagtggtattaatgtgtaggtggcacagttgtgtacttatgggtgtggtttggggaactctgtcttaaagagactgccggctccttgaggacaagaacttggagttgcttccatgtttcctgttgctaaaccaggttggcataaagtgggtgctcagcagatgtttactgagccgaatcccatgtacctacaggctccaaggttcccgctgtgatcattcaaacttatggatctcctttgagggacagctggaagttgtttacagaatcagacatggagactttctccttcagacggaatctaactggtcagttttaaagctgtggcattccctggcggggccactgtgctagttctccccatggcgggctttataggaaggccccctcttcacacagaagccgggaaggcgtgcctcggtaagggtatagccctgagtgtctgcaccccccaaaacccctgctccctgctcgtgtgtgacaatctgacttcagacagttaatctttctggctcaagcatttggaatggagatggactgaacccactgggcgttttagttgcatgtaagccgcactccgggctgagcttgccgagctgacttcactgtctgggctgcctgcctggggtgctgggagccaagtgcccatttccagaagctcgctgtgctcccccaggtcagctcctgtctgcctcacctcaccgtggtctccttttcctaatgcgtgatggagaccagcgtcgtgtggcatccatggaccccatcgaggaccttttgatcagtggtggggttgggatggggacaggaggtggtggggttgggatggggacaggaggtgagctgctcatggtgttgatttcttctcctcgcagacacaaggagattcagaggtcctgtttgtgcctctgtctgctttttcttcctggaaattttcttcctgggattcaggacctgaggaaggtctgggtgtggcctcagctttgggccatgaaacccatctggacagatcaggctgacctctgggaagcatctgtgtgtggtttagacagggagagaagctggatggaggggagtggtgctgaagtgggttgagccagtgggggtcaagcggctaagctccagaggggggtctgggctgcaggcgaggaggcttcctggggtcctcaggcggcccctgcacccccagctcagtgggcctggcgaggaggcttcctggggctgtcaggcggcccctgctccccctgcctcagtgggcctggctgtccccttagcacaacggcgagttccaacactggatccctgggagagcatcttttgtttgcttttgtttagtttaaaaatagatatattaggaatcaagatgagatgaggttagtccccaaagttaaattcctcttccttgcctttgagctgtgccattccgaacgcgtctcctttagtccccctaggatccggtctgggctgggcttgcggatgccaggcccccccgatccaccgtgtcagggccagctccatctgtcctgtgtcagtggggtcctcaaacaggatttattttaaatcatcactgcaggagataatctattttccataataatctgcaggtagctttactaatttcctctggagcggggatggaggctcgcctcgcttccgagaggctggggccgcgcctggctgcactgatgccttatcgcccgtgtcctcacgcaaggcttcactttggtgtcaggatctcgggggctcagaaatgcgggttcattgtgggtggagggtaagcccttcctcagcaggtcatgaccagaggtggtcggacggcaaggactgctctccaggcacgtccagcagggacagtgcggccgggccctcccctcggccgctggaggctgcagccctcaggtttctggcagtgacaggcgtcctccagggagggtctgagtcgcaccctccacattggctgaggacccagctcatgctgtgggagaggaggaagcttccatggctccaggactgtcttcctgaaggaagttcgtgggggtgggtggtggaagggggtccggccctaatggggctcccgttgtccctcagcacggcctctgctgggggtggtggcctgaaccctcactccaggggcccaagctccaggtagacgtgcccagcttagctgtgtggttgcccttgggaaccacagtgggtcgggaatcaggcgccccagggatgtctggctctacactgtccctccctcccacagcacaaggcctagtcccctccctgccctgcccagagcccccagttcctgcactcgcgacccaactcctttgtccccactgactcctttgtccccacctttacagactatccctgtccctctggcgaccccgcttgtgcctgctgcttcctgctgttatccctcccggtaccacattctaatcacttgcgattagatcggcactcaggcctctggacacccgagcatgacttctgggacaagctgtgtcttctcccccaacctttaaaaatgtgaaccatgattcaggtggtgaataaaagctggcacggaattaagcggtggatggatgcgacatctttatcgctgtgtcctgattgtggtgcaggacggtcctcgcggtgccgtggctgtttctgtggcggtcgtcggcgcactgtggtggtgactgtggctcacatgcacccttggaggccctcggaggtggcaccacatctgcggacacagcagccccggtggcctcaccctctcactgaggattcccgccatcacctggcgacatcccctgaagattctttttaagaagtctgtgccctacacggcaacattaggctgtaggcgtcacgctcctgtgattgtgaagtcaagcgaccgcggcgtcaggcggggctccgtgctgtgagtgtggccaggcttgcagctgtcagtgctggggagaagttcaggggtccgggcatctgggcggtccttctctgatgccacatcctgggaatggaactccctgaatggaggggcttctctccgttttctcggggcagttttgtgatcggcattggccttgtgttccttccttccctcactgatgtgcacccgacgcctgcatgtggactgacggcctggggtcaggacgctgctgggggtcaggggtgtgtggtgggctgtggcggggtgtggtgaagcctgcctggcctcgagcccggtggaggctctgggaagccccctgcttcctagtcctgacgggggccggtctccaccttcctttggtgttccagagacctgaagcggaggggccagtgtggctccaaggtggccggggctgtgcggtgggctccggagcccccgaagcactctttttctgcagaaccgcatctgggcctccggaaggaagctgcaaatgaaccggcagcagcttccccgatggccctgtcttggcagccctcatccgggcaaggactctgtgggagagcagggccactctctgtgatgccaccgccgggatggctgagctccagcgtggtgcccgtcctgggtctgagggcccggcagccgcccttccgtctgctgccaggagtgtgtgtgcccagcactggagagcagtgagaggcactggtttcccagcacacagtgtgcgcctgcccgctcactctcccggctccgtgtgtgcgcccctcatcagccaggtgctcgctttcccggctctgtgtgtggggccctcaccggccagtgtgtagctgcatggtgtttctggggggctgctggcctgccaggcatggcctctcagtggccagcatggggtctgggggtggtctgggatggccaggcgaggggctaggggctcgggggcagctgtcagcccttgggtgtcaccctgcacttcctgccctgtggccacatcctcccaccctcttctctgtacatcacgctgaagaacaaacaaaaaatctcaccaaacgcgtgttggaggtggccaggctggctccattccgggggccctggtgataggtttcaggatggcagcagcagggccgtgggatggggagagtggactcagctcctaccgccgtgaggatggggagggaggggacaggacgtgtaaccgtggacgaggaagggccagggatggaacaccgtgaacaggaagcatcagggtgaggggctccgacagatttgataggaccacggctgatggccggcagggctcccatgacgctgatgtgccggtattttcacccagtggagcggctccccctcacgaggacagagcgggaagccccaggtcaggcctcattgtccatggcaccagtcccctgccagcctcctgatgctctccaggcgggcaggggcctttcgggccaggggaagaaagtgacacccgcccttctgtgcctggctttgggtcacctgtccccgttccagggcagcgtggcacaggtctgagggctctgctggtcactcagcccctgaggcagccccgccagcccaggcccgagcacctcttccctccaggctgggcacagccagtccccacctcccaccttctgcctccgccagtcccgggacatggagtcacaccttggaggagattcacactgtgtcatcagctggcgcgcaggtgactccggagcgcggatcgtgccaatcggcccagggaggctccgcgccgtcaccatctctccccacgccctccgcccatccctgtccaccccctgacccacacaccctcggctctaacccgggatttcgggttttgctgccatttagaaatgacattcttacttgttgaattctaaaatggaagcaacacagctgtctagtaaatcaaatttagtgaataaacgagccgttcttgtttagtattgtctttaggtcttatttctcatgtctcctttcattagaggttttcattgtaatctcttcggctcaacaaagacaaccaaatctgccctgttaattttgtaattgaggtctatgcaaacatattgccatagccatggaaaatgtttactctttttcagctgaacacacagtacatttttagttgaataagatccaactgaaaggcataaatcaagcgtttaaaaatagaaagaggatcgcaaagcctagtatgtcaatatgctcgtcaagtgttaatgcagaaaggcagagttaggcggccccgggcgctggaaactgcgtttgacctcctccctgcccctctgcgtctacagttcagttctcacagaggcctctggcgggaggagccaccatttagaatacagatggccaaaggaaacaccatttttaaatagttactttaaaaaaatcctttcagatgaaaaaatctgctatggttgatctttctggtgttggtgaaaggaaagagaaatctccgtgtggggaggccctgggcagcgttcagggaccgagccctgtggagcggaaaggctcgagactggacctatcttgcaaaaacaaggctcctgttagcagaatcgaagtccattgaggagctggaagaagacaggtcccttctctaaagcactgtgattagctcaagctcgttggatttgcacttttggagaagatgtgttcagtgagggctgtggaaggctaggcaggctggacgcccggctagaggccaagcctgcagacggcagaaaggcgaatgcaccttccagatggccgcctttcctgaagaactgcctggggttgcatttgtggaagccagccatccttcatcaacaaagcaacaaatatcgattgttcaatttacacattttcattttcataattttatttgtacacatttgaacaccctgaggtttgtaaacatttagtaacttatccaaaggtcacaggactatccacgcttcaaatccgggcccctgtcctggacttgcaggggtgcaggatgaagaaaccccagcctgctgtgagggacctgaggctgctgggagagctgagaagtgtgtgcggttgcaatgacgaagcgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgatgaagtgtgcacggtggctgggagagctgggaggtgtgtgcggttgtgatgaagtgtgcacggtggctgggagagctgggaggtgtgtgcggttgtgatgatgaagtgtgcacggtcgctgggagagctgggaggtgtgtgcagttgcgatgacgatgtgtgcacagtgacggcactgcaaaatgtgacggaggctccgagcaggggttcctaggggccggaggctgggtctaccctggttggggctggcccggtggaaggaacgagaaagacagtctcaggaacagtgacgtgtggagatgggaggatgagacacgcccccagtactgaaggagaccctggtggtggcaaaggcgggttgggacagaatgtgggaggctttgaacatcaagacacgagtctggactcatttatagtcagtatttttttatgagttaaacaaaaagacgtgtggcattttggggtctggacacttttaaatcaatgactcctaagtgtttacaaagcaggaaacaaggtttgaaccatgagcttcaggagcaggacgggctcctggagcctgaaaggagcccagtctccctctctgtgggcggccggatgctcctgacttgggtcaagagggagagtcgttctcctggtctctatgccgggctgtgaccactgcctgtcattcaagatgaccctttcggggtgttgaggactgaggcagctctggaatgtcaccctacctgtaacctaacctgcccagcttcatgggtgctgggaggagatatggggctctgaggtcagggagggaggacagcttgttacagcagtgacagtggctgtgaacccgcaggaccccatgtctactcagccccgtgaagggaccagtgctgccgcacacaccatgagtcagggtcataggagagcacccctgagtcttctgccacagaggaaggcactgcctttgccttccagggctgtatttgctttcaggcgtccttgaacaggtaggcctgaacaaaggggaggccagtgtctcgctacatggggtgtatggaaaatgtgccacccgcagagaattgccttccagtggtgaatcggtggcagctggcagacccagctgagctgtgctgtgggtaagccagtggtgggagaggcctcgcccctggaagcatggtgcccatgtgttgccgccacgtccctggggtctctgggctggagttccaaagtcgtcttcatcatgaagaagcacatccaggctatgggcagaactgtcttgaagccgtccagctgtttaaattctacattctgtggggcatgcacggggttggcttattcaaccttccttccattctccctgtggttggagaagacagagaacaaaacaactcatttccaagatgcttggcagctgggcagagtccaccaacgagaggcacccaaaggcaatccaaaagacaggcggaagaggagcgcatcttgttgccattgtgccatgtttgctggaaagcaccgttgttgagatgtgagtatttctgcgtgatgtccgttcttcaaaccccagacgcagttggatggcagcggatggcagccgtgaccccgcgggctcccggcttctgctcctggtccccagctggctcaggtgaatccatggtcaatggcagccccaggaatggcggcccccatgatgggtgggctttacattgtcctgcaagtagtttctgggagccacagccaagtgagaacttgcttcaactttccagtcactttcagagacaccagcattacctcctttcctgctgaagacacctggagtggcttcccttctctgcctcaaaccctgactggttcacattcttagttcataccttactgttgtttacaaatcacctgcaaactcttggccacagtgcagcgggggcggggctgagcactctgctcctagggtgtggccatcgtggctgagcactctgctcccagggggcggtcaggcaggggtccgggatggagagagggcggccccattaggggcgatgagatgctctcgaatctgatttgatcatccccactcctgctcctcagccccctggagccgcatgtctccttcaaggctgctgtgatgtggattttcacctggcgtccatggatagccacgtccagtggggaggggtgtgggagcaggagagcccctcgggggccccaccctcctcctgcgcacgttgctgctgctggaatggcaggacacaagctgctccagactcagtgagccctcattagtgagctttcttcatgggctcaggaagatctacggccctttgtctacttttgaataacaagttatcccaaatgcaatggcttaaagcacacattatggcacagtttatggggtcgggaatccagggcctgtagctgggcacctcctgcccagggcttctcctgaggacagcaagctgtggccaggcccaggtctcat

SEQ ID NO: 470 - DNA, 10865 bp, Homo sapiens
gactcagggctgcggccggggtcctgcggggtaggagcgcgaggccggcctgagggaggaggcctagcgacccatccggcgcctcccgccccgggcacccgcccgcggccgcgcatcctgcgggccccaggaggcctccatctcaaaacaacgtgtttttaggtaatttcaaacttagggaaaagcttcaagaataataccgaaaatgtcagtgtccccagcacctagatcccccagttaaatccttttccatttcaccgcgctgccccccgccccctggacggttatgtggccgcgtggggttggctctgcccagggccgcggtcactgcacagaacgccctgcacgtaaggggctccgcctgggtaagaccccgcccagctgggcaggaggagggcgtgggcccaggacatggagaccagcctgggcaacatagcgagaccccatctctgcagaaataaaatattagccggacggtgcacggtggctcaggcctgtaatcccggcactttgggaggccgaggtgggaggatggcctgaggttagtgtctcacatgtctgtgtgaagagaccaccaaacaggctttgtgtgagcaacaaggctgtttatttcacccgggtgcagcccggctgagtcggaaaagagagtcagcaaagggcgatgggattatcattagttcttacaggttttgggatagacggtggagttaggagcaatgttttgcaggcaggtggtggatctcataaggtacattctcaagggtggggagaattacaaagaaccttcttaagggtagaggagattacaaagtacattgatcagttaggatggggcagaaacaaattacaagggtggaatgtcatcagttaaggctgttttcacttcttttgtggatcttcagttgcttcaggccatctggatgtatacatgcaggtcactggggatatgatggcttagcttgggctcagaggcctgacaggagttcaagaccagcctggtgaacatgacgaaaccctgtctctacaaaaataagaaatgaacgcagcatggtggcatgcacctgcagtcccagcctcttgggaggtggaggcataagtcagctgtgaatgcgccctgcactagagcctgggcagcagagcagacccttcctcaaacccaaaaagcgtcgtgccaaccagaccagatggtcgcctaatcaatagagaccatgcccaatcaggtaaggacagacacaaccaggcatgctttttcttgttttgttttttgtttgttgttttgagatggagtttcactcttgttgcccaggctggagtgcagtggtgtgatctcggctcaccggaaccaccacctcctgggttcaagcgattctcctgcctcagtctcccaagtagctgggattacaggcatgcaccaccaggcccggctaattttgtatttttagtagagacgggggtttctccatattggtcaggctggtctcaaactcccaacctcaggtgatctgcctgcctcggcctcccaaagtactggcattacaggcgtgagccactgcgcccagcttgttgtttttctttagacagtgtcttcctctgtggctcaggctgaagggcactgggatgatcacagctcactgcagcctccacctcccaggctcaagccatccttcttcctcaggctcctgagtagcgggagctacaggcatgcgccatcatgcctggctaatttttgtattttttgtagatacggggttttgctatgtagcccaggctggtcttgaactcctgacctcaggtgatccctctgcctcagcttcccaaagcgctgggattacagaacatgagccactgtgcccggcttattgtacagtctttactctcggttttcaccagagaactcaagggctgtgaaaagagcaggacctcaccagctgcacggcggtggtgactggctccatcttgctgtccctcccaatcacacaacatctccccttgaaggctctgcccaggcccggactcccacctttcaagatgtctggatcagtgcaggacctcctccttggccacatcgctctccttggactggttcgttaaccctgttttacccacattttctttttttttctttttctttttttttttttttctgagacagagtttcattcttgttgcccaggctggagtgcaatgactcggtctcggctcattgcaacctccgccttgcaggttcaagtgattctcccacctcagcctcccaagtaggattacaggtacacaccaccacgcacagctaattgttttgtattttaggaagagatggggtttcatcatgttagccaggctggtcaggtgatccatccgccttggcctccccaagtgctgggattacaggcgtgaggcactgtgcccggcctgccccccttttctcttgatgcacatgacagccttcttgcaatcaagaaactacgtgtggccaggatctcatccactatcacagtttcagctttccccaaactggaatgtgtctttgcagacgcccatccttattaaagggcaaagacttctcatacacctaggatggatcttatattcttggcgggactgcagagaaggtgccgtgtcctgagtcctcatgtcagggcacaggcttccagccagttctacctgggttatgtttatctcaattccctggtggtattggtgtctgctgggttttgccagaatgaagacaccgtgttttcatttgtcagttgattcgtattttccaggaagacattctgagattacagcattgtcttagtcaaggtgctgcagaaggacagaactaataggatatatgtacatatgaaagaaagtttatgaagaactggctcacaccatcacaaggcaaagtcccatgacaggccatctgcaagctgaggagcgaggaagccagcagtggctcagccggagtccaacagcctcaaacggaatccaacagttcaggcttcagtctgtggccaaatgcccagagaccccggaaagctactggtgttagtcccagagccggaaggccaaagaacctggagtgtgatgtccaagggcaggaggaatggacagaagcatccagcatggggtaaagacgaaagccagaagactcagcaagctagcttacctactttcttctgcctgccttgttctagccgcgctggcagccggttggagggtgcccacccccactgagggtggatcttcctctcctagtccactgactcaaatttcagtctctctgggagcaccatcacaccagaaacaataccagccatctagccacccttcagttcaccatcacaaccattgtcttattcatgaaacttctgcagacccaccttaacctccatcggtgacttctacctgaagccctctgattgttgcccagtggtgctttttaaaataatttccatagtttcttctacacctttagttggcattctactgtaaaggagagattttattttcttactcatttatttgttagtttatagtcaccaccatatggatgcagagttctgtctcattcactgggaagtattctattgcagtcatgatttattttgatgttcacatcccagagttggtgagtgagcgccccttcacgctggctcccgagtgctgacgtgtccccgtccttctctgcacttttccttacctcctggcctcagatattccagggtcatttgttctctccctgctccaaccctgcagtcagccatctccctagggacgttggttcctttatggaaggtggcatttagaagccaggatttgggctgagcactgtggctcatgcttgtaatcccagcacttggggaggccgaagtgggcggatcgctggaggccaagagtctgagaccagcctggctaacatggtgaaacccttccccgtctctactacaaataaaaaattagctgggtgtgttggcacgtgcctgtaatcccagttactcaggaggctgaagcaccagaatctcttgaacccaggaggccgaggttgcagtgagccaagattgcaccactgcactacagcttgggtgacagcgcgagacaccgtctcaaaaaggataataatttaaaaaacagcaggatttgggtgagcagtgcgctcattgcttctgggctctctcggtggacataggctaggaatgtaagatgtatgtgcctgtgtatatacacacgtctgtagctatgtctatgttgcatacatgtgtttttccaaaaaccaaatccataaccatgccttcagtttcagcccaacacctccgggctctttctagctttctacctttcatgattgtgaataccttctccagcagtgagaaacctggctcctttgtcctcagtggattttcttatttgctcaatttttttgttttttgttttgtttttgtttttgagacagagtcttgttctgtcacccaagctggagtgcagtggcataatctcggcttaccgcaacctctgcctcctgggttcaagcgatactcctgcgtcagcatcccgagtagctgggattacaggcatgtgccaccatgcctggctaatttttgtatttttagtagaaacggagtttcaccatgttggtcaggctggtctcgaactcctgacctcgtgatctgggtgccttggcctcccaaaatgctgggattacaggcgtgagccaccacactcggccaagtcagaattttaagtttcatcttttttgtaattaattgaacacctgcattcaaagaaacagagaagtaccaccacgcataagtaaggtggccatggcgtacctaggtttctcagcctatcaagcttaggggcttctttttacgtgaagtcctcctaagacagcctctgatagctgccttgtggtcagcagggaagaagggccttgtaatagcacgactctgcagggaggcgggcagctctcatggccttagtttgcagacctcgagatgtccactagaaaggaggagatcgtggctggctgcggtggctcacgcctgtaatcccaggattttgggaggccgaggcaggcggatcacgggatcaggagatcgagaccatcctggctaatgtggtgaaaccccgtctctactaaaaatacaaaaacttagccgggcgtggtggcgggcgcctgagtcccagccactcgggaggctgaggcaggagaatggcgtgaacccgggaggcagagcttgcagtgagccgagaattgcgccactgcactccagcctgggcgacagagcgagacttcgtctcaaaaaaaaaaaaaaaaaaaaaagaggaggtcgcagcgtctccagtaacacatcaactccgcaacaaggggccacaagtgttcctcgccaacgggtccctgctacgatccctattttaaataaggggaaactgaggcgtggagggggtaagaaacagagaagtcagaattcaaacctggacgacgcctgttagttttttgggattacaggggtaagccactgtgcccggccacacgtgttagttttttgggattacaggggtaagccactgtgcccggccatgcctgttagttttgtaactccagcattcctgtctctcctgcatttgtcaatagcactagtcctttgtggtgagttttttttttttttttttttttttttttggagacagggtcttcctctatcgcccaggagtgcaatggtgcgatcttggctcactgcaacttccatctcccaggttcaagcaattctcctgcctcagcctcccgagtagctggaattacaagcacccaccaccacgttcagctaatttttgtgtttttggtagagacagggttttgccattttggccaggctgggctcgaactcctggcctcaagagatccgaccacctcggcctcccaaagtgctggggttacaggtgtgacccactgcgcccagcctttttttttttttttttaatacagattgggtcttgctatgttgaccaggctggtctagaactcctggcctcaagcgattttcccaccttggcctcccaaggtgctgagattacaggcatgagccaccgtgcccggccaggaccacccctttggagtgatacctctccccaattttatgtggctctggtgggtcatccctcagtgtccacttaacagtgacagtgacgttatgtcctgcttttcccagaagagtcccaggttatgttaactgttctagcaaaattattcagagcaccccattttcagtctcagaaatgtctccattagtgtcatgtgaagtcaccctaaacgaggtcaagaaaatcatccaggctgggcgtggtggctcatgcctgtaatcccagcactgtgggaggctgaggcaggtggatcacttgaggtcaggagttcgaggccagcctgcccaacatggtgaaaccccgtctctactaaaaatacaaaaatcagtcaggcgtggtggtggcacctgtaatcccagctactcgggaggctgaggcacgagaatcacttgaacccgggaagcggaggttgcagtgagaccagatcgtgccacagcactccagcctgggcaagagtgagactgtctcaaaaacaaacaaaaaaactcctcttagttcatgcgtggattctgatgcaggcttgcagggagaccctcaggtgctgcccatgagtagctgcgttgacggtagctgcttcctggctaccccgaggggctgctctgcagtcaggggagaggggccggctctcagggaaaggcatcaagaaccacacttgagttcctggatccgggcacatctaaaatttaggagcccataaactcccgttttcacagaacctattttgagttgggttcttgccacatgcaatcagaagtcctggccgacacacaactttggcttcagcagtctccctgggtgtccccaccccatcccgttccctgtgttcaaaggcgcttggggccatcctccactgtgaaactcccagacacgccagcccagctgcttcaggtgtgcgctgggaaattttcactccctgaattccaaaaatgatggcagcctctgcctcaccctcataaacgcaacgtttacatttattgtccagttgtttcaggacgtggattttctttgttttgctttttttttttttttttttgagacaagagtttcacttttgtcccccaggctcgagtgcagtggcgcgatcttggctcaccacaacctccacctcccaggttcaagcgattctcctgcctcagcctcctgagtagctggaactacaggcgctgccaccacacctagctaatttttgtatttttagtaaagatggggtttcaccatgttggccagcctggtttggaactcctggcctcaggtgatccgcccgccttggcctcccaaagtgctgggattacaggtgtgagccaccgcgcccagcccttttttctgtctgagaacaagaagacagtaagctctggggaaaaaacaggacccaccttcatctttcttatctttgctgtgcacttcttacaaatatttgctgaggctgtgaattataattgcaaaagtagaatccactgtgtccaagcagaagagagggtgtcatggggagcgggcagtggggagtcacctgtctgccaggctggacgggtgaacacattcatcatctttaggcatgcgagcttctcctacctctatccatccttccttcagcccatttcccccgacttctgccaccacctccgggacgtcctgaaggcgaaccggcctcccacctgctaagtccaacagacacttcagcctggctctcaccagccatggcgggttgccctcctacctcttgacaacacgctcttcctcggctgcagagacacctcctctccgtattttcctcccacattagcaatgaccacactcaggctatgtcactcatggtatttttgcatcagaaatgccatccttgggccgggcgccatgcctcatgcctgtaatcccagcgctttgagaggccgagccgggtggatcccttgaggccaggagttcaaaaacggcctgggcaacatagcaagaccctgtctctacaaaaagaaacagtttttaagtcattcctgattttacaacgctactctgatctgagcccctgtggcctcgggatccccaggcgtctgttcccgagaacgcggggcagaaagcctagtcctgcacgcagtaccaacaatgcggagtcagcgggttgtttcgactttgttctgtttcctgaggggttctgaataagggccacccccttcctcctctgtgccgccatgttccctcccggccacgcccccttgcaacccctccaatctccgccctgcaccctggcagctccccctggcggcagcagcgggtcttcgtggagtcagcccctccgctgcttggccgctgggtttgtcccttattttaatggatgcgcgttggctaggactgcaacattgtttctttcttccacaaattttagtttgaaacagacaggaagttaatttcccgtctggctgccacacctgctggtggcgtggactgcggcccttaggctgttccttgctcgatttaaccctgggagacatcgaagccttcccacccaagctgtagggagctgttgaagacctggttcacacgagatcctttgcggggtgcagctggggaaagcatgatttcagcttgtaagctgcatggagaatgcaaatgtatgtgtgtgtgtatatatatatgtgtatatatatatatatatatatatatatatatatatatatacttttttttcttttctttttttttctttttttttttttggagacagagtgtccctctgttgccaggctggagtgcagtggcacgatctcggctcactgcaacctcctcctcccaggttcaagcgattctcctgcctcagcctcccaagtagctgggactagaggtgcacgccaccatgcccggctaatttttgtatttttagtagagacagactttcaccacattggccaggctggtctcgaactcctgacgatgtgatccatccgcctcagcctcccaaagtgctgggattacaagcgtgagccactgtgcccggccaatgtatatattttttcaagacagctcaacccaaagtagcaccagcatggacaggccgagtgacgaagacagtgctggaggcacacagaggctgtgggggcaagtatgcggccggctggacctgcggggaccctgcccgtggctggaaaggggaccagggggtccctgggaaacacagggctctgacctctgtgcagggtgaggaagggttttaccagcagagggagagctcagcccaggcccgaagtcagcacgacgagcagctgacccctgggatctttgaggaacctgaaagtgcttgatggtctttgtgaatctgaaatccgagcgaagcgtcagaccctcgagtttccccaggggaactccgttagtctcctgggatttgatgtattcacgctttgttccttctggaccagtcacgccccacgccaatctgagccgtcgggggttggcccttccaggatgctgtgattaggtctagggaattccacctggagggaagggtgggctgtgtcctagggaattccacctggagggaagggtgggctgcgtcctcgggagggagacagcaggtggcaggcttcggcctcccaggcagccctattgaaaagtgaagccacctggacttcctgggtcaagtggggactgggacaacttttctatctagcaagaggattgtaaaatgcaccaatcagcgctctgtaaaatgcaccaatcagcactctgtaaaatgcaccaatcagcactctgtaaaatgcaccaatcagtgctctgtaaaatgcaccaatcagcactctgtaaaaatgcaccaatcagcgctctgtaaaatgcaccaatcagcactctgtaaaatgcaccaatcagtgctctgtaaaatgcaccaatcagtgctctgtaaaatgcaccaatcagtgctctgtaaaatgcaccaatcagcaggattctaaaagtagtcaatcgcagagaggattgaaaaaagggcactctgataggacagaaatggaacatgggcggggccaataagggaataaaagctggctgccaccaaccacccccgccccccccccccacctctagccagcagtggcaacgtgttcgggtcctcgtctatgctgtgaaagctttatcctttctctcttcacaataaaccttgctactgttcactttttgggtccgtgccatctttaagagctgttaacactcaccgcgaaggtccctagctccattatcgaagtcagggagacaacgaacccaccagcaggaaccacctccggacacactatgtccctgcatccccgaagctcccgctactccctggaatattctttgaaaagggtccctgtgtccttttttgccagcaacagaaactctaaaaacagccaccattatagcaatcaattaccaaactcttctgctgaggccaggcagaaagcaaagcacaacggaccttaccaggaggccccgccgctcctgtccagcccctgcccactcactcaggtgctcatcacccccaggaggctccactgctcctgtccagcctctacccactctctcaggtgtccatcacttccaggaggctttgcgctcctgtccagcccctgcccactcactcaggtgctcatcacccccaggagggcccccctccctgcccagcttccccctactcactcaggtgctcatcacccccaggaggccccactgctcctgtccagcctctacccactctctcaggtgtccatcacctccaggaggctttg

SEQ ID NO: 471 - DNA, 2486 bp, Homo sapiens
gtagtagtcggcgtcgtagtcgtcttcgtccttgtcgtcttcctcctcctctccgctgtcctcggagccctccggggagtgcggaggggcgtgagcgagcccatggctctggggggcggcctcctgcccgccgcgcggccgaggcccgagcgcccccaactgctccgggtgccctccggggacccgcgccccgggaccccacgcctcaggtgacggcgagggctgctgtaggctccgcccgtgtcccccggcgtgctcacgtgggagggtgtctgcggcaccccaggcgtctcccgcggctgccgaagaggccgccaccgcagctgcggctgccgcccggagccctagccccccggtgccgcggggaccccgccttccccggagcctggacagcgtcctcctcagagggtccgccatcccctctgccttagccgcgaggctcacccccgccagggggagaggtcggagccccgctggggagaaaaccgcgctcgcggaggcggaggcggaggcggcggcggctccccatgaccggcgctggccctcgccggctcctcacatacttggcataactctgccgcgggaaggcgtgggggagggcggtggcgccgcaacgcgcatgccccggagccccgggccgcgacggggcgcgcgggccgggggcggcagaggtgggttctcggggtgggcgagtggtgcaggtggaggcggagggcgcgggccggtaggttgagtagtaggtcggctgaagctgaccgacggaagcaggggtgggcgcacagagcgcgaagggtgcggggagagttgaggcaggggaaagaagaacgagcaggaacgtgagtttgggctggtggctgcaaagttttggttagggagcccgagaaagggaaagtgccctcctggctgtcaccccagcaccttcaccgccaccgctgcacgaggtgtgtcttaggcacagcaagtcctagcttgagagaaaacaaagattgttttgacggacaaagtacgagtgcaggtgtatctcggtgcatgtgttctagaaatgtatcaatcattttaatcgcccagagagctagctagctaaaagaaatttgcagcgattccttttctataagagttcttttatcaaaaacaaaacaaaacccacccaccgatgtctcttttaagtctgtttttccttctttatttcagttaatgcatgctaacaaaattattacatcagccaaaacttgtaaaatggagccacaaatattatgtccctcatcaccctacctacaagattatcatacaggtttgcagctttctaatataaaaaagttaacacttcattttaatttaaatagtgagttgagaagcaattgaattgaagttgagacacagtgtaatctagaaataccggctgtctcccaaaaacgttaaattccaggttctgggcagcagttgcaaactcaagtacccctcgttgccagagattaattgattcagtgactgataagaatcagtcgtgctatcatccctgatttgagttactttttttagtgtttacatagtagaaagggcctttttctgagttactcataaatatgctgacacctagcacagtgcgtgcacttagtagatactcaaatacttaagaaaatatttgttgaataaataaatgtttgcattactgaataaaatgaaataattttgccctaatttaccttatttgcaactgcagtatattttcctatgtcagttgttttcttgttgtccagtggctccaatctctgaatgtgctttgactatactacctttattagtacctagtctctgctttctggaataattgttacctgcatctgagatttgcagataagagagaatatttgcagaaatcttacccactctctaaaactctgctctaggccaggcggggtggctcatgcctgtaatcttagcactttgagaggctgagatgggcagattgcttgagcccaggagttcaagaccagcctggacaacatggcacaacctggtctctacgaggaacaaaaacaaacaaaaaaaaaaacacaaaaaaaattggctagatgtggtggtgtgcacctgtagtcctagctactctagaggccgcggtgggaggatcacttgagcctgtgaggctgaagctgcaatgaaccgagatcatgacacttcattccaacctggatgactgagggagattctgtctcaaaataataagaataaaataataaaactcagctcaactgccttcttgtttatgaagtcatctctgatctcccagacgggaactcaagttctaaacttcaatattactttattcccacccatagtatagttactgttttttgttttatacagtttgtatacatgtcctttctcctttacaagaaaattcataaactccctaagggcagaaactgtttataattgacctttatattctccacaggagtataactttagcatcttatatattgtgc

SEQ ID NO: 472 - DNA, 2564 bp, Homo sapiens
ccgcttccgcctggcgtaggagctgaggcatggccttgttctccagctgagaggacgatcgtccttataggagaggccgagtctccgagggcaatttcagaggtctggtgcgaggtgggggaagcggcgcggcgtcgatgacgacttccttacatcgcccccgacccccgcgttctcttgttaacttctgtgcattgttgcctgtctgcactttccgtctccaaaacctttgctctcctcaccccgttttcccttgtaattataccccagcgatcactagtctgggttcgaagtgattgtgtgtctccataattgacctggttgcccccggttatcccagaagtcaaagatgacagagaaaaaaaggaagagcgaggggcttatctcgtgttctctacgtcagactcctcttcccctgtccttcctgggtgatctttatccttcccagcactgttctttcttaagttaagcaccaaggaagagggcaactgcttgggcgctgttggcactccgaagcagccgcagtggttcgagattgccagtcggactagccaagggagctgctgagtgagtggttttcgagaacgctctagattctggcaacagttaggccagattattggaagtggggttggaacagagttgtgggtagtcatacttgttctaatcctaaagcagaattgacaagaaggttctagaagtttggagccctttccttatcagctgcgggttagtctgacccttttgttcaagatatctacagtgccctcagtctctttgcaacatactttatatcttcataccaagcccgttgtgtcttcaggctgggtaatttgaggcggtgatgtagaattagttcatgagatctgaaatcaggattctgagatttttactatctaatgagttcgaaatataagaagtactcggacgcaatgaatagttatcaagcttgagggtggttaccacagccagatctcaagttcctgatctgctgggagctgaggggcctgacaaagtgtaataggcccctgggatatcagagaagccaggacaccagagtccagtctctgttcttaattttgagctttcatgttgttcctacttcttcctagatatttaaagctaagcatcatcaacccttatacatcattaaagagctgcacaatgggaaacaaaattcctcccagtgcagacggagcttaaattaattgtagagatttacttgtatttggaaagagttcagtggttctttatactgtaaatagggatttggccacaggttatttattttttattttttgagacggaatctcgctctgtcgcccaggctggagtgtagtggcgcgacctcagctcactgcaagctccgcctcctgagttcacaccattctcctgcctcagcctcaccagttgctgggactacacgtgcccaccaccacatccggctaattgttgttttttttttgtatttttagtagagatggggtttcaccctgttagccacgatggtctcgatctcctgacctcgtgatccgcccacctcggcctcccaaagtgctgggattacaggcgtgagctactgtgccgggctggccataggtaattttaaaaactcaccctactcattgtaaatctctgatgtagagtgtccctattttggacttcatttcatagcctcctatcttaagcaaatacatttcttcaatcacagccttagaggatagtctatcataaaattggagtaaatgaacctgaagacatataataaaataggttatgctgtaatgtgaccacatcacacaaaacatggtatttgatagcagtacaacaaaataaggtaaactaccttatttcatggaatttaagtgtcattaggctgggtgcagtagctcacacctgtaatcccagcactttgggaggccgaggcaggtgggtcagctgaggtcgggagtttgaaaccagcatggccaacatggcagaaccctgtctctactaaaaatacaaaaattagcggggcgtggtggcacacacatgtaatcccagttacacgggaggctgaggcaggagaatcgcttgaactcaggaggtggaggttgcagtgagctgagatcgggccattgcactccagcctgggtgacaaagtgagattccatctcaaaaaaaagtcattgattgcagaatgcaaattattttatctgtcactaagaaaatgtaactgtaaattaaacatgacaacatgcattattcctgtagttcaaatagtgacagaaaaaaattaattaaaaaaagaaaaaagactgggcgtggtggctcacacctgtaatcccagcactttgggaggccaaggcgggtggattacctgaggtcaggagttcgaaaccagcctgactaatacggtgaaaccccatctactaaaaatacaaaaattagccaggtggggtgatgctgtaatcccagctagtcaggaggctgaggcagaggttgtggtgaggggagatcatgccattgcactccagcctgggcaacaagagcaaaactccgtctcaaaaaaaaaaaaatcaatt

SEQ ID NO: 473 - DNA, 4258 bp, Homo sapiens
gaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcgtagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttcttttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatgga

SEQ ID NO: 474 - DNA, 964 bp, Homo sapiens
gagaaaaacttcttttatagctcttgcctttctcaaagggggaggactcatcctggagagaaaccccatggatgtattcaacatggtaaatctttttgatggagctctcacctagttgcacatcacaacttataccagatagaaaatttatgaatgtaatcaatgtggaaagtttttcagcctggtgctcccaccttgttagacgtatactgaagactctgggaacatcgggaacgtcagagagctttcagcaggagatctcatctaattgggcaatagaaaactcatactgaagaaaaacaattccatgtaatcaatgtgagaaatatttcagtgacatccttgattttaattggcatcagggaaagtgtaatagagagaagccttatgaatgtagtcaaggtaggaaatctttctatacagctctggccttgttgcacataaaataactcatactggaaagaagcttcgtgactgtaatcagtgttggaaatggttcagttagagttctcacttgttgctcatcagataaatcataccggtgagaaactgcgagtgtcctgagtgtaggaaatcagctggagctgattacttatatggcatcagagatttcacattagagagaaacctcatgaatgtcactggtgtggaaaatcccgcagcaagaattctcaccttattgaacagcaaataactcattctggagagaagcctataaatgtagtcaacgtggaaaaactttcagacagaattattattgtgtatgcaccaaaaaattcatatgggcaaaagccaacatgaatgtctaaatgtgaaaaagccttcaggagactatctgaccttatggaacaccagatcattcataatagagagaaactgtatgcatataatcagtgcagaaaggcctttcaggcagcattctaatcatgtcaggcaccagataactcattcttgagtcaaactg

SEQ ID NO: 475 - DNA, 2223 bp, Homo sapiens
agctcagctggagtgcaagctgggaatgcagtcaaggcttcatccaccccaggcagctttcctgagccttgggagactggctctcaatgaatccaagctgcttttatcctttgctgcctatctagtcttgttaacaacaaagaagaggagaatggagattgagcaaccaggaagcagtctcagccacaccatcatatggagaagtgcctgtttcccattctgcccgattttaagtttcctgaggcacccccagccatgcagaactctctggtgcctggcccacaggaagttttcactaaatattgaaataaactgaacttagattaaactttggtgtctaacttaggaaaaacaacaagagttctacaaaactatttcttcacaggaaagtctgaagccaggcctgcttagcagaggtctccgtatagtagggatctcactctttcaagatgtaggatctcaactggttagccagccctctgagtgaagctggtcagttggggctgtgacaacatagcacactcaaaggggcagacccttctcagctccaacagattggtgtcattggaaaaggtggacccagtgtaggcagactttcctagagagtccagaagtgactgtgcaagcccaaagcaatccaaacaaatatttgtggaccaccaagaacctctggtatgaagtaaataataaaggcattgaacaataataacctgtctgtatatccaccaatgggaccgatgggccacagtgtgacatctatcctattcatgtcataagggagatgaattctactgtgggacagtctgtgtgactgctcgtaggagattatccaattccttttgctctaatttcatggtcaccaaatttctgcttgctaactttgttttacaacaaactttagaaaggaggtgatctgaataagaggatatatgtttttcagtctctggaaaggggtatttctttgtattgagaagccagaactcttgagtgtgttgagccttgtagagattgaaccactctgggtcagctgacaaaataagattctggtgctgaaaagctgagtatgtgaccatgatattaacagtgacctaagtttgtgtggcccccttcgttctccagaaaccaaccagtcagccttcattttgtaaatgtagcagacaccattttgctagtgaatgaggttaaatctttagccttgtcattggttcggctttgtaatttaaaactctcttattttaccctctgattttaaatccccagattttcctttctgtgtcctttgccccctgaagtttccatctgtctagcaactaagcactgtttgggtatctactgtcttccccaagttgcctttacttttcttctttacctttctcttgttttatttatttctttctttttttgaaatggagtcttgctctgtcacccaggcgggaatgcagtggcgcaatctcggctcattgcaacctccacctcccgggttcaagcagttctcctgcctcagcctaatgagtagctggaattacaggtgtgcacccccatacctgactaagttttgtattttcagtagagacggggtttcaccatgttggccgggctggacttgaactcctaacctcaggtgatccgccctccttggcctcccaaagtgctgggattacaggcatgagccaccacacacagcctctcttgttttacttctgtcattactttttgttcttttaatttggaaacccacctgcttcctcagtgtcattattaaaaacccacatgttacaggttcattaggactgaaacattccttcagagctgagctgaccaacatgttagccactagccacatgtgactattgcatacatgaaatgcaaaatgtggctggtctgaaatgatggtataggtatgaaattcacacaagatttagaatactgaagataaaaaagaatgtaaagtatctcattaatactttttttggtattgatcacctattgaaatggtaatatttggttatactggcttaagcaaatgtacattaaaattaatttcatctatttctttttacttctttaataccagaaaatgtaaaagtacctatctggcaagcaatataaaactattggtcagtgctacttgagagtcttaatgtctgtattttttatatctctgtaagcataaatgctgtattaaaaacccaatttgaataaacacccccaaattactcttcc

SEQ ID NO: 476 - DNA, 4320 bp, Homo sapiens
atgcgagcggtaagagtgcggcgggacttggaaatcgaatctgtgctctgtgagagatcctaggaaaggaaactgggagcccgggagaactaaaattcccaattaaaagtgaatttaaatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacagggaccctgaaagctgtgtctatgaagttattacaagatattggctactgtggtgcatggagcttctaggccagggtgattctcacacctgcctgatgtggatcttgttgcttcacacctgaaacatcatttgagaagcccgggaagtggtgtggctgctgcatggctgctccaagaactactcccatgggagaggagctcccaacagtgccttgccatcaagctttgatttctaccttacatacctctgaataaactgttgccaatgaggctgatggaagtcttgtgagtttgaatgccaggttgaacttaagaggattccctggtgagcattgcaagatggtatactcaatgttattaatttgtggggagtttaataaaagtattgtttatattgatgtgggaagggtatagggaaattacaaggtatggtgcagtgtcccaagaatagtaacatggggcactgaaaagatagagaaaggaaaagaatgagtgaccagaacctggtgacagagccacaggggagggctgtctggctggagctgtgacttaccattgaaggactcaggaagttcttttttttctttagacagggtctcgctccgtcatctaggctgtcatgcagtggtgtgatcatgactcactgcaccctcagcacacaccaccatactgggctaatttctgtatttttatagacaggttctcaccaggttgcccagtctgatctcaaaatcctgggctcaagcaatcttcctgccttggcctcccaaagtgctgggattataggcataagccactgcacccagccctcaggcagtttttattaattctgcaggaagggagctgggagaataaaaatcccgacctcattttctttccttcttttgttctcttgcttgagcttcccatggatgaactggaagaattcagaaattgaatgatataaataacaaagttaaattaatagacatgtattgaacttagtttttagagtatgtataattttcccaattttctgtggaattattgcaaaatttgatcacaaactataaggctacaatttaaaaatataacaaattcctaactgtaaaaattttctaggttaaattctttgatcacaaagcaggcaagaaatgaatggtggaacaaactaaaatactagctccatgaatgaaaagacctacatggatatgagagtaattaagaaggagttagcagcgatgggactttgtgattgactggatatagacaatgaggaatatagtgaaggaaagatgatttcctgatttctggcatgggcagctgagtagatggttatgctataaactaagaaaagagagaaggataggaagagatgggcctggaagagtatggagtttgagatgagaagagaaaatggaaactctgaggagcacagaaaattaaggcccaagtgaagaaagatgagcttgcagggaagactgggtgatgacaagcggtgtaggagagaatccgggtactctgttttgctgaaatgagaaagacggacatacagatgcatataaaggcatatagaggcagatatatttatatttgaggaagtctggacattgagtaagttagtgctgataacttctagtttcttagttaagaaagagatgaggttatctatacggagtaaggaggaacgtggtggtgccgttgctactacggtgtaatacgtcactactattactattaattatggtgtaatacctaaaacgtagtggcttgaaataacaataattatcttttatctctcacagtttctctgggtcagaaatttgaggataaggtggtgaatgattctggctcaaggtctcccatattgttgtgatcagtggctggagccagaacagcagagggcttagagaatctagggattggtcagatgtcgctttcgttttatctggctttgagacctctccaatgtgagctaatttaggcttcctcatagcgtggtaacctcaaggtatgtgaaccgtgtagcggttgacgcttccaagaacaagtattctagcaggcaaggttcatcttttatgctttaggcatggaaattacatagcgtcactttccctaaaatgagaaaggatatagcatgtttggacagtacgaaccagtatcacctaattgacattaatagaccatcctatccagcaatggcagaatacatatttcaagtgtagatggaacattcaccaaggcagatcatattctgggccatgtacaaaaaaaactgagaaatttaaaaggattaaaattacagaaagcatgctctctgaccacagtggaattaagctagaaatagaaaacaaaaaattatatagaaaatccccaaatatttggaaattttttatttttgattttttaaaattgtgttttttaaccaatgaaaaataattgtattatctgtggagtacatagtgttgtttcaatacatataaagtatagtgatcagatcatggatattagcatatcagtcattccagacatctataatttttgtgtagggaaccttcaatattatcttccagctatttgaaactacataatatattatggttaattacagtttttctattgtggtatagaaattagataatatactcttttaaagtccatgggacacaatgaaaaataattagaaaaattagaacatactttgaactgattgaaaattaaaacacaacatatcaaaatttgtgagatgcagctaaagcagtacctactgaaaaatgtatgggattagatacttaaaaagtagatgttaaaccaatgtcctaagcttctgcctcaagaaacttaaaaaaagagcaagcaaagtaaatccaaaacaagtaagggaacaataaagataagattagaaatcaatatagtagaaaaaagggaattatagatacaaccaaagaaacaaaaaaactggtgatttgaaaatagcaataatattgatataggcctctgatcagactcatcaagaacaaaagaaataatatacacactaccaacatcaggaatgaatttgtaggaacattcctacaaatcctacagacactaaaatacaataagaaaatattataaacaatttatgcttataaatttcattacctaggtgaaaagtacaaattttttcaatgattcaaactgtcaaaggtcactcaagatgaaatagataacctgaatagccctgtatctattagagtaattgcattcatagtttaagatctcctttcaaataaattccagactagatggcttctctggtgaattttaccagacatttaagaaagaaacaatgtggccgggcccagtggctcacatctgcaattccagcattttgggaggctgaggcggatggatcgcc

SEQ ID NO: 477 - DNA, 11704 bp, Homo sapiens
agacggccatcccccaggcccagccttgcccacaagattcccagatttcacaactggggctggcgctgaatcatgtacagtaagtccggggagagaaactcccggctgcctggcgtccccgggacaggacagctgccaagcctgccctccctcccaggggcccaccggcagccagggatcatcccctctgggcccctgaccagctagggggtgatgggcgagacacacaacctcccttggctgtgccagggatcaagggaccgtgtggtttccagggaaccttcaggctctggagggataggggcaggccagggtggtgggagaggggtcgaagtggccttgtattcaaccacggcctgccaccaaatcactggtgacctggagcagtccctaactgtaactctaagttacggtttccttatctggaaagtggggataatcacagccctgacctcacaggtggctggaaggactctgagaagatctgtgtacagtgcttaccgcaggaagcgcccaataaatattattattattgttgtgacgtcgagctggtcatgacacgctttaagaccctggagaaatcatccagttctttggaggacgtctcccctgaaacacccacccctcccgctgtgatacaaattacatcttatcttttcaaaacttcttcagtacatcagcaaacatttattgagcaccactgtgttccgtgcctgctaccaggtcctggagatacagcagtggacaaaacagaaagacatttaaaagccctctgttctcgtggagcctgtattctagctgaggagaatcagacatttgaggtcatttcagtaagtgagcagggctccaaaggaaataaagcagaaggtgcgatggagagagcctgggaggtcccctctgatggggtgacatttgaacagaagccccaacaaagaggagaagcccacgtgcaaaggcagggggtgggaaacggtgctccaggcagagggaaccgcaggtgctaaggccaggctgtgggatcctcttgttgaaggctcagcaagggcagtgtggctggagcagagggagtgagtgaggggcagaggggtgggaggtgagcttagtggggcccccaccctggagcagctctcctaatgccaggctcttcctgaaagtggccacctggtgcctgacttctacctgtaggggcagccacctgacaagggcccagcttcttcccatccggggtcccaaggccccggagctgcctgctcacagtagaaagcctcattcccaggaaccccacggagggccaggctccccgcccctgccctttgctcaggctgccgctgggactcccctgcccctcccggaggatgtgaccctccctgcctctcagccgctcagagtgtgggcatctgcatctcggagtctcagtgtgcccacctgtgagatgggcaccatgttgcctcagggagggagtaaaaggaggaagggagctctggccttagtatctgtcccctgaaccctggaagaaggaaaacatcggggctcactggggaccaggctgtgcgttcatagctggacggagagctcaggcgtgtgtatgtgcgtgtgtgcatgtgtgtgcatctgcgtgtgtgtgcatgtgtgtgtgtgcacgtatggggtgggggagacgggggtggcatcaagacccaggagccacaagagtgaggaagagggaaggggtgggcttccagggacagggggcagtcagagcctggttctggcgcccaagtggggattggggcagggggaataagaggcctgccctccctcctgggggcccagcggcagccagggatgatttcctgggatgttttaaaaatcatttatttctagaaaagtctttcatcatttcccttcaggtcacggaggctgagatggctgacggggtaggtggctgtggcctgatgtgtcacttttggcctcaaactgaggcaatggggacgaagtggctgcgaggcgcagtatctggcatatgtgtgagaaacaaccacagtgccctggggaggggccacgtcctcaccccgcaccgccagggtctcagcgtgtctcccaaaggtcatgtgggcctttaagaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacacccctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaaacaggtttttatgtgaacataaatttttgtttatcttgggtaaatttctaggagtggaattgctgggccaggtggccaagtgtatgtttcactttatcagaaaccgctgagctgttttccaaggtgtctgtaccatttttcatccctaccagcaatgtatgaaagtgtcagttgcttcgtattctcaccagcacttggtggtgttagttttttgtgtgtgtacatgtgttttacttttagtcattcaaataggtgataatagtatctcattgtggtgttagtttgcatttccctaatgactaatgatgttgaacatctttgtatgtgtttctttgccatccgtatattttctttggtgtagtatctgttcaaactttatgtcagttaaaaaaaaagacccaattgttttcttcttaatagatttggagagttctttatatatattctggatactagtcaagcctttgtgaaatatgtgatttgcaaatattttctcctgttctgtggcttgtctttttattctttcaataggtagactttaataacatcgttttgttttctttttaagtatttttctggttatctttgatttgtggcatgtattctttggtttttcaattttagtgataacaccaaatgttttcttttaaaatgaatttatttaagtaaaaacgtcagtaaatttgaagaaacacattaaataaggaatagtagaagtggacagtagacagcataaaaatcgtgaaggcagtttccaatttgcataaccaaagtgtgggcagctccgattcgttcgtcaacaaatactgatggagcccccactgtccaccaggctctgagccaggtgctggggacacagcaccaagcgagatagttgtttgctcttttaatgctggtttttctccagtgagtctctcttcatctttcaaaagccaatttgaatgacccttccttcatccagaccttccctggaatgtttgtcacactctactgcaaatttctatttctgtatctcccaggcaaggggcatgtcgggcagcctctggtagggttgtagagagcttggtgcatagatatctcaataaatagcctctcacatagtacaagctatgatgaggtgctgaagaccagttgctgattcaattggttgaaactagccaggcctgatgaaggggcctgaggaccttccctgctgcagtctggctgaccccaagcaaaccaaagtctctccccttggcctcccctcccacataaagataccaagagaaaaagcctcccaaacccactgccttcagcctctgctatttgcttcccatccagtgcccatggatgcctttcctgcaagacacagtattcacacagacacttaccaggcatctttgttctgacctgccccaggaccaccactttcaccttggcctcttaccaccattcccctgttcctccactccagcacaccagccagtgtttgcccctccaacatgcccagctcattcccacccctgggcctttgcactagctcttccctagttctttgccttctctagctctccacattcagttctgaacttcactgaccctcctcagaggctctctaggctatgctaccaaagccctctctcctctttttttttttttttttttttttttttttgagacagggtcttactctgtcacctaggctggagtgcagtggtataatcatagctcactgcagcctccatctcccaggctcaagtgatcctcctgcctcagcctcctgaatagctgagactacaggtgtgtgccatcatgcccagctatatacatatatttttaaagtagggatatactcactcactgagctcagtatgtagctcaggctggtctcaaactcctgagctcaaacaatcctcccacctcggccctccaagtgctaggattacaggcgtgagccactgtgctcagacaccccatgtatttttgatcccttcattctgtttctgtcctttgtagcatggaatgctctcatttccgagtttatttgtgtgtttgtttgtttctcgccgtgtcccctgttggagtggcagttccatgagggatttgggtctgtccttctctctatctccccagtgcctagcacagtgttcagcacacagtcggtactcaatcagaatttgttgaatctatgagtgaatgaatgaatgagctcatgagctctcccttctccagatgcactcacggcaaagttgaacccatctatctgcccatgcgtcaggctagttgtcctgtgggcccctcctgggtgggtactgagggatgcccactgggtccagccaggcctgtgtcttgtcagctgcccaggctaagggactttccattgtccttggagttggcctgtggaaagttgttctcaggacctcgtgagcctggggccatggatggggctaaaggtaactgcaaggtatagggacccggcgtgaaattccatcagttaacactgtaagtgaggctttccagctccctttcgtcctccctgtgatgccaaggggagggagaaactccacgtggggcttgtgtgtcttgagcaccttcctaccacctgctttttcttcggaagaaacagagcagatcccaagtacaagccgtcatcggcaatagtagctggctttgtttcacttttttgtatatttcaccaattgtcttccatttgcagcaagtgccttagattgggtgcctgcaagcagaccttaacagaataaactgaaggcaagtagcctatttgggagatgcctccagaaagcactggtagggaagtgagatcagggaggaagggctgccaatctcaagagcgctaccaagccagtaaccacttaggcagctggggctcggtcctgctgtggcacgctgggagcccatgtagtaacggagttagccccccaggggcggagatcgggtggtcagggagctggggaagggacatgtcagctcctgcctatcattgcttgacagctgccgcttggagtgttagttcccagcacatccagcctgccccatgagcaaagctcacaggtgaaggggacaggtgctgcaggtggaatcctgtctgtgttcaccggagaaaagggagaggaggtatgggcagggcacagacaacaaaggcctcacagtcaacactggttcctcatttaaagccaggataaaatgagttcatttaaaattaagttttcgcaaacatttaaaaagcgaattgatggaaagagtaggtaatacctgcaggtgaaatgtgaacatggcaaatgctgctatttttcaaggcgtccaaagcctttaataggcaaacagtgttcttcacgacccacaagaatggcgtgtttggggcggtgaaaacactctccctttcctcccagcatgccaggctcatgctcactcctaacactgcccaggacccctgggagtcctggaaatgggccatgaggcttggaggcagaagccctgtgtgacttggggtttgtcccttaacatctctgggcctgtctgttaaaaggggatgttctcaagtcacataaaagagtaaatgtgcaaaaatagtcaaagcaatgctgaaagaagaactaagagagaggacttgtccgtccagacattagaatatatgacaaaggcatagaaataaaacagtttggtattggcatctaagtggacaaatacatcacgggaacagaatagcatccaggaattaacccggctatcacctggcctacctccactcatagatgtgaaaggatttagaaaagggaagagattggcaggcatgggattctctggattatgttatgtctgggctggtgaagaagcttccaacaggctccccatctgcagccctcccctctaacctaccagccatggcaccagggacactcactgtcatgagctgcactcacccccgctctgctctggaaatatcagagcctcccacgcaagatgggttagaccacagttgtcaccattcctccttttgcacttctctttgattcttctgattaacccaaggagaaagtctcaggcgggcgcggctggacttgaatacctctcccacgtttgctcgtctccctttatgaggcagagctggccttaagctcagggccttcagcaggcaggagaatggagcaagaatttggtaacgttcttttgtgattgttgttttaaggttactttctctttacagaaatgaaaagttgtttcctccttctgatagtaacacaaattttccttttaaaataattttttctaatccatattacaatgagaatgaacctccaaaacatgatgctaagtgaaaaaagccagacacagaggtctttttttttttttttttttttttttgagacaggttcttgctctgttgcccaggctggagtgcagtggtgtgatctcggctcattgcaacatctgcctcccaggctcaatgattctctcacctcagcctccccagtagctggtactacaggtgcgtgccaccacacctggctaatttttgtattttttgtagaggcagggtctccctattttgcacaggctggtctcaaactcctgggctgaagaaatccttccgcctcagtctcccaaagtgctgggactacaggcgtgggccaccatgcctggccagaaggtcacatattgtatgattccctttccaggaaatctccaaaataggtacatccattgagaccagtgaagaatggtggttgttaggggaatggggagcggctgctttatggtcacagggtctccttttggggtgatgaaaatgttttgtgattagctagaggtgatggttgcagaacacaatgcaaaaatgccaccgaaatgttcactttaaaatgcttaatatgatgctatgtgaacttcgtctcagtaagttatttttttaaaaaaccagtggagtaaaccaaaaaatcaatttacttaagaaaaggtatgaatggctttaaagatggcttttaagtgacgtgtgggagacagtggctaaggggatgattctcacccatcgtgagcctgggaccatggatggggccagaggtagctgcaaggtacagggacccggcgtgaaattccatcagttaacactgtaggtgaggctttccagctccctttcgtcctccctgtgatgccaaggggagggagaaactccacgtggggcttgtgtgtcttgaacacacattggcttataccttgctcaggcctggaaggccctctgctcactgacggaatcctatgcatccctgggaacccagctcaagcctcacctctacgggaagcccttcctgattacacaggtggtcaggcggggtcagtcctgcagcccttcagacccggttgtgaatcccagtcttgccacttactagtgggaggagtctcttaacttagacatattgtttgactaagagggcctcagtttccttatctggaaaatgggggcttatgatagctcttatctcactaggttgagctcctacatagaaagttttaggacagaacctggggagatgtagctgcccttcattcacacttcagtctgacactgatcacatcacagttgcattccttttcctcctgtctcctacactgtgggcaagggctcagcctttgtgatctctgtatcatgttgctgtacagaactcacacacagtaggcacccaagaagggcgggttggctgacgtgcagaggaactcccagaattccacctcttctctcacctccacggtccccaccctggtccagaccctgcatggcttacctggactattgtggtctcctcctccctggtttcctggcttctgtcctgaatcctccacctccaatccattccccacatgcagccagagagatcccgtgagaatctaagtcagatctcgtcccttctctgcctggaaacttcccacagctctcaccttgcttagaggaaaagccaaagtccttcccgtggctcatccactgtgggacatgccccaggtcctctctgctctctgttcctcctccccaaggcctcatccctacgacagtctccttgttgttgctccgacactccaggctccacctcagaacctcgcatctgccgttctggtttcctggagcacccattaccccacacggcccgctgctcacttcctcacctcctccaggcctctgctcaaatagcacctgctagggaagcttccccctgcttcccaggttttgctggactccaaagctcttttcttcccagaggcaaagcccttggctggggtcctgggcccagcccggtgactcaggcggagaagatgctcccaggcctcccgctggatttggggcccagggtcagccatgggggtaggcggtacctaggctgtacctggcgcagaggcctctgcctgcccctgccgtgggaggcagccctgccctgcacacacgggcttccaggctgcgggtgggaaagccccacatcctcctctgcttacctgactccagctgactcagacccccagccctggccagaggggagccgcagctgctccgccccttgatgggaagcagagctgtggctgtgagggcctggc

SEQ ID NO: 478 - DNA, 31758 bp, Homo sapiens
gctccggcttccctccaggcggcagcggaaggtgggagcgacgactgcaaaacggcagcgatgggctcccgcaacctccggagcttgtgcgcgtacttcagggaccggcaccacgtcaccgtcacctcctgagtagtgagttcccctctgatgaaaccactggtgtgtttactcaccatccccaccatttttttttccccaacctgatggaaggaagtacataatggagagcaagtttttaaagcacggtcgtgtcgtgtgaacttgctctagccaaattaggtttatagcactttttttggctctcattacctccagtccccacataaacaagagtgaccagctgggtcatccgcaagaccgtttgaaattattgtggcttgggtggaaacttaaaggagtgaagtatctgctttccagaaaaatcgttgtcattcaaagtgaaattaaacttgttttctttgcaataattcgcctttatttccttgtatatctgtaaactcttcacttttttgtaattactagacaattcggacttaaaaagagcctcagcatgtgtattttggaattgtgtagcttcataatgtgaaaattattcttttctatttgagtaaagtacagttaatttgaagtaaataaaatttctatttccattggttgtttcttttaaaaagtcaccttttacttacaaaagaatcactgtaatccagtttacatttatcattgaaggtcaaaagcaagaaataggaagaaacacaagcatactataaaataaaaggtaactgtcatgtttttgaaggtaaggtgttttgacatatcagcagacattgtgtgaatttatttcaactcctagtggtactggtgtaggtagaaaatgttttgcttggttattcatttcatcaaacactctacttcactgtttttttttcacttcaggaaaattcgaggaggaacaacacatactagtgtctttcctttctttctccccgtcttctgcaaatagtcccttcctcttcctgctttctcctccttctcatgttaacatcttcaaccataagatggtgtgttaaaagattgaatatacctctatggaatgacttccagagggtgtaagtctgatatgagagttttattaccttgagtattttactggaagagatagaacaacaaacattttcataataaatgtgtgggttaggagtgttaggagaaaatacactgatactattactttcaatatttgatactacttactttgactctcactgaacacctatttgtttaggatgaattcactttaagccgggttgaagaacaagcctttaattgtcctattatttgtgccaaatctattataaatttgttaaaaaatttttaatacctaccttagagggtactctaggtatttaatgagctagcatttgttaaaggcttgtatagtaagaattcttatagtaagagttcttaccaatagatggtatattttttaaattgtcctgttgcatcaaaaagttcatctttattggtaatgttgattaagtttgcccatttggtagtttggtttcttttaactatcttactagattttcttacttttacctgaaaagtagtccttactaataggcacatgttttgtatatttccaaaatatgtattatgttaaattctctgtacactttatttaaaaattacagacgttgagggaaaaaaaataccctattaagggaagaatgagtttgtgtataacttgtagaagaaggaggccacccatttttagaaaaatatggatggtattgaaaattttgccatggcaagggataaaaaggacaggcttctctaatgtgtctgaaacaacatttgaatcccctttgttcattccctaaatctgctgctcctttagaattcctgattttcataaatagtaccaccattcacttatttgctcaggcataaaacttggaattttctgattcttcacactcatacaactcatcagacagtaccatcagttcttcctgacaaatacattctgaatttagctacttatcacttccactggtacaacccttgggagccaccatcatctgttgctggaccacagcaataaccacactagttgctatcactttctatctgtaccctcatgaatattttcccatttaaaccattctctatataccaaccaaagcaatcacttaaaaaatgttattaggttatgtcactcccttgtttaaaaccctccaatagcttccttatgcacacagaatgaaatcggaattccttaccatagccttcaagactgcataatctggctcctgcccacttctccatcttcccaggaagcagcacaggaagttgttctcacccttcttactgcctcctttctgtcgtgggctgtgctttttctagtctgtagcagagtctgttagttgtccccaaaaattcctccatttttttcatagtaatagacatggatacatggctacccagaacaaagactatattttgcagccttccttgtagccatgtaatagtgctggctgatgggatgtaagcagtatatcatgtggcacacttgtaaaaccatccttaaaagatagttggtgcacaccttcaatgcggcttttcctttatcctgtaccgtggaatatagatgtgatggcttagaactgtagctgccaatttgtgcctcatgcaagttctctcattctagggatggcaaaactaaactggtggaaaccagggtctgtgagaactttatggatcagagcaccatgctagccctgcagtcgtaaatgtctatattattaaagccactattttggagtctcttgttctcaactgaatttaatcttacctgatactctgtctcagggcctttgcacttgctttttattttttatttatttattttttttctgcctgggatgtggtcttctgtcttggatatggctgactcattctcttccttcaggttaacccaaatatctctgacaggccttccctggccaccgtatctaaaatagctcacgttcccatttattctctgtcaatcacgtgcccctctattttcttaatagcatttataatttatcattatcttgtttattcactgtttattttctacctcccttcaccctacaaaaatataaactacacctgtttttttccactactttatccttcacacatggtaggcattagataaatgctgttaaattagtgagtgaatgaatcaacaaaattcttatccaagattagctagactttttaaataataaatgagtaaatgtcaacagatatccttaacacaaaatttgtaaaatccaatctaggaaacaggaaaaacagtactaaactaataggatattcctgacctccaacttaataaagaagatgtctacctttttctgggaaatctgtaaggctagtacaagttaaaaaaaaaaagactgcactgcagtatatccagggctaaaattcacactaaaaggggtctgaattataatttactagacctcagtttcttcatcttaaatatgtgtaagctttgaatggtaatactataacagttaaaagtttaatagtaagcccaacttatgagtgacaaaacatgttaaacattaatttagtcttcaggcactattttaacaagtggttatttcttgataatactggcaaggattcagagaaacagggctgcttatattgctgagagtgtatgttggcagcacttttctagagtgcagtttggcaatatgtatcaaaagccttgagccatgtgcatttgacccagcgattcttttagaaatgtgtcataagcaggctgggtgcagtggctcatgcctgtaatcccagcactttgggaggccaaggcgggtggatcacctgaggccaggagtttgagaccagcctggccaacatggtgaaaccccgtctctactaaatacaaacaaattagctaggtgtggtggtgcacgcctgtagtcccagctacttggaggctgaggcaggagaatcgcttgaacccggaaggcggaggttgcggtgagctgagatcatgccactgcactccagcttgggtgacagagcaagactctgtccaaaagaaaaggccaggcacggtggctcagagagccacctgtaatgccagcactttgggagtctgaggtggggttggatcacctgagggcacaagttgaagaccagcctggccaacatggtgagaccccatctctactaaaaatacaaaaattagctgggcatgctggcgggtgcctgtagtttcagctattgggaaggctgagatgggagaatcacttgagcccaggaggcagaggttgtagtgagccgagattgtgccactgcattccagcctaggtgacagagcgagactccgtctcaaaaaaaaaaaaaaaaaagagaaatgtattataagcaaataagggtgtgtttaacaagttaattgcaagagtattctttactgcatcatttattaggagattggttaagcaacatccatacagtgaacagtattcagccatttgaaatgatgtggaggaaattttattgacatgatacattgttaagagcaaaagaaaaagttttaaaatacaaatgtttaatttgtaagtctcacaaacatcatctaacgaaatatacacgaggtgttaagtcagccttgcaaacgtaactattttttcattatttttatatcagttactgttattggagcattttatattgactgaggatctttattaaaacttcttcagccttctgtgaaatcttgttatgatggctatagtgacactatataaaacacataaccagaatatgtttatgctcaaatatttcaagcaatatttgatgcttaaaataccaaagtgacaatgaaaatgaaagaaatttggatagttccttagagttatttgtttgtgtttcagatatgaacataaagtatgtttttaatattaccagttttgagaataatagaataaatgccttctcaccttaataagatgttctgttctgactcagtattcatttgccatttatttttcaaatgtagctgaaatctcagtcatgttccaggcactatgttttgtctctgagagaggaaaaaccaaactttttccctgttctcaaatactactcaatacaatacttctgcaacaagatggggtgggatagcggtcccccctcacccccgcccacatcaaaccatcaattttctagcagacatcagctgggtgtctcaattctattcagttctgacactatctacctggaggcagcatcagatcgaacagattgagggctcggttctgcaagactgcccccaccacttccagtaccagccacaagtagtaggttgtcaccgatactcctgaccaagctgtaaatcaggattcccatgatcccttcctcaggttcaattagttcactagagtggctcacagaagtcggagaaacactttactagcatttacccatttattataaaggatattacaaagcatacaggtgaacagctggatggaagaggaatctgcacaccttttctcccataccttgccctatgtataggtagggagaagaggtgtggcaattccatgccttctccaggcaggccagcttccaggaacctcctagtgttcagctatcaggaagctctctgaaccctgcctgtccttttgggcttttatggatacttcattatgtaggcatgattgattacattattggtcactggtgagcaaataacctttaaccccctctcccctccctggaggtgaggagccaggttaaagttccaactccctaatcacatggttggcttccctggcaaccagctcccatcctgaggctacccaggagcccatcaagagttacctcattagaacaaaagattctcctatcgtccaggaaattccaaggggcttaggagctctgtcaggaaccaagggtcaaagactgaatagaataagattctcctagtgccctttatctagaagttttaggacctctgggctaggaaacagagacgaaaactaaaacgtgcatacagaagatagatctatatatataatattataaatcacatcaccttgtcatttagttctcaagaaaactatgtgatgtcagaataatagtataattttttccattttcttgtatgctacatgtatgtagcagatatcatttaaattggtgaaccacatttccccccctttaaatatccttgtccatatattgaatctctctaatactcatcacctttggaattgatcatggcagtattaaaggcacttctattctgaactgaacattaaagatgctattacccctccagtgcttttgtgggtcactatcatctataaaaaatatcctaaaaggagaagccaaataaatgaggtaatcagtggaaagaatataagatccttggaatctaaaaaatggctgtaaccaatcagcataataaaacctctaacaatagaaaaatagttaaccacttagtttagcatctgctaaatggcaagcaccataattacatgatttcactcaatctgtgtaacatttctgtgtgataggtggtatttgcattttacagatgaggaaatggaggctttaagagaggttgctagatatatctagaaaaccccattgtctcagcccaaaatctccttaagctgataggcaacttgcgcaaagtctcaggatacaagatcaatgtgcaaaaatcacaagcattcttatacaccaataacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatacgtaggaagaatcaatatcgtgaaaatggccatactgcccaaggtaacttatagattcagtgccatccccatcaagctaccaatgactttcttcacagaattggaaaaaactactttaaagttcatatggaaccaaaaaaagagcccacatcgccaagtcaatcctaagccaaaagaacaaagctggaggcatcaagctacctgacttcaaactatgctacaaggctacagtaaccaaaacagcatggtactggtaccaaaacagagatgtagaccaatggaacagaacagagccctcagaaataatgctgcatatctacaaccatctgatctttgacaaacctgacaaaaacaagcaatggggaaaggattccctatttaataaatggtgctgggaaaactggctagccatatgttgaaagctgaaactggatcacttccttacaccttatacaaaaattaattcaagatagattaaagacttaaacgttagacctaaaaccataaaaaccctagaagaaaaccgaggcaatactattcaggacataggcatgggcaaggacttcatgtctaaaacaccaaaagcaatggcaacaaaagccaaaattgacaaatgggatctaattaaagagcttctgcacagcaaaagaaactaccatcagagtgaaaaggcaaccgacagaataggagaaaatctactgcaatctactcatctgacaaagggctacaatgaactacaatgtagatccagaatctacaatgaactcaaacaaatttacaagaaaaaaacaaccccatcaaaaagtgggcaaaggatatgaacagacacttctcaaaagaagacatttatgcagccaaaagacacgtgaaaaaatgcttatcatcactggccatcagagaaatgcaaatcaaaaccacaatgagataccatctcataccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaagtattataaatcatgctgctgtaaagacacatgcacacgtatgtttattgcggtactattcacgatagcaaagacttggaaccaacccaaatgtccaaccatgatagactggattaagaaaatgtggcacatatacaccatggaatactatgtagccataaaaaaggatgagttcatgtcctttgtagggatatggatgaaactggaagccatcattctcagcaaactatcgcaaggacaaaaatccagacactgcatgttctcactcataggtgggaattgaacaatgagaacacatggacacaggaagggtaacatcacactctggggactgttgtggggtggggggaggggggagggatagcattaggagatatacctaatgttacatgatgagttaatgggtgcagcacaccaacatggcacatgtatacatatgtaactaacctgcacgttgtgcacatgtaccctaagacttaaagtataatttaaaaaaaaacgaggctgctttagattacaaagattataaagagagaggattggaattcaggttttgtaactacagaacctattctttcttttttaaatgtatgtaatttttaaaatgttgtgtgtaatatttttgtatatccgttttcttgggagaggatccatagatgtcacaagattctcgaaggggtccttactgaaaaaaaaaatgtctaagaaccactaaaactccctactatgaatttagtgcacttaataatggggaagaaagtaactctgacatagtttggccacagaatatattttttaattgttactaatcaatcaaatgaataaatatggagaacctaggtagatgcttaaaattctgattcaactaactattgaattgctattatgcactggcctcacagattatacactactgtttctcagtcttgagtactataggagcaccttttatgaatttttgtggatacccagtgtgataaactatttttcttataaagttaccctaatatgtacaaatagaaaactaggagtaaacttaggtttttagctctattttaactattaaactagaaaaaaattaggaatgaaataaaactaaaatattttaagttaacattaatgtgtaagttttttgttaagcctaaatcatcactggaaatagagcacagatttatttgaatttgagatacctatgttgctatgtgataactcaattttcctaacagttttctcttacgatttttttgaaacctttataccagaagcaagcaattacagtatttgacctttacctggcataaatggatcattaattaacttactctttactgtagtccagggcaattttaagttagatagtctggctccaactccattataagcaaacaaaaacatgggcactcaagtcgaagtatttatttatataatggtgtttttttaatccaaaacagagttatgttaacttttagattacctttgaaataaagctacaaaactaaagattttttgtgagaactcacaaatactaaagaatatgttagtgggccactagggatttaagaagcaagattatgagcgtaagggttttgaatagctaagatctgcaattttatctaaccgaaacacatgcaagcttcagtgccctttgaaaaaaatgcagtattttaaaaattacttctacaaacctcagttttgctgcctaaaattcgagcataaaaatatgactatgcctttcaggattgtcataaaaattttatcggatgggccaggcgcggtggctcacgcctgtaatctcagcactttgggaggtcggggcgagcagatcacgaggtcaggagatcgagaccatcctggctaatacggtgaaaccccatctctactaaaaatacaaaaaacttagcccggcgtggtggtgggcgcctgtagtcccagctactcgaggctaaggcaggagaatggcatgaacccgggaggtggagcttgcggtgagccgagattgcgccactgcactccagcatggatgacagagcgagactccatctcaaaaaaaaaaaaaaatttcatcagacgacatatgcaaatgcttagtatagtgtatggaatgaaccaaccactcaaatagttgcgatgatgatgataatagttttatgtggaaaaccacacgtaatctaagaatttttaataaaattactaatgaggcacctgaaaaggaaaatgcaagaaaataatagactatatagacagccatgtaaaaaaacaacaacagaaatataaatgtgctagctagttgagttaaatattttctgttgagaactaaaatcaggtaaggtggggacgtaaaacatatccctaaatgattacattttatagcgtcaactagtgatcatgttttattttcctgccataaaaatatgtttttaagtcactttaaaaaataaacatgttaactaatcttgagtttatgtaatggcatccctttcacaattactaagagggttttaaaagacgcaccactttttaaagacattgtttagaagaagatagttaccagatatttacaacagttcttaaacaaccttacatttttaatatgatgtccaactctgaagtagttagaattgatagtgttaattaagatttttaaaaacactgcctaatgtagaggtaaacaccatattttataaaacacttattgtacttcctcagtaagagtaagattagtttccattagattctagattataaaagttgctacagctgccataactttggtgaaggtgattctggaggaatattatcccaaaacctcttcttttccttctaatgaagcagcctgcaattaggaaacaactcttcataagcataacccatataagcgagcatgtaatagttaaatggcaaaatccagagaaacagccaattgatcttttacaaactcagcagctgccactgaagaaacaggtgataatgtagcacaaaaagataccgtaaaacacaggacttctaaatacttagtaaggaagacctttttgaaagccttatcctgaaaacatctcttcttgctaaaagctagggaatcttagaatcttattaaaaacaacaccacttacaatagagcagagggaagagaaaatctgttttgaatgaaccaacaacaacagacatatttattatacttttttttaatttataagaaaaaaagatttaattggatcacagttctgcaggctgtacaggaagcatggtaccagaatctgcctgacttctaatgagggcttcaggaagcttacaatcatggtggaaggtgaagggtgagcaggcatctcaacatggtggagtgggagcaaaagagagctattacacttctttaattaagttaaagaatttacttggctttgcctagttccttatagaaacaaaaattacaaaaagggaatgaaggagggagagaggaaggaaaaaggaaggaagaaaaaaaggaaaagggaaaggaaaaaggaaaggaaaaagtaaaaggaaaggaaggttctaaactagattcctcagtacactagttccataagatactggtaagtattctgttaaaaagcaaaggatttcattgtaatgctctgaattaagaggtttcattattgccaaatttgtttgttacttttttttcttcttctttttttttttttccccgtatgtttttgagacagggtctcactctgtcacccaggctagagtacagtgtggcgcaatcagagctcactgcagtctccaactcctgggctcaagtgatccactcacctcagccttcagagcagatgggactagaggcatgcatcaccacatccagctaacttttaataatttttttgtagagacaaggtctccctatattgcccaggctgttctcaaactcctgggtttgagactcctcccaccttggcctcccaaagtactgagattacaggtgtgagccactgtgcccagcccattggtatgttaaggtgttaatatatgtgtacctaagtaccttagttcttttttattgaagattttaattaatatcttacaaaaccacaagctatctaactacatttgatggagatactgtacttgaaaggctgaattttgggttcctgtacatagggattgagaattctctaccacagctttgttataagaaattgacacaaggccaggcgtggctgctcacgcctctaatcccagcacgtagggaggcctaggcaggaggatcacttgagtgcaggagtttgagaccagcctgggcaatctagtgagacctcctctctgaaaaagttgacacatgatgtgaattgggtatcacagaagatgtttttaacaggaccaaataagatatttctcttacccttttaggactgaggttttgccaatacattaggcaaggactggctaacacttgatatcataatactataggtacaacagaatctttcttttttgttgatgcatttataatataatattgagtgggagttttcccattgccccgtaattatgattatgccccaaaactgagaataaaattattaaatacttcacattctaagttaaaataactgaataatcccatagtattagccaagtagtgtcacaagcatacctatcaccaccaccactacctcaccaccaccactcctactcacccttcattaaaaaaatggtaggcctgagagaaaataaggaggccttttggagaatcagtttgtggacaggactgttcccaatatataattggagtcggggttgcatgaagagaattatatccaaagattgggattaccaaaataagaggcatatttcttttctctgttgggtgtttgctgggacagaggacttgctgagctcctggagctatatgagtagaggaaagagaatttgcaagagatgatagactaacagaggccaggacagcaagaaagtggtcttcatgcccatcatttagtgtgtcaagaataacggagattcccatggatggtatgaacaccagggaaagtaggtgagcttcagccattttgtcagtatgcgcgctgacctcagcaagagggaatctctgcagcaagagaaattaaagtggttcagtaaactggatccagatgaccaacatcaggaaactacataatgggaagcccctgcaggctccctcaaagaagcctcattatagatctagcttttggatactgtcacacagaggttatcaaaatccagttaatgaggactgcatccttacccagtcaagtaagaaaataatcgcccttttctctgtacttggggtcgggggagagtagaggggaatagtgtaaagagctttgaattgagctggagattgaagctttaaagttaacaacatgattctttaatatattgtgattgttctaataactttaaataactgaaaaatcagagaatctatgtaggatataattaaaggagtcatccctctttttttctatttgattttaaaacttaagtaaagccagggctgggcgtggtggctcatgcctgtaatcccagcactttgggaggccgaggcgggcagatcacctgagatcagaagttcgagaccagcctggccaacatggtgaaaccccgtctctactaaaaaagtacaaaaattagccttgtgtggtgataggtgcctgtaatctcagctactcaggaggctgaggcaggagaatcgcttgaaccagggagttggaggttgcagtgagccgagattgcgcccctgcactccaggtgacaagagcaagactccatctaaaaaaaaaaaacaaacaaaaaaaaccttaagccaatgctaaagtggtagttcagactcagttgctctctaatcctacttttctgtttaaaatctggactggctgacaatatccagattgaatgattttgctgcctatgggtaacaatatcaggattgaatgacatagctgcctgtctttgtaatgggtagcaaatgcaaaaagaagcaggacttttagtaaaccagatagatatttaataacatgtatgcttacattatatagttcatttcaaaatgtgctttcagtctttatcaacttctttggtgaactttataaagttctgcaattgaaaacattctgggcagaattttaaagatatctacaattaacagtttgagtgaagattctggtgttcagacagagcagactaggtaagcaacatcctttgcagaatgttattcttaaaaatcttgctcctctttgcatttgccacccattacaaagacagacagctatgtcattcaatccagatattgtcactcagtcttatattttaaacagaaaagtgggatgaaagagcaactgagtctgaactactgctttacttttagcattcaccttgctgaagttttaaaattaaacagaatttcacagaattttagatcagtatcttcacttctaatcaattaaatgaatataatttaaccccagaaaaaaacagagtaaatctaaaacttgtatttaatatgattgaagatttaatcttccaggtgaatattgaatttcattgatatttggtgcaataacatctagcatgtatctagtcaagccttttaaccatcgcagtctatatggtgtgaagcatgaagaactgttcttcgtttgtttgttttattggtgagggaataatacaagtgattgctttccaacttcagatctggatacaaacaattagatcattcttttatatgaaggacaacatgggtccatgcaaattcccagtgcattcatgctggtatttactgtgtaccaggcactcatccaaatacagggaaagtagagcagtaaggaaggcagataaggttcctgtttttatggaggagataaacaataaatattcaatataatatgcagtgattagaactatcaaggaaataacagctagagaatgataaggggatggtgtgctcttttagataaagtcagtgaagacatctctgagcaggtaacagaagcaaaagatctgcaggaaatgaggttgcatcaagtgcatgttgatgtacatatgatttaggtgtcagactatgaatttaatatttcttaaggacagtattttttgtatattctgaacaaccccatccgagaaatacaattaacttgcctttacaaaaaaatagcatattgttatgtacagtaatatcttcataaaatctggttgttgcttctggtcttactcatttcattttgattcaacagatctttattgagtaattgctgtacttcaaggctttattctaggtttttgctatataccattgaataaaataatgaaccctggctacctggagattgcattctagcaggaaaatgcagacaataagcaataaacataataaattatatactgtgttagaaggtgatttgtgctgtaatggggtatgtaggccagagaaagggaggtactaattacttggagaagaacagcttccattagtaagtatgctagcagagtggccctcaattaggttagacctgagcaaacaacagggacctgagggagttagccaagtgcctgtctgagaaaacagctctccttgactcatacatatctacatacgcttttgcctccaagaaagttactatcttttttccaactcttactatttttttagcaaaaaaaaaatagagtagctatgatacaccatcactgtatataatttacttgaatacgtgattttattttttatttacataggtagccactactatacacacatgcacacatacatatatacatatatgatttatatatatgacatatatatgattttaaatttttatcatctgaaagtgtgaagaactacctttttttttttttttttttttttgagatggagtcttgcttcgtcacccagtctggagtgcagtggcgcgatctcagctcactgcaacctccatctcccgggttcaagcgattctcctgcctcaacctcccccagtagctggaattacaggcgtgcgccaccatgctcagctaatttttttgtatttttagtagagacggagtttcaccttgttggccagactgctcttgagctcttgacctctagtgatccgcccaccttagcctcccaaagtgctgggattacatgcgtgagccaccacacccagccaagaactactatttttaaaggcactgaaaaataacttatgattagaaaacatatatttttatatactggcatgtgtaggtcacactacaaatatactttatgctttccagttaaaaggtaatggtgttcttgaagatatgttagaaatccaaaataataatttaagataagttggaagacatggtagattactcactgcatgctataaattgagtgcagagctaacaagtgtggtatgttggtatgtgtagttagaaaaattgacttttatgagtttattcaataaaattagaatactttcaattcttttatttttgcttcattccatctgccttccagatatcactgactttattacaaaggtgtttaaagttaacattattaatctacatatacttgttattctgcagagtaaaatcttctaatctttatgtttctaaaagcatgacttttaaaaaaagtaaccacacagttacaaccaggcatctaggtattgtaactgtatttcctttccattttcaaattgtgttctgtttttatttttgaatcaatgttaaataacaggtaactgtttgtaactttagatacaatattttactaaaaagatcataaatgttccataagcttatatactttttgtacttcttttactaacctggaagtaatagatttgatttgctttaaaaaataactttttttcttcataaaacccttcctttcaaatcctgtctacagtgtctccttctgtcttctgaatttactttcgtattacctatgtgacacttattagtttggtgcaaaaggaattgcagtttttgcaattacttttttaatggcaaaaaccaacctaatagtatgtgttgtcttgtgtctgttttagcttccaaaaatagaccatacattttccaaggacaaagatccaattcttatcagttagcataatgattgtttcccaaagtaattcttccactatacttgtaaaactcaaagttatattttatctagatatctacctatctatatctaaatatagatatagtatagtatacaaaattatgctatactaaaattgaaatctttttaaaattgaaagggtttatttagtctacctccttgagatagagaaaaaaaggctttccatcatccctcctctgtctttggtggttaaggttctattacctgaaaaattgtgtagccaaagcgccaataaccagcttgtacgtataaaaagttgatcctaagtagtactatatagaaataaatttaaacctaaaatgtttttgttttatattgacaccaaaatattttgcttttatatctgtacagtctgaaaattcaaaagagaagcaatttaaaggacttccatttacttctttcccctctaatctgcacaaaaggttaaatgtagcagtgcagcagttctggccatcaaaatatgattattgtactttaaaagcagccatgagaactctgctctttgatagacttcaacttgcaacaactaaggtaacatattatctggttctacccaaaaatacatatcctcatcctacttatcttagatcatgtgtaagattcagttatgtttaagctgtccttcggaaaaactcacaggttaatctttagcacccactctctactcactttaggtccttatccctgatgactactttatttcttgcaggaataatccagttccagaggagattaggagttgggtgagaggatagactctaatcttagagaaataaggtattgtacaagttatcaaggcctagcaatccaactactttgaccagaattattacagaaagttggaaaaagattaacttgatgcagagttatctgagctgtggacactgcgcttcttcagtttttcctaacaagtttgaacaggtcagtgttgtcacttgttaggaaaaactaaccatgattgaagtgtcacctttgggcagagctgaaatttacttgtttgatacatgatcttctcaaagtccagtgatcgctactttgaaaaggataccaagcagttaatctaataatataaccaaacatggtgccctgtgctacttactgcacaggttgcatgcctatgaagcagatcctctaaataagaagtgcaagcaaataatgaaaatcttaaaagtctattactttaactaacagaacttctagttttgtctcctatgagaactcttaagagtatgtatgcttattaaggttttacttggaaaattatttgatatcgtaatcataaagagttattagctgttttctcctaatgcaagttaaaatgtatagctatgttaaaaattcatatattagtcctagttaaaccatatttttaatatttttctaaataacaaaaattcagactctctaaggagaaaaaattatcagtttttggtcttattttctatgtgaatggcatcaggttgaagttatcatagttttagtagaacattattttggcctcactaataaaaaaaaatatgctttactgagggaacccagtgttatgccaaggacttgcttcattgtcctgatcattaataatcattagacaaagaactagggaaaaaacaccacatttcacatttgtcagacaagcttatgactttaaaacctaaaaagtatagcaactaaattgcagtgtggttaatcgagcttattcagtttacatattgttataatgtggaaagtggaatttgaccaagaacctttcaacccaatctattataacagatttaattgcccttctgtccttaaaaactttatgacagttaagaaagctaagctaaagtttttttaaatttctgattttgacttttaggttagctacctaactagtggatgaaattgataaataggcatgatgattttcactgtgacagtttgttgtgaaataaatttaaaatgcagaacttaagtttcagccttcctaaattgctcccttggactttacaacttactgttgcccttgagaaactggatcgctgaatgaaatctcttttcacactaccttctctctagcaatccactgtttaacagatggagataccctaacccttgcctcagagggcttcaaccctagagagagtgaggcaggcaatagaaaaatcacaagtaaaattttggtatgttagatgtggttaggtactatgggagaaagataaagcaaagaaggaatgtaaggagtctgggtagaggtaggagcatggaggattataatactaaatccgataaaaagaaagtctgaaaagacaactacatagaaacctggaggaagaaaagtacaagccattgaatatccagggaggagcatttcaggcaaagggagctgcacatgcaaaaccccagtgtgttcaaggtccagcatgaagaccaatgaggctggaaagtagtgtgcaaagtggaagctcactaggagacgaagtaaaagatgtaatgaggtgagagtagaaggagtccaatgaagaagagtagagagttccaatcataagtcactctaagctattttggtaattttgatttttactctaagtgaaataagcctttggaggacttgaagtagagaggtgacatgatctattttattaagaagagctaactgaattggggcaagaagcagaagcaggaggaaggccaggtaggatactataggaatattccaggtaaaaggagataatgacttgaaacagagcagtaacagaggtggtggtgagaagcagtcagcttctgaatgtagaataaagagccattaaatccatttagcttatcattgactgaagtactgtttttataattatttgtgatatatactttcatagtaaaatgtttgaaaatataggtaggtgaaaaagtaaaaatcactcagaacctcactctaaacatttgatggatagtctttcactttttctaaatgtatgtgtgtatgtagcttatatttattcaaatgtgatcatacaaaaatcattttattacccattatatgtatttttatatattgtgataatttcctatttctttaaatattttctcacaccatagtattagtggctgaataatgtagtttggatatagcataatttagccattttatagatagaacagtttatttatccagtattctattgttggccatttatacattttccagtttttctgtattataaataccacttaaatgaacatctgcattgctatatctttgaaaatgtggtcactgtattacttaggaatctctgcctatttaaacaatttttttcatcatatttattttttcattgtgtttatttttaatcaaagaattacttttttcttttttttattatttcagtagtttttatggaacaggtggtgtttggttatgtggataggttttttggaatactactcagccataaaacggaacaaaataatggaattcccagcaacctggatggagtcggagaccattattctaagtgaagtaactcagtgagaacaaatatcgtatgttctcacttataagtgggagctcttaaaagtgggagctaagctatgaggacacaaaggagtaagaatgatacaatggactttggggactagtggggaagggtgggggctggatgaaggataaaagtctacacattgggtacagtgtacattgggttttttcccatctataaccgtagaaagaaaagattatatcagatgcatattgatagattttaaagggtgccaaaaatatttgaatatgaactatatataaattcctactgaagactaaataaacattcatgtattttggaatttgttttctatttctgatagacttagttattaccaggaacagatgaccagttgcaagaactgtcactattttaacattctccatcagctgtggccatgttggatttctggcacctgagcattcacatccatctgtttatagggcattatgcccactcatgaggtttattccagtttcaaaaagtcatgtgtaaaccaagattggaaatatatattccttgaggtataaataatctattatttgaactttttgaattatgtttttagaaagaactttagccacttaccaatttgagataactttcaattaggcatatatggaaagcaacattatcagcaaaattttaactttactaactaataaatagaataatagacttcttcaacatgagaaagttgaaattaggaaaatgctataacatatccttgaaaaatattttgaaaccaacatttatttgataactgctgtgtgtgaggtgcttttgtataatttgtgcatataattgtcataatctgtgaaatagatattatccttactttgcaagcaaagaaactaagagaagtgatttacttagtatcacaagtaggaagtgacaaagataatttcaagcccagttctttctgacttcaaagcccatactcttttaaccatactgtgctgcttaagagattgggatccaagcattagagcagtttgacacatctgtaatgttgattgtaagcagttatagtagttaaaatgtaaacaacaacaacaacaaaacaaccaaccaaccaccatcaaccacatgactgctttacttttaaaacactaaatagcccaaggtaagtataaggatataaattagctctcattatcaggaagacagtgctatatagtaattaactgttttaactgtaagagaatatctacttagacaaaatatttaagagaagaaaatctggtgagatgtttgcttgttgtctttacattagtgattttcaaagttgaaaaaaaaagttatttttcccccacagaaagctacataaaacaagtgaaaatggttgaagtgggggtacaagtgaaagatgggggggatgtagctctatttgctccctacccagttctctcctctaattctccatgtaacatcggaagaaaaatttacaaattccagaattcagaatgtcatttaataggccatgttgtggctggaacacttggttgattggcttactttttaaatattcaactgatttattttggttatctaaaaaatgtgatttgggctgggcatggtggctcacacctgtaatcccagcactttgggaggccaaggtgggcggatcacgaggtcaggagtttgagaccagcctggccaacaaaaattagctgggcatggtggtgcgcacctgtagtcccagctactcgggaggctgaggcaggagaatcgcttgaacccaggaggtggaagccgcagcgagctgagatcgcacccctgcacaccagcctgggtgacagtgcgagactccatgtcaaaaaaaaaaaaaaagtgatttgaaagggggaaacagtttctggggcaatggctcacttttatgttatactgaattatctttccttgtttctcccagccagaatcaataaatttattctatcaaatgatttttgaacttcaagtaaatgccaggcactatactgattcctaccttcaagaagtctagaatctgtctggaagagacagataataaagaagtgaaaaaaaaatcaatttgtgctataaagaaaatctgtttttttgtttgtttgtttgtttgttttgagacagagcctcgctctgtccctcaggctggagtgcaaaggcacaatcttggctcactgcaacctccgcctcccgggttcaagcgattcttctgcctcagcctccctagtagctgggattacaggcgcccaccactatgcccagctaatttttgtacttttagtagagacggggtttcaccatgttagtcaggctggtctcgaactcctgacctcaggtgatccacctgcctcggcctcccaaagtgctgagattacaggcgtgagctaccacatccggccgaaaatctgtatttttgataaacaatacttacagtttgttagggaactactttattttggtctttttggcaaaagttacttgtattggattgaataatgttccctcaaaattcttgttcacccagaacctcagaatgtggctttattagaagtggggtctttgccaatataattagttaagaggaggtcatattgggttaggattggccctaatccagtgattggtatccttataaaaacagaaatagagacacagacacacaagggagagtgccatatgaaaatggaggcagaatggagtgatgcatctacaagccaaggaacaccaaaaattgccagcaactactagaagctagaagaggcaagaaaggactttctagagcctttggaaagcatgattctgccacatcttgattttggacttccagcctctagaactgtgagagagtaagtttccattgttttaaaccacccaatttgtattaatttgttatagaagccctgggaaacaaataaactactttagatcagttaggaaggcttcttgaactatatgacatttaaacagagacataaatgatgagactgtcccagccaagttaaaaatatcactgggaatcaaactcactggtgttattccagctcagtggtaaatgttctactggtattttaaataattctaaaataaagtcattatttttctttgcactccaaagtccttctttgcaaaaactatatgaagtaggcattaatattcagacttactatatagaggctaaggaacttagacctagtaagtagcagagcctagattcaagctcaggtaacctagcttcaggagcctgtaatttaaaccatcaggttatactgactctattctcaaccttatgcagtgtgctttcattcttcccacaagcttccaaggtgtccttttttgtgatatcccatggaatccagtctcatatgtgaaatttagcttttcttttttgtctcctacttttcctcttttcctttataatgatagtagtacagattgctaaatgtattgagcactaagtgtgccagctcttttaattcaaacaacaaccatatgaggtagatactattatcatcctcatattccagaggatatttctatggcttagagaggttaagtgacatatgtgggatcataatactaataaatggcagaccctgggttggttggatctgtctgacttcaaagcttctacttttaaaaaaattcgatgtaaaaccaaggtataacttacatgatttaagatgcacaactcctaaatatttagtatgatgaactctgatatgttctatacctgtgtaattatcatcacccagaacattccctgatggaaagactccttaatcaccccccttaacagtagataatcctccaaagataaacaacattctgttatatatcaccatgaattaactttatttttgaactttctagaagtagaatcatatagtatattttcttcagtgtctcatttctttccagagtccttatttttaatgaccatgttatactttgtccaacaaaactgccaagtcctctgtcctattttcctaggctcttgctaagtaacctatgttgatgatgtaatatgctaattcttgctaaaatattagtgggtgaaaattgtttaagttacttttttggggggataacttattagtatcataactgaccttaagctgagaagaatgactattatgaaaattctaagtagagtctgagagacttttaggcaaaaggggcctagctagttccagttttatatggtttgttaactttaggaaagatgctcataaatgaatgcatagaaggaaagcaaaagctgaaaaaaagggggaaactgaaagtatgtaaatacttctgggcaaagaaaggctgtatgagttttatggtattgggagaggggagtgtcctggtccatttctcctgctgtaactaaatacctgagacttagtaatttataaacaatagacatttatttctcttagttctggaggctcagaagtcacagatcaaggcaccagcaagtctgatgactggtaaagccccattttccatagatggtgccatctaggtgtccttacatggtagaagggcaaaaagggaacaaatgttttttcctcacatggcaaaagagcagaaaggcaagagagagctcccttcaacctttgagcccttttataagggtgctaatcccatttatgaggtcagagccctcatgacttaatcatctctctcttagtactcttgcattggggattgagtttcaacatgaattttggaggggacacaaatattcaaatcatagcactggtacactaattgtggacctttaaaatttatttctaaaatgtaaatgttgtatctataactgaaattgaaataccacagaagaaatcttagatgtataaaaagaaatgttaatgtcatatagaaaaatgaacattgaagttgtcaaaagttttgggttctagtcactgctctgcagcttaccagctaattacctcgcttaaatcacctaatctttctgagtcaacttcagtatatgcataaaaacatttaccctgcctgacaggattggtgtgaagattaaatatgaaataagctagtttatattaatgtgctttataaagtctcatatatgaagctttatatatatacacatatcactgtcataaaatagttaatacaatattagatatatgaaaaattgaatactgtaaccacctgatgcaatagaaagtcttaatgacattgtttttgaagaacttctaatttaataacccaggcttccagtcactcagttcaagtttgtcagaactctaaatgaatggatttggaaaaatacaagagcaattttctttcccatttccttttgcttttacatttcacctcttctcagtgataaattttgttggaaagcaagacataatttttttacttttacccttttccttagagtttcttgcatgtcacacgtgaatttgcctagggattctcctgtaacaagaattatttaattgtcaggtaagagtgtgaagaatttattagaaaaatgtgaaagacttcatactgataaccaattattattattattattattttgagaccgagtttcgctcttgttgcccaggctgtagtacagtggcgcaatcttggcttactgcaacctccccctcccgggttcaagtgattctcctgcctcagccttcctgagtagctgggattacaagcatgcgccaccatgcccggctaattttgtatttttagtagatatgggatttctccatgttggtcaggctggtctcgaactcccgacctcagatgatctgcctgcctcggcctccctaagtgctgggattacaggcgtgagccaccgtgccctgctgataaccacttactaatttatagccaatttaaaaaaattggcgtggggtggggaggcacgctgggtaggaggatgggtagtaataatatgttccgctttactttggactgccatctactggtaaattaagtcagacaatgtttgacaaacaaaacaattatgttcagagattagaacaaggaacttgttgaagaatgacatcagcaaaatagtggaacagaagttcctagtactcatctcacagaaacataaatttaaacatctatccacactaaaaaaatacctttacaagaactaagaaattcaagtgagggattatagcacctggatgtagcatggaaataagaaaacatgtattcatgacgacaggaaagacagttttacattacctgtgtgctatggtttgaatgtgtcctctccaaacttcatgtgctgaaacttaatgaccaatatgatggtattaagagatggggcctttaagaggtcatgagctctccttctctcatgattaaggcctttataaaaggggctttgtgtagtgttcacctcattgcctttccaccttttgccatgtgaagacctagtattactcccctccagaagatgcaacaataagatgccatcttgaaagcagagagcatccctcaccaaacaaccaaacctatcagggccttgattttggacttcttagcctccagaatgatgagaaaataaatttgctatttataaattatccagtctctcagatattttgttatagcagcacaaaacagactaaagacaccatgtcactgttttcacaagcctgggcaacacatcatgcagataaatacccttcatgtgggaaaagcagtgtgaagtgagctctcaccttcacttcagaccctggcagcaggcctaccccagtaagcccagactctaggaccaccccagcaccaggagtctccaggccaactgtcccagtctccagaccagctcatgtggtcacaggctccaggcccaaccgagagacaggcttgaccttgcagccttaggttctaggccagccccttggacacaagctccaggcctccaaaggtaaacaacattctgctatctctcactatggattaactttgtttatttttgaacttcctagaagtggaattatatagtatattcgctttggtgtctcatttctttccagagtccttatttttgatgaccatgttatactttgtccaacaaacctgccaagtcttctgtcctattgccctaggctcttgctaaataacctatgttgatgatgtaatgtgttaattcttgttaaaatattagtgggtgaaaatgccctaccactgcaccaacccaccccctgcagactcaggctctagtcccatcctagcaccaagccagctcccatggtcccaggctccagactgccccctgtggccctatgctccagaatatctaggttccaggcccaccccagtagaatttgatactagtccagccctcaaagacccaagctccagactggaccccatcaacccaagaccaaagcctgcccgcatggactcagcctccaggcccactaccatggacccaggtgccagggcaccccactgaaccctggtgctaggtcagctcctgtaaactcaggaccaggcccatctccatggacccaggcaccaggcctcccctagcaacaggttttccctcatggactcgggctttaggctggcccctgtagacacaggtttcagcctacctatgcatgcctacccatgcaggcccaatctctaggcccaacccagtggagtccagcactaggctggcctctgtgaacccaagatccaagcctaaccacctagattcgggttcaacgcctgccccactggacccatgagccagactcagccaagtggacctagccaccagaccagcctgcctgaggattccaacagcaagcttgcaagcagaccccactaaatggctcaccaagaatctctggatggtctgactggtaaaggactttccctgccaaagccagtctgtaaagatgggaaaagctgcctgcttctttttaaaaattatattttattttttagagacagagtcttactatgttgccaggctggagtatagtggatattcataggcacaatcatagcacactgctgccccaaactcctgggctcaggtgatcctcctgccttagcctcctgagtagctgggacttctgtgcctggttaagaggttcctacttctccaaatagacaaacaccaacacaacaccacaaggattacaaataaaactgcctgacaaagaattgaaaataattgtcttcaagaaacttagtaagctcccagagaacacagctagacaactaaacaattatcaggaaaacaatacataaggaaatgagttcaacaaagagaaggcatttaaaaattctggagctgaagaacacaatgcttgaactgaaaaattccatagatagatttaacaacagatttgatcagtcagaagaaagaaccagtgagactgaaaacaggtcatttgaaattagagcagaggaaaaagaatgataaagagtgaagaaagcctatgggacttagagaacaccatcatgtaaaacaatatttgtgtgtaagttttctggaaggagtagaaaaagaaaaggggagaaagcttattttaagaaatagtagcagaaaacttcccaaatctggagagggaaatgaatgtccagattcatgaagctcgaagaaccccaaatatattaaatataaagagatctaccccaagacacattataatcaaattctcaaaagccaaagacaaagattattttgaaagcagcgaggaaagacacgtcacatgcaatggaacccatatgagatggtcagtgaatttctcagcagaaaccttgcagatcttgagagagtggaatgacatatttaaagtgctgaaagaaaaaaaaaaacctgaaaaccaagaatgctacccctggtaaatctttccttcagaaatgaaggagcgataaagactttctcagacaaacaaaagctgtgggagttcatcaccactagacataccttacaaaaactgtaaagggagttcaagttgaaacaaaatgacactaactttctagaagctgaagctgtgaaaaatttttaaaaatgacataatataaaaacatagaagtataaaactgtaaaggtaagaatacagtcaaattcagaatactctaatactaatgatggtaatgatagtacataaataactctagtaaaaagttaaaagtcgtgagtgttaaaaataaatatggcaacaataatttgttagtggatacacattatataaaacatgcaaattgtgacaccagtacataaaatgtgagaggaggagaagttaaaagtgtagagttttgtatgtggttgaagttaagttgttattagatccaaatagactgttataagatgttttatgtaagccttatggtaaccacacacaagaaaagtctgtagtaaataaaagataaagaagacgaaatcaaagcacaccactacaaaaataaatcattaggctgggcacagtggctcacgcctgtaatcccagcattttgggaggccgaggcgggcagatcatgaggtcaggatatcgaaaccatcctggctaacatggtgaaaccccgtctctactaaaaatacaaaaaattagctgggcatggtggcggacgcctgtagtcccagctactcgggaggctgaggcaggagaatggcatgaacctgggaggcagagcttgcagtgagccgagatcgcaccactgcactccagcctgggcaacagagcgagactccatctcaaaaaaagaataaaaataaaaataaaaataaataaatccttaaatcacaaaagaagtcagcaagagagaaagaaaggaacaaaggaactacaaaacagatttaaatgattaacaaaatggcaatattaagttcttcctatcaataattaattgtaagtggattcagttcttcaacaatagagtggctgaatggataaaaggaaaacaagattcaattatatgctacctaccagatactcacttaagctttagggacacacataggctgaaagtgaagggatagaaaaagaagatattccatgcaaatggtaaccaagggtgaacagcagtggttatacttatattggacaaaatatactttaagtcaaaaactttcacaaggacaaagaagctaattatatcatagtaaagagatcagtctatcaagaggatataacaattatgaatactatgcactcaacattggtgtacctacatatttagcaaatattaactgaacagagaaatagaaagcaatataataatagtagagtacttcaatacctcactttcaaaaatggatagatatagatcatccagacagaatattgataaggaaacagtggacttgaaatacagtataatataaaccaaatggatctaacagatacgtacaggacattccatccaacagcaacagaatacacattcttttcaagtgtacgtgaaactttctcaaggatagatcatatgttaggctgtaaaacaagtcttaacaaatttaaaaagattgaaataattatcaatatctttttcaacgacaatgttatgaaatgctgtaaaatgttaggaaaacaacaggaagaaaattagaaaatacacaaatttgtgtaaattagaccacatacactcgaataaccaataggtcaaagaagtcttcaaaagaaaaataaaaggccaggtgcctgtaatcccagcactttgggaggctgaggtgggtggatcacctgaggtcaggagttcgagaccagcctggccaacatgatgaaattccgtctctacgaaaaatacaaaaattggccaagcatggaggcaggcacctgtaatcccagctactcgggaggctgaggcaggagaatcacttgaacccaggaggcagaggttgcagtgagccaagatcgcgctaccacactccagcctggacaacaagagtgaaactccatctcaaaaaaaaaaaaaaaagagaaatgaaaaatatcttgagacaaatgaaaacaaaaccacaatataacaaaacttactggatgcaacaaaagcagtcctaagagggaagtttataacaataaatgcctacttaagaaaaaagaaagatctcaaataaaca

SEQ ID NO: 479 - DNA, 1480 bp, Homo sapiens
ggggcatttccttcagcgccaccatgccagagagagcggcaacttcccacaggttgcaaatgagtccgcgtgatggggacgtgagttaattagtgcacttgggtttgagaggtgggtaacaagctgccgctctgcatttggtggttccttttccgaacaggtggcaactgactgacgggctttctctgaagtggagaaggacatctgtgttttccatattgcggaacaccggatctttccaagtcacacatttgggaagacagctgaattgccttcaagttcctcctgttatggtacaaatacccacctggtgtgcaaacatgagagacgcagctttacactagaaccaatgaaagcaaatttgagaaaacccaactctttaggaatggagactacagatgtatgaggggatcttaataattaaaagaagaaaatatgtaaacaggaaaaatatccaactgtcacaaaactctacactaaatcaaactgcaaagttttgtctttttaaaaatatagtcatgtgccacatgacaacgtttcaatcaaggaggggctgcatacacgacaatggtcctgtaagattacaatggcgctgaaaatttcctatggcccagtcacatcatagctaccaaaacatcactgtgcaaggcactactcatgtgtctgtgatgttgctggtaccaacaaatttactgcactgccagtcatataaaagtataacacatacaattatatacagtacttaatacttgataatggtaatagtgactatgttactgatttacgtatttactataacttgtgtcattattttagagtgtgctccctgtacttacaaaataaaaaatttaactgtacaacagccccaggcaagtcctttaggaggaattccagaagaaagcattgttatcataggagatgacagctccatgcgtgttattgcccctgaagaccttccagtgggagaagatgtgcagctatagaataaacagtggctggaggatgatacaccaaagaaggaaagaaacaagtgaactcaaatcaaagaattcacatcagcttttttgaaaggggaaaaccaaaaacgtcaattgcaagcctcaacccccttcttcttccccaaactgtttttccttttggtttatttctgcatcagagtctacctaggtttcaaaaccaattttccattttcctagaaccagccaaatatggagtgtgtgcaaaaacatggtagcttaaaagaagaagaagtagacaattatcaaagggaagagggaggaaggaaagagaagggaaataaagagagatgacacaagggaactggaccagataaagacaaagcaatgcacttaacccacctggagagcacatcggaccagcaaggcgctctcagccaatcgcctgggtctgcggctgggaggagagtccgcatgggttcatttggctgaggagtgtgtttcataaaccttacggtgcagct

SEQ ID NO: 480 - DNA, 12969 bp, Homo sapiens
ttatttaaaaagtttatggaaactgcctaaaaagtgatcagaaattgaatctcaaattttaaacattgatgtaatgtaggtcatatattctaaaactccaataaaattaagttagatgttagtttaaacagtgagaaaaaaaacccttacatgtagaaattatgaaaaaaaccccgacacttctaaacatcttatgggccaaagttattgtaacaataatcagaaaacacataaaactgaataaaatataaatattacatatcaaaactaacgaacacctaaataaaacattatttaactttaattgattatattctaaaaaggaaagactgaaagtgaacgagccaataaccaaacttaagactcaagaacttgaaaaattaacataatacagaatacaaacaaaactgtatattatcatcagaaattatttatatataataaatctgaaatagaagaaaaagcaaaagataatttttgaagagataaaactgacaaatctttagtgagactaatacgggaaaaaaacacataaatacacattgttaagaatacaggcttggtgtggttgctcacacctatactcccagcattttgggaagccaaggcgggaggatcacttgaagcatggagttccagactagcctctgaaacatagagagaccctgtctctacaataataattataaaaaattagctaggcatggtggcacatgcctatagtcccagctactcaggaggcttatatgagcccagagttcaaggctgcaactagccatgattgtggcattgcactgcagactgcgtgacagagcaagagtccatctctacaaaaaaataataataataataacataaatgcaggaagaaagtgcagagactagaaacatgagtatcaaagttggacacataaaaatatgtatacatttaattatataaatataaaaattacaatatatatcatacaacacatctctatttgcatctctatctctatgtccttatatttatagctaaaatataattacacatacctatagtttattcttattatttacagtatttctgttttataagtccccacagacactgaattagccaatagtgaactcagacaaaaatacagttagatttgtgaccctttgttcacattattttgttaatccatcaacacgcacctttgttttatatgtctccatttaaagacaacttatttaatgtattttgttgattcattaacattgaactcatagccaacagcactgcaactcatgcctagacacagcttatctaacacacataattttaccttaagtctcattaccaccttttgcacttaggaacattacatagcactttaagcactacatttgggggccattttaaacagtgaaattttcaacaaaaagcacaagaatgtgaaaaacacagctctaaataaagcacagaaaggacatttgcttgcagtaagtgagctgaaacagaaaggcaaagtgtcactgtgtttgatctcacttgggaatgtatgcattgtgcaacttgtatttttggctctctgcagatatccatgaatgaccatgaaagtacagcaagtgattttcaagctgcaaacaaattttagcaagtaagtgcatttgccaataagcaatacatgaatatgagaatcaaaagcatatataccataatatgccataagtttatacaccataaaatatatctacatatttatatctatatctatatcaatctatatgtatatcataaaaacaacaattatcaacaatgcaatgaatttaagaatacattggaaatgggaatagaatagatgaattcatagaatagtcctattgataaacaactctaatatagtacaaattattctaccgtatgaaaaaaagaatactagttcaatcattttctgaagctagagtaacttaaatacaaaaatgtgacaaggatagtcttagaatgtagaacacacttataaacatagatttttgtgcagtattaaatagaaaatagttggtcaatacaaacaaaaaggccaagtgtggtggcttacacttgtaatcccaaaatgttgagaggccaagacaggaagatcacttgaagccaggagtgggagaccagccggggcaacatagtgagacccccatctctaatatatatatatataaaagctgggcatggtggcacatgcctatagtcccagctactctggagactaagagaggaagatccctttagcccaggagttcatggcttcagtgagctatgatcgtgttactgcactccaccgtggcccacagagtgaaaccttgtctctaaaacaaaatccaaacaccaaaacccaaaataaagacatttatttattaaattttatgtagcatcagaatcttcagctaagctaggcatgcttcacaatgtaacaccctttaaagcaagaagaatcttgaatctacttctcaactattttgcatatatcttctccaattcttttcacattccccgttatgtcagttcctattcacctcttttttagtcatctccatttatttttagcagctcatattatcacctagacaaaaggtcaaagactttatcagcccctgttgtgttctgtttgggtttttgtttgtaatgtcctgtctattttccttttaaaatggcaaaatgataattctatattataaggcataataaccttgagattgcccaattgttgttgagtggataatttaaaaataattgtagagttttcgtcaagaaagtgaaaataaacacaagccagcatcagttccatttaaagcaatactacatagataagccacttcacctttttaatatagcattgacattggcaacaaatgttaaggatgtcatatacaccatgaatttgaataaattaaatgcagaaactagttgacaagtctattttttcataaaattaatgttaaaaattgagtttaagcttgagtgtcctactgtattattattattacataacaaatgagttagttatattgaaaatgtaggaaaagcaaacttttcccaacccccctcgcatcaaagatggtgtctctcaactgcattagaaaatgctgattcaggtaatcccaccctaaccccagatgctgtctaatagtgtattaggaaacccctagtagcttggaaagtattaacctagtatttctgtttatattgccttgattattagtgtaattaaacatttgatttcatcttttgtaatacataggtgtatgtctcttaaaaatattttaccaattgcttacttgattattagtgtaattgaacatttgatttcatcttttgtgatacataggtgtatgtctcttaaaaatattttagcaattgcttattttttcttgtagatttttcttctctgaatcttttttattgaaaattttattcctgagtgaatctcataagttgcaaacattgaatgaagtaggatttttaactttattttgttcacatgtgttgtcaagtgtttaaatgccatcaataaatttgtatatattaaattccttatacgatttgttaccacagtccttattatagctagtttttcagtttgttccattatatcaccatttaattgctttataattaatagcatttttgaaagagtcttcataagtcttcagtgattttcttaaattatttttattttgcagttaaataattttccaaacaaatgaactaatttaaagtgataatttttactgttattactttaatttacataataatttggcaagaaatgaattccagtagatatagcaatgcattgtattccctctgctgtagtggaaagcgccagtgttacaactagaaataaaaatctcaggtatggtagtgtagaaaaattgaaggtctggtagctgtctcatatgaatccaagtagttctgttcagtgctggaaatagcttacgatgtcatggttccaggttctctcttgttactctgtcatgttcagcaaaccatccttgcagctgtttttgctttcatcatcccattctcattgcaggcaaatggaagaagaaagaggagagtggtggtgtgtgctttccctttaatggcagaacccaacagtcgtacacaccacttctaccctcttaagatgggtcagaatccaggcccaattccatgtatacatggaagagaggcttattaaagtagccttcagttgctggacagagttccatccaaaactacagttaataggtaagtcgagaacttacattaagtgataaatggcagtctctgccaaggaaaatattcttatccatgctcatggataagaagaatcaatatcatgaaaatggccatactgccaaaagtaatttatagattcaatgctattcccatcaagctaccattgactttcttcacagaattagaaaaaactactttaaatttcatatggaaccaaaaaagagcctgcatagccaagacaatcctcagcaaaaagaacaaagctggaggcagcatgctacctgacttcaaactacactacaaagctacagtaaccaaaacagcttggtgctggtaccaaaacagatacatagaccaagggaacagaacagaggcctaagaaataacaccacacatctacaaccattgaaactttgactaaccagacaaaaacaagccatggggaaaggattccctatttaatacatgctgatggaaaaactagctagccgtctgcagaaaactgaaactggaccttatacaaaaattaacttacatcttatacaaaaattaactcaagatagatcaaagatttaagtgtaagacctaaaaccaaaaaaccctagaagaaaacctaggcaataccattcaggacataggcattgccaaaaaccttatgatgaaaataccaaaaggaatggcaacaaaagccaaaattgacaaatgggatctaattaaactaaagagcttctgcacagcaaaagaaactaccatcagagtgaacaggcaacctacagaatgggagaaaaattttgaaatctatctttctgacaaagggctaatatccagaatctataaggaacttaaacaaatttacaagaaaaaaacaaacaactccatcagaaattgggcaaaggatatgaacagacacatctcaaaagaagacatttatgcagccaccaaacacatgagaaaaagctcatcatcactggtcattagagaaatgcaaatcaaaaccacaatgagacaccatctcacatcagttagaatggcgatcattaaaaagtcaggaaacaacagattctggagagaatgtggagaaatagaaatggttttacactgttggtgggagtgtaaattagttcaaccattgtggaagacagtgtggtgattcctcaaaaatctagaactagaaataacatttgaccctgaaatcacattactgggtatatacccaaagattataaatcattctactataaagacacatgcacacgtatctttattgcagcactattcacaatagcaaagatttagaaccaacccaagtgcccatcaatgatagactggactaagaaaatgtggcatatgtacaccatgggatactatgcagccataaaaagaatgagtttatgtcctttgcagggacatggatgaagctggaaaccatcattctcagcaaactaacacaggaacagaaaaccaaacaccgcatgttgtcactcataagtgggagttgaacaatgagaatatatgggcacagggaggggaacatcacacactggggcctgtctgggggttgggggcaatggaaaggatagcattaggtgaaatacgtaatgtagatggtgggttgatgggtgcagaaaaccaccatggcacatgtacacctatgtaacaaatctgcatgttctgcacatgtatcttagaacttaagcataacaaaaaaatatatttctgggcagaggaaaaatactttgaaatttacatttaatccagtaaaatttcagtgcattaaattaaagcttgtaatataataatgataataacagacagcatttaaagagcacctcttgtggataatcaagttattgagaaattatgtgtgttatctctgggataaagattgctgcatccttatattcttgtgtataaacagaccctgtatatgtaaaaaaaggaaagagaaaagtatttttaaatgcactaatttgtaattaccacataaactattactcatggaagattagttatttgttgtcagtactttttttttccctttcaaaaatgtattcagattttactatggcctaatatgtaataaatgtatatttcctgtgtgtcccattggggctttcaaagaaaacatatctcttttagaaaacatttttcacatagagatattatgcatcatattcaaaacctttgtagatatctttcttgaattattttatgagtcaaagtttatatttcagaaatatttctttattttttccagtaaaggagaaatcattaataaagaggcaaatttattaacactattacctgaattttttagaatgataacaaataaatttagtaaatattgctgatttattagcagataaagtcattctgctccaagagcatgacagctaaacttccactagctcatttatactctgtggaaatatgatttactgccatatgagagaaattaaattctattattttaattctgtattttgtatcataaaagagaaaccagatatggaatacagaatatgcatatatggaataaaacaatggggaataaataagatttagttcaagaaataaagagatcatgtattcaaacacaccagtgagttctttaaaaaggaaatcttttatgttctaattaaagtagcaaacttcacaacttgagtttttcagctcatttgtttcctgacttctttattccaagttaaatactcctaaggtgggtcatataattcagtgacctttaaagtaaaattgaaatatttaattttactacttttctttatctctttttctctcaccacatgcagcttataaatgccaatagaattaattgcctaattataaggaataaaaacattgccttttgaaggatttcaaatttatgtatcctgctgtggagattttgcttgactacctgacctatacagtctgtgcttcttaaggaaagaaaataagtggactactttcgaacacattttgaacttggtaatgaatgctacaatactgctctgctctataatcttaggttattttatattttaagggcttcacctggagccattttactgttaaccataactattatatatactctttaataagctccattatatttttttttacttttttccttatacaatttagtaatatggcagaaaagcaggtaataaggaaaatactaatcatcattagtttacaacacattgacacacattttccagcaagaaaattcgattaacaggtagcacgaaaaaaagctgcctacctggataactcatataacactttacactatatctctcagaaaaaaattaccatattcaatatgcttcatatttattttcttaataaccacatttttaataacctcattttctctgggaattttgggtttcaggtacatatagcatcttcatgccaattttataaggtcataccttaatcactagttgcaaaagtagggatataaaggcaagaattctagattagaaagtgatatatgtgattttacaggaagacagaagaaagggagaatttgtgaatactatgtgaaagaagaataaacccatgagccaaacttaatttggatattaaagctgattatatcacacatacaccaagagagtatgaaaagatttatttctcacataatgagactttctggacagatcatggcaagctcaaaaacagttctgaaaatggcctaagataatatggagggatgagtagcttgcctgttattttacttggagttgggagttgtgcatctgggatgaagtttacatggtttgaactttccactggcactgaggtaaagatctaagatatataactggcttgccaagatgtagaacaaaacagaagggcgggtggtaaagcataaaaactattaacaataaggcaataaaaatcaatccagactctttattataactcactccaatgtttgactgaggagtaaaatgtgctatgatttatttaattgcatttgaagttgttatagtaagccattatggttacctatgaggctcacagcatgagaacggtaaggaaataaaacttccattgaataccttcgtcagcagatgtgatggttaattttatttgtcaatttaattggttgatgggatgttccagtgtttgcttaaacactattctgggtgtttccatgagggtatttgggatgcaattaacatttatatcagtagactgagtagagcagattttctgccgtattgtagttggaacttacctaatcagttggaaatctaaataaaacaaaaagtctgaatcaccctaaagtaagagagaatcttgctacctgacactttttgaactgtgacattggcttcttttcctgacttcagactcaaactgaaagatcagctttttctgatttttaagcctgccagcctttggactggaactacttcatttgttctcctgagtctccagttttgtgacttgccctgtaaaccttgggacctgctagcctccatgaacttccatgatattactaatttccttaataaatctcattcattctctctctctctctctctccctctcttagttctgttttttttgttgttttgatttgttttgttttgttttttcctggaaaactctaactagtacatgagcccagcattgtgtattttgtgaagtaaaatgtgttccttgctcacaattgctcacaatcaattgctcactattattaatgtgtagaaccgtgaaggggtaaggaataatttggtaaagatttgtattgtggcatcattatgtaaaaagacttgcaaccctggttatatagtgggtacttgtaattcacaaaatttcagagttattttttccaaacaggaggatgttggacatgaaaattttgttgctagcattggcctgcccaaatggccagaccattgtccacagataaatattccgcaaaattatgcagatatggctgattcttggacagagcatttattgttaagattactgcatgatgtttggccagttgcactgagccttgggtctcattcttgatcagggacattctgttgaagcaacagaaagtggctgttatgcagtgggctctattatgtgtaatggcagtgcttccatccatcatggtatattaatggactcacagttccacatggctggggaggtctcacaatcacggtggaaatcaaaggaggagcaaaggcacgtcttacatggtggcaggcaagagagagtgtgcaggggagctgcactttataaaatgatcagatctagtgagacttattcactatcacaagaataccatgggaaaaacccacctccatgattcaattatctcccaccagtacccccatgaaacgtggggattatgggaactacaattcaagaaaagaagtggatggggacacagcctaaccatatcacatgggtagtctggaacctctaaaagacataagaagaggttgccaaagcttctacagtgaacaatctttggggggcactaacttaagtctctgttgtattgcaatactgatagattctagagtcttttgttgtagggtgacccattcagggtaagtcaatttgtgagcaacaacataaatgagcttaaataaatgtaaataaggaatatgtttctttcagaatccaaaaggtcgaaaagatgttgaatttgttttaacattgtgggtgatgacagaatgaacaactgtttctttataatgtcaggaacggagcaccctctagttaaatgatagtgagaaattttactgaggtagtgaggccttttgctttgtgtgagtaagtagtccactaattttgatgagctctgttgtgactgtttggttgtcctgaatgaatgtgtaaatagactctcctaggaggatgacatcaatataatgtcatacatatgttcctagaaaaattttaatgtgattaaggtcttacctacaaaggctgtgtgcaacagtaaatctgttgcgatgcccctgggttgctgcataaggatgtattgtctttttgaaggtgaagaaaaactgcagctaagaagctgttgaaataggcaatgaaaggaatttactagctaaatctgtgactgcaaagtacttacccgtttctgattggattgaatggagtcagtaatttaagtaatatcgggtatagaagacttaatgggtgagattatgacattaaggttgcaataatccatcattaagtgttattcattatttccagttttaagaatagaccaaatacagttattaaataaagagaaactgtgggggataattacctcttctccaaatagttcttgtataatgtgttttgatcttcgaaggctctgtttaactttgtatgtggccacattaagtattttgaccagaggggaaaacccatgaggtccaattctgtgaagctgattgtaagtgccaaacatttgattttattttaatgtattatttatggggtcacatcatccatgcacactatggaatattttagtgcaaagcaggagcttataagtaggtctgtctcattctcttgatattggttgttggcaaatgcagatccaaattcaggcctgcatgtgcgaaccctcactctgattcctctccctaactataagaaaagtcaagccgctggctgcacccccatcccaacctgcgctatctcaaactgttttcttcctgcttaagaactagccatgttcatcccacaaagcctcattatgcgagtaataaactgcttcataccctcttgatgtctgtgtatggtattatcagcttcgacaacttgactaaatgtttggttgggtgtacattcttattgcacagatcaaccacaaaaagaaaccattttcgtctgatgtagtcatgaaaatttttacagaataatttaaatttgaaggagactgacaggtaaaaggatttgcataagctcaaatgagaaatgggaaaattcagtgcaggttatgtggaccatcatatatactggtttgtcaagttgaaaaatatttaatgtgcactagattctggtacattaattgatgttggagtatatttttacttattcattgttttctcatgtatttcttttctttgtgtttctctcctttcccatagacaacaaatagggttattctatgttcattacttcaaggatgatcacagaaatattttttcccctggagctctaagagtagatatccttaaggaaataaacaagtttaaacaaatggtttgctaacatatggtttgattaggtttggccttcccttccccaaataaaaagaaaagaaacataatatatagatacagatatagaagtatagatatttctagggcaggagaagagaacagaaggaatgacaagtttaaatttatcgaatcatatacggaggaaaaatatatgctgcttctagtcttggcttgagtgaaatggtagtactcaaaagaaatttgcaaaattggagagaagaagaaccctgaacagttcaggaagtctaataaagaaaggctgtatattcgatcgaagcagacacatatttaaacaaacttcagtgactctcatgctttagtgagacattggacctgcagttcacacactaaaatgaggcacggagattgccactggaccagaagggtacatcttcttgggaatcagggttatcttagcagcaatatacatagactaataactgagactcaagaagaaaaatcgaaatatctttgttgaaaaatgcaatcagatatctgagactgtgggcttgtccacattgatgccttggcagtaaatacgccacctagaactaattccaactcaaggacagatgctggcaacatggaattgcaaacctactccgagtgttctgacactcacatagaataaaaacttgagttaggaaaaaatagagaaaattatattgtttcactttttaaaaattactatgtcaattaaaatttatatactatatttagatgaaataaggttgacagtaatgtggaaccctagctatgaaggactcatatcagattacagcaattagtctttattttctacagaagattttgagtttgggattttgttataaaatcagtccttaaggaaaattaatctagttttttgcactttgcaataagaggacatttagaaaatataaattacagttaatttctctaatgcagttatgagataaaaattgccccagattatgttgttggatacacatgatagacaggaacataaaaacaaaatgacaaaatattaaaacttgattataaatttactataaaggccaataagaagaaaggaagtacttgaagttgtagttctggtgactggaaagacagaaccaatggattacagaatcaaatcaagaggtttgattgagaaaacaagacaatgccaatttggattatacaagtttctatgttatctagaaggcaaactgaaaagtagttgaaaatatacaaatagaatgcacaagttatcttgagatggatttaggcttttctaatagagattaagaaaggcccaataagcagtgcatcaaaatgcttcaaacataaaaagatgccaatttggaaaggttttaccttctcatttgtaggcagcatattaatggcaaataaatagaaagtaagggggagaaaaatggaagcaagatgcttggaaggaaaagggattaaagtatatgaacagaatgctctttgaaaaccaagcagg

SEQ ID NO: 481 - DNA, 5678 bp, Homo sapiens
gagaccgcagcctaagcagataccttggttgcagccatgtgagacaacctgaaacagagggcacagctaagcctcagccaggttcatgaccctctgaggaaactgtgagaaagcaaatgtcattttaagctatttaattttggaggtagtttattacacaacaataaataactattataattatcttgaggatttatttcctggggagaatacatggaattgcatatataggtcctcatatgcagaatactggtaccctagagatgttcaccccagagatgttttaggaacctgtgaatatgttacattaaatggcaaagttttcctggatggtttaagtttaagatggaaaagttttactggattatccagtgggtccaatctagtaacatgagtccttaaaaatggagaatattttttggccatgatcagagagacatgtgatgatggaaaaagtgtcagagatgcaatgtgaggggactaaaactgctgttgctgactttaaagatggagagaggggaacccgagtcaaggaatgcaaatggcctctggaagctggaaaaagcaagaaatggattctcctttagagcctgtggaataaaatgcagtcatgctgacaccttgattttacctcagtgagaccaatactggagtatgaccttcggagctgaataaaattatacgtacacatcttaatttcttgggatttgattacttcttctgctttgaaattagaccaagtttagcctgcctttgctattttggcgtatctccaattcttcatgattttctcatcgcaaaggccacataaggacagtgagaaggcagccacctgcaagccaggaagaaaggtctcaccagataccaaccctgccagcatgttgatcttggacttccagcctccaaaactggccttctgctcacatgggcttccgtgcacctgcttcaggagacagcaacacttgcgcccgcaccgcggcaggctcccatcacctggtggatatgccgcgccgagtctcatcacaccttagtgaaggaacacatggacccatatgttagcggatgtatttacatcgttttatacagaaaggggaagaaaactgcatacctcagaaaggggttgctcctcactctgagtactagactaaagataaaaagactagataaaagtactagactaaagacagagctgacccatgacagatggagtcttgctctgtcacacatgctagagtccagtggtatgacctcagctcactgcaatctctgcctcccgggttcaaatgattcttctgccttgacctccctggcagctgggactacaggcctgcaccaccacgcctggcaaattttttaattttttttagtagagatggggtttcaccatgttggccaggctagtctcgaactcctgacctcaaatgatctgcccgctttggccttccaaagttctgggattataggagtgagccaccatgcccagcctgttcttaagtctcctagaacagggattctgaaacacaaaactcatctgtttacgcactgagagcatctaaagaatttgaatgaggagcaaagctttttcaaaggttggattaaactacaattgtcctctccaaagaatgttcagctatcctttatgtactctgttgcaagtatttcaagaaggaggtgagaatatatgaggttcacgtagcagcaaaggaactacatggtagaagagggcaccttttttccaacatctctttatgctaatgttgtacatctgcaagatgcaagaagaggacaagagcctatttttgtagcattcttgagtcaagagcttccatgaaaagctttaagtagcaacaagcctgccattgaaaaagaaatatttggtttggaatttgagattgttaaaaatcattatagaatgcatgttctactgtgaaataaactgataaatgaatagtatgttggggcagcccctgaaaggtcatttacactacctagatgctttatagttaaggaaagtaggtccagagaggggaaatgatctgaccatggtttcaaagttatttagtaagaaatagaatgaggagtagttctcctgacatttagataataggaccaccatagaaaggtggttttatgattccattaagatttggatcatttttttcaaggctttgaaagtgagtggtaaaatttctattttcattatctctggagcagtatactagagtataccagatatataaaaaagcctttcatctaaaaggtaaatgaacaaattccccccaaaccaatgaataatatataaaatgaaacttcagaatacaccatcaaagtggcaagaaaataagaaatcttaagaggaataaaaaacttaaaaagttaaagcaagaatctaggaaattaagctagtataattttaaggcaaaaatgaaagaaaattataaaggatggtatactatttatttatgctgatcactgaatagtctcaactctctgacttcttggcccatagtaagattgtactgcctggattcccatgtgaccaattctggccagtgtcttgtgagagaaactaatgtgtctctctggctttgggctaagcatttaattgtcagtgagatcctccagtgcttgttttctctctagtaggatgattgacaatattccacatagcattttcttccacattttctggtatatcataccacgtgtgatatgatttggctgtgtcccaacccaaatatcatcttaaattcccacctgttgtgggagggatctgttggggggtaattgaatcatgggggcatgactttcctgtgctgttcttatgatagtgaataagtgtcataagatctgatggttttataagggggagtttctttgtacaagctctcttcccttgtctgccaccatgtgagatgtgccttttaccttctgccatgattgtaaggcctccccagccatgtgggacagtaagtcattaaatctctttcttttgtaaattgcccagtcttgggtatgtttttatcagcagtgtgaaagtggactaatacaacatgggaattatgggagctacaagatgagatttgggtgggtacacagagccaaaccatataaataatcttctcagtagatgtgaaataaatactattattatttccacttcatgaaaaaactgaagaagcgcaaaagctttaagtaatttgcttcaaggtcacaaagttactaaattacagaactagcattattgtcagtaagaaggaaaattacccctattgtaaagtctaatatgcaatggcatgacatatgaagatactaatatatatgaggatatacctaaatttcagaatgacgacacaaaactaccaaataataatgattagagaagttatgaaaatgaaatagaactaaaaccctcagcaaaaatagtatatagtttggaaaaggatggagattagatgttcaagtgttgtaagcttctcccagtgttcaaaagtagagcaaatatataaatttttattttattttgttttatttcattttaagacagcatcacagtggtgcaatcatggattagtgcagcctcaacttcccaggctcaagcaatcctcctgcctcagcctccttcgataattttaaactttgtaaaatatttggcaaaatatttataagtggccactacaaagtcagctaaaaagtgtatactctccaactggagaagattagagaattaataatagagaaaagactgaatcaatttaaagggagacaagaacgtgggaaaaaatggaaaaagcaagacaaataaaaattaggtggtagaaagtagaattagtaatttccattgatgtaagtggacttactctttatttacaacacagaaattttgaatgagtaacttgatatcaaaattaaaaatagtggaagtaataagaaatacatattatttctattcatgttaaaatttttaacatggtattagcaaaaataaatgaacaatctaaaaatgtataatacattatgaatgtttagattctccaggactgcaaggtaggtttaatattaaaaaaccaattagtataaattaattttattagcatatgattacaaaagaaaaatgcatgaccttctcaacgggtataaaagaagcattcactgacattcaatatccatgcttgataaaatttacggtaaactagaatcagaagtgatatttaataagtacatgttgaaatacatagaagatgccatgtcctgaatgtttgtgtcttcccaaaattctatgttgaaaacatagtcacctgtatgattgtgtaagaaggtgggttcttttgagaggtgattaggtcatgagggtagaatcctcatggaaaagactagtgccattataaaagaggccccagagacctgcctttcccctttcaccatctgaagacacagttagaaggcatcttctatgacccagaaaattggtcttcatgagacattgactctgctggcaccttgatcttggactctccagcctccagaactgggagaaataaatttctgttgtttacatgctacccagtatatagttttttgttatagtagcctgaatggactaagacaaaagacaaaaatgctcaccataactacttattttcaataattttctggaagtccaaagcaagaagaagatataaaagttagaaatacttttatagaagatagaaaagttagaaaaggacagcataatgttgctgttattattcacatatacattgtttccatataaaatgtaaagcatgtactgataaactactagacttgaacaggaaactttgcaatgttgatcaaaacaatagctctatataaaattcaatttgcattcccatgcctaatcaatgagaattagaaaatttaatgcaaaaatgatattatttacaataacagcaaaaatacaatgtattcacctctccattcacatgtatacttataagaagaaataaaagaaagatttttatgacataaagaaaaattataaaacttaataacattaaaagagatttaaaccaatgggaaggtaaggtataccacgttcataaacagaaagagtccagtagtttaaagctaccaagttctctcttaaaacttaagtcaaaaacttaccaagacttttgtacaacttgacaaattaattctaaaattctaaattgattctaaaatttttgtgaaggaggaagagctaacaacagccaaaacacccctgaaggaatgggaggagaaagcagaaaacatgtcctattggatgtcaagatctttgcataaagcactttagttagaaatgcaattttgacttaaagatagaaaaataaatcaattaaatcagaagagaattagcaaaaacagacccacaaatatatggaaatgatatataataaaacttacagtacaaataattgtgtaaaggaaagacaacttaatgatactagaaaaatagttatttatataaaaaattaaattagatttctctctgtgtataaaaatctattccagttaaagtcttaaatttgaaagtgagtcattttagattttattttaattttagaagacaatataggagaatatctatatgacctttgggtggaagaaaattttataaccaagacacagaagtgctttcataacataaatttgta

SEQ ID NO: 482 - DNA, 2398 bp, Homo sapiens
gacccctcagggcttaaagacttgagaatgacagatgatcaagtgaggagaaagaacagctgtttaccatcttcccagagtcaaattgaacacactggaacagagagattgcattcttacccaaatactcttcgtgattgcctgctttgcggctttggggtaagtcccagttttccacaaccttaagaaaaaaatgcataacataaaagatgccagaaagacttatgtgtcctgatagtcggggtctgtgaaatatacatgggtttgttacgggggtgggaggcataatgaaataaagaaaagcgatttgtttctgcaaggatcaaaagtgtgcgaaagtgtgcatatgcaaacgaggctcccatcaggaaagccacctctggaatgtaaatgacaaagcttggaacacacacaatcaattattttcaccagcatttaaaatatagaaaacaaaatctgctttgggaattgactgaatattttatttagctttttttattgagacatcctttgaaaaatggcataatataaatagttttacaaagcaacaatataatcaatctctaaactagaatataaatcaaggatttcattaactgctggtagccagtttaaattgtagtcttgtccataatgtctatctatctatgtatgtccaagttatattaaaaacctttaaatggctttgtaatatcagctacatctagctattataataattaatggtactgttttataaatcaatacatgtattcttgataaattcatatccagttaatggtgtaatttaaataaaaaattaatgtaataaaggacatacagaagcgggcaggaaatctttaaaggttaagagccaaatttgtctaaattcatttttaacctgttttggaaaagtttatatttaaaatcagctgagacttaccttgtttctgtaaaactaatcttgccatttctggtggtatctagtattaaatttgtaaggtgttttctgacgttgttttaattacgtagttacaatactgtggaatattttactgtcgttgcactattttgtgactattgcatattctttagtaaaatagaacaaaacaaactaaaaacatcacaccagcaatttatttttaatacacaaatgcatgtaaatgatttattttttgaaaatctccaaaactatacacacattttatttaaggggaaaaatgactgactagttcaataaatttgcatgtggaagagccgagcattttcactgcttccgctgagtgaacattccaagaattttagaaagaaaagaaaaatgcatgaaagagtctgaaatgtattttaacgctgcacccgggtacaggaacattctaccaaaagatgagtgtattacagttctaatgtaaagaatacataccaaagacatatttaaaaaataacaagatttagaaaaacaactgaaggttgtatgttatcaaatacaatatcaaatctttccaaataaaatttcatttggttcataagagtacgcgttttacaaaaaatatctttcaaaattatgcagaccagtctgccctgccatcctccttgacatgatgcagaaatgttcctttaatccactgagctttttctgacatttttcttaacattgctgagccttatttagagcaccaaaggaggcgtgtgcagttttctttgacactgatgggtatttcaaaatgttacagagagaggggggaaaaaaaagaaagaaaagatttgctgccagtcacttcatcaatagagctacagaagcaattactatttgttaaaagtttacatttcaaatgaagctaaattttaaagaagtctcatccttttagaaggactggtgcttggaagagagaggaagagaatgcacattagtgattacatgttaaagtgcactcaagtactggaaccatttaaaatgtattgtgtttttagttgaaacctgcagcaaaaccactcctaagaggcttaatttaggttttataggaggaacataaaaaagaccaggttacagcaacatgctgaaatatggggtacattttaaatatcttcatttaaaaacgtatgtttatttcccctcctgggatcactaacgtgtgtctccacagagaaagcaaggacatgcattcttaaaaattatctgttaaagggatcacattccaagacaggtttgagcatttttattactacagataacctcttaattgtgtcactgccttccacttgttaatcagggacattcaacatagttaaccatgcagtggttgtctttagaagaatacattatcattaaggattagaaacacattttattcctataatcatattgcatgtatggttttagcactgctaaaaccctatttacctgctttaaatacataacacc

SEQ ID NO: 483 - DNA, 7787 bp, Homo sapiens
attttacttcgacaaaggttgaagtatgtagcaggcgagcgtcagggacaagtgcagctatctctttgatcacatcgctttaaacatttttcagctttaagcttgtcttacaagtcagctctatcagtctattaattgtttcactgtacctaatatcttacacgaaggcaccttgaaaaacagcaggagaaagcacatttgtttaagtcctgcgatggctagcacggcagctaatctccttgcaaattataatcatagttgtagttcatccattaggctggaaaagacaagattcccaagtggccttggtgccttttccagttcccgggagacccaccaaccctcggcgtgtgttgcctgcgcacccggagcgttcttgctaatcagtgaggagctcaacataacagggaaaaggagcacaggatgcagctacttagagggtgttgattgaaaacttcgatctccccaccccatcacggttgatttgacggatttctcacctcgttcacagagaaaatttcaattaaggcacatggagacggacctctacctgcaatgccccccttgcacttggacagaaccatgtgactatttataagctatgacacatgagcagacatgacatgacgggattgatggagcaatgacctcatcttttctcctgccaaatattatgaaagaggactcaagtcactcacctgagggacactgggtgaaagtcagtaatgaagctgaaaggtcgctaaatgctggcaagtgagatggattatagtgtctagactttttcctgaggtcattctatatccagcagatatctttcagtatatagtctattcagaacaatgtgctagtgactattgagtgtggttacattcttttttttttttttttttgagatggagtctcactctgtcccctaggctggagtgcagtggcacaatcttggctcactgcaacctctgcctcctgggttcaagcaattctcctgagtcagcctcctgagtagctgagactacaggcacccaccatcacggccaactaatttttgtatttttagtagagatggggtttcaccatattggccaggctggtcttaaactcctgaccttgtaatctgcccaccttggcttcccaaagtgctgggattacaggagtgagccaccaagcccagccagttacattctttaaacaaggagtggacgtaccctgaaacaagagattagtcaaagagattttgctattcatgggacctaaaaggtggctgtacttccctttactgcttttccatacacagcaatgcacgctgtatgggttcttataggtcagagagtgaaagagaaccaggacctataaaagaatacaagtctctaaaatcagaaagtttattatttaaaaaaatagttacgtgccagtctgcttataatttatttttatgactgagagtgcctttcataagcacattctggcaaactataaaacaaataaattgaaattgaataaaacctttagacattagaagtgtagcaccagatttagtacataactgcaaaacttaaacatgcaattttacatctgcaagcacattaaattgaaagaaactttaacttaatttagatacattaattgatacaaacttttctggtatatagcacttcttggcgcattgagtattcttaatctttaaggcacatgaatataataccttaggaaagatctgttctccacacatttcctctataaagtgccaaaaaaaaaaataacgaagagccagtttgtcttccgcatcagtgtgatttagcatacataaataagtatcttttcacacaaaataaaaggttcagaacccaaagtgtctgatttttatagtgctttttctttccttttaaaaagatagcaagatgagggtaagaggtaatttaagagaagtaatcatcttctaacagccagcttgcagaaactaaaacaaatatcaatgatgtaaaaatgttgttttgacactttggtaaatgaaagtgtgagatgagtaagaatatattataggtgcttgtatatcaaaggcctgtgaaaatggctgattataaaggagaaagttaatgatctctaattgtgttgtaatgtaaatgcagtatcaccgtaatgaagagaacagatttgcatgttaacaaaagaaatattagaggagtgagtgtaggatgtttgggataattaattccatcctccactcctacatacatatgcatatacaaactcaattcaattttaaagagaacccgaagaaccaaaaatagactgaacacacttgatgttgtatgggagcttaaattactatttttgttgttctctgtgactatctcatttagtttctattgtgtttgcagtttcttccaaggtgatttttaatggattgagtaatgcataaaaatttgcagaagtatgcagaaagtttgtatgcagggccatgtagagcttttatcctacagtaaatcctagtagtttgctggtgctgtgtgattttttttgtttgtttagggtttttgtgtgtgtgtgtgtgtgtgtgtgtgtgtgtgtgtgtgtgtgaagcttatttattccatttccgcggtgaggaaggacgctttctaacgggccacattttgctgtgtagacccaaaactcgcctctgaggccccgcgttcaggagcggggtcaggtggccccagggcggcggcggcttgccggagactcgcgagctccgcacccgacgccctctcccaacgcggcctcctgctcgcgccgcggaaccccttcgtcgggtgttttacccaccggaggggtcgtgccggttgaggttgtcaccgggtgcgtggcatagctcgtgatagctcatgggtgaggttttgtgcaaacttggatgcagggaaagttgcctgttagagcctccacctgcgacctgcttcagtcgttgtgtgtgtgtgcgcacctgtgtgagtgtgagtgtgtatgtgtcctgctcagcgttgcaggggggtttatgtagccgtttggacaggatttcccgggttaccctgctggcccaggagctagttcccgcgatgaagccctgtccatcctccgcccagctctctcacgcggggtggtgccacctgggcctgcccaatggctctgtgcctccaataagggcctaagaaaaagtcccacaggctgcccctggcaatatacaaaaatcagtagcatttctatacacaaacaaaaacctagctgaaaaagagatcaagaaggcaatcctatttccaatagcaacaaataatataaaatacctagggataaatttaacaaaagaggtgaaagacctctacaaggaaaactacaaaaaactgacgcaagaaactgaagaggatatgaacaaatgagaagacatctcatgctcaaggattggaagaactaatattgttaaaacgactgtgctacccaaggtaatctacacatttaaggcaatgcctatcaaaataccaatggcattctttttagaaaaagaaataatattaaaatttgtatggaaccacaaaagaccccaaacagccaaagccatcctgaacaaaaagaacaaagctggaggcatcacactcccagactcaaaatacactacaaagctacagtaaccaaaacagcatggaactggcataaaaacagacacacagaccaatggaacagaacagagggcccagaaattaatccgctttctacagccgactgatttccaacaaaggtgctaagcacactcactgtggaaaggacagattcttcaataaatggtgctgggcagtggcttacacctattacagctacttgagaggtgggaggattgcttgtgcccaggagttcaagaccagcctgggcaacacagcaagaccccgtctctacaaaaagtttaaaaattagccaagtgtagtggtgtgtgcctgtagtttcagttacttgggaggctgaggtgggaggattgcccgagctcaggagtttgaggctgcagtgagctatgagccactgccctccagcctggatgacggtgcgagaccctgtctctaaaaaaaaatttctactctagtgcttacagcagaccaattcatagtgactgaaaatggggacatcctaccgcctatcgactgcccatcagcatctgggtggctagcccagctgtggtgcattcacaccaaggaatgccacttggcaattaaaaggaactactgttatgtggaacaatgatgagtttcacaaacactgtgccaagtaaaagaagccagatacaaaagactgagtgattccatccatgtaaatttctagaacagatgcatccacaatgacagaaaacagtctggctgcaaaggggcaagaaggaagttttggtttttgtttggagtcagggtctgactgtcacccaggctggagtgcagtggtgagattgtggcttactgcagcctccacctcccaggctcaagcaatcctcttacctcagcctcccaagtagctgggatcacaggcatgtaccaccatgcccagctaatttcttctatttttgtagagatggggcatcactatgttgcccaggctggtcttgaactcctgggctcaagtaatcctctcgccttgacctcccaaagtgctgggattacaggcatgagctacagcacctggctgtttttaagtaatggaaatgttctatatctccgttgtaacaggatttgcatgggtgaagacatttgtcaaaactcatagaattgcacacttagaatgggttttctttatataaattattcatcagaaaattaaaagggaaaaaaggctaggggtaacaacaaaaatacccttttagatgaatataaaataatccttagagaaccatcgtctccttatccttggcaagcatcccctcagggagagctgctgttctctttccacccctctgatgtcagccccagttcctgggagcccagatccacagcgttgtcagcctaagagagaggttctctagaagaatagatgttagcttgagaacagaacattacaaggagagtacacacgccatagtaaaccatatgcctattcagggaggtcaaggaagacaaaggtctttaaaggaaaagcgagcaggatcacagtggttttgagataattctccttggctacaaacatcaataacaaaggtcattccagtctgtggtagcctgtgtcagaatctccttcctgttaagggctgagcgacgttccattgtgtgaatagaccacagtgcgcgtacccattcgtccatggatggagaagggctgagcgacgttccattgtgtgaatagaccacagtgcgcgtacccattcgtccatggatggagaagggctgagcgacgttccgttgtgtgaatagaccacagtgcgcgtacccattcgtccatggatggagaagggctgagcgacgttccgttgtgtgaatagaccacagtgcgcgtacccattcgtccatggatggagaagggctgagcgacgttccgttgtgtgaatagaccacagtgcgcgtacccattcgtccatggatggagaagggctgagcgacgtgtacccattcttccattgatggagaagggctgagtgatggtccattgtgttaatagaacatgatgcgtgtacccattcttccactgatggagaagggctgagcaatattccattttgtgaataggccacgatgcatgtacctggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggttcacgtggcttgcatgttgggaagttgctgtggtctgcgtggcttatgtgttgggaggttgtggtttgtgtggcttgtgtgttgggaggttgcagtctgcgtggctcgtgtgttgggaagttgctgtggtctctggcttatgtgttgggaagttgctgtggtttgcgtggctcgtgtgttgggaggttgcagtttgcgtggcttgcgtgttgggaagttgctgtggtctgtgtggcttatgtgttgggaggttgtgggtttgtgtggctcaagtgttgggaggttgtggtctgcgtggctcacgtgtggggcggttgcttggctcgcctgttgggagtttgtggtttgcatggcttgtgtgttggaaagttgctgtggtctgtgtggcttatctgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgttctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccaggg

SEQ ID NO: 484 - DNA, 6032 bp, Homo sapiens
agagatggagtgcatctgccccaagtggaggcagcagcagcagcaggagggaggtgtcggggcagtggggccgcagggccagtcctcaggaaagaaaactggctcagagaggctgagtaacctgctcaagatgacacagcttgtgggtggctgagttggccttccaacccagattcctgtcatgttcctcaagccgacaggttcagcttggttgtgacctctgctagaagccctccctggcctccctgtgcactgagctggtggttcctcctttgcgccccaggtacatgctcagatctgtgtaccctacactttgtcctccagcttcgtgtttggatgttcacaactcccatgagaagggcccccgagagctggcacagtgcatgtgtttcctctccagacttctacaaacctggcacataattgtttgctgaaagatggcatgttcctaaaacagaggaagtagaaccgaataaagcgaaatccaacttcccactccctgctctcacttcctctgggacaggccttgagcaagagagacaaaaagaacaagagatgatctttccctttaatgggatttcagtctgatcagggagatagtaacagaaagactagactagactagtgtatgattaaatgacatttgccatccccagaagagggagagacctgcatggaacagggtggtcaaggcaggcttcctggaggaggcaaagacttagatttaacagtaccagagctccaggatagatcctcctctgactgaactccctatttctttctcccaccccaaccttcccgggtccccagctgaagggatacgtgtgtgtgtgtgtgtacatgtgcctgcacacatgtacacatgtggttagaaagggggtattagtatctctctcctaggatggagtctcaaggacaggcccatcatctcctcagtttgcccctctctctcccacttcacctagggaatggaataagaatgggataagtataacacaatgagacgaatgcagaaccaactagatgtacacccaacaatgtggatgaaccttaaaacagtgctgcctgaagaaggcaagaaacagaatgaaatctgcagcacatcattcatataaactaaaaatacatgcacagagaaaggccacttttttttttttggagacaaagtttcgctcttgtcactcaggctggagtgcaatggcacgatctcggctcactgcaacgtccacctctagggttcaagcgactgtcctgcctcagcttctagagtagctgggattataggagcccaccaccatggccggctaatttttgtctttttagtagagacggggtttcaccatgttgcccaggctggtctcaaactcctgacctcaggtgatccacgtgcctcggcctccgaaagtgctgggattacaggcgtgagccaccgcacccagtcagcaacgtatgttttgtagagacacagacaaagatgtgatgtcaaacacactaatgtggttgcctcatttatggatgggggactgggctggtgaatgaggattaaaggaataaataaataaaacaagagagggcctctgtacagaacggtgatgacagcgtgccgtcgaggagaatgatgaactcaaacttttgcacctgagagccaaacaaaagctcaaaaccaaaatctctcttagaaatgatgccactgactttaggatggcactcatatctgtgtgagtgggagagagaagggtttggggcagggatttgactgtagctgtaatgttttattcctttaaaaaagataagataatctgaaacaaaatgttaatatctgttgaatctggggagaggctatgagggtttctgttaaaccattttgtgtacattttaaatacagtcatgcatgagttaatgatggggaataagttcttagagatacgttgttaagcagttttgttattgtgtgaacattatcgagtgtacttacacaaacttaggatggaatagctgactatataacttagactatatggtctagcctattgcttgaaggctgcaaacccatactccatgttactgtactgaataatgaagacaagtgtaatacgatggcaagtatttgtgtatctaaacatagaaaaggtacagtagaaatgtggtatcgtagtcttatgagagtactgttgtatatgcaatgctttgttgactgaaacatcattatgtggttcatgactgtatatcataattttaaaaaatattttaagaggttgccaatcaagacactacaaactaattttgtggcttttgtcaaaattcatttctttctttcttttttttttttttgttttgagacagggatcactcaagcaatccttctgccttagcctcccaagttggtgggactacagtcttgtatgccaccacgcttggctaattttttttttttttaaattattgaatagagatggggtcttgctatgttgcccaggctgatctcaaacttctggactcaagtgatcctcccttcttgttctccctaagtgggattacagatgtgagccactgtgcctggccctggctaaattttaaattatttttgtagtgacagggttttgctatgttgcccagactgtcttgaactcctggcctcatgtaatcctcctgccttggcctcccaaagtagaattcatttctgttgctaggttggcctctgaacagttttacagagctgaatgctctagtcttctgtgacacagtctttttcttttttttttttttttttttgagacggagtctcactctgtcacccaggctggagtgcattcggctcaatctcggcttactgcaacctctgcctcctgggttcaaggaattctcttgcctcagcctcccgagtagctgggattacaggcatgcaccaccatgcccggctaatttttgtagttttagtagagacggagtttcatcatgtggccaagtggtcttgaactcctgacctcaagtgatccacccacctcagcctcccaaagtgctgggattacaggcatgagccaccatacccgatgacacagtcttaataaggagaagaatatgaagaatttgactttttattgatgctaaaagcattaataaataagatctttggaaaaatgtggaaaatggaaaatgtcactgcctgctgtctgtagggtgaaatgaaatggctaaagagctataggagcattttgttctcacttgttgggtcagatcaacttcccaggactttttgggaagatcacaaatcctagacaatcgtactgcactgctctaggaattcttggagggctggaagtctcacaattagggctttttctctgggcaccaacctgacacgcatggcaagggggctgagcagttgtctatggtatagatgctatattctatgactcctgttggccctagccatagctgattggtatagagggtcaaagctgggccaatcagattatctgtctcaagattctggaattctgaactggggcagagacagggagctgtgggaatgtggttgctttaatgggaatgttctggtgaggagatgcattgactccagatgcttacatcctttcctgaggctcaattgttcaaccttttcttgaaatttagggccaaacaaaaggtcaaaaccaaaatcactcttagaaatgatgccaccgactttaggatggcactcatatctgtgtgagtgggagagagaagggcttggggcagggatttgactgtagttgtaatgttttattcattattgtgaattttgtcatattattgtgatttgtcagggttgatttctattacttgtcctatggagtaggttactatatttttgtcttctcaccttcccctggtgctgctgttaatacatatggtatctttattgagttagaaaaagatgcctgactctgggtggacaagcaagaaaaagctgttctttccttcaggcggacacagcctctaacgagggtggaaggtttggccagtggagcacgggctgggtttcaggccatactctgctcacttccttggcccagcccttttgtgcattgcacagatgacatccccatttatggcggccttacacctgtccaccatgtgcttttgggatgatctgtcttctgcagctaggcattgttcagaatatgaagggctattccagacaagattcacgggacatggactatcatgcaagtcctattctggactttaaggctcatgacaaagatgttaaaagtcaaacctgctcaaagtcaagacttaaaggaaatgtagaaaaactctctggcctgataaagtccacagaagcctcatcttctgatgaatgatcttcaggcttgaaaggatgccttcctccaaacaggctggcagacattcttgaaatgtcaaaggataggccaggggtggtggctcacgcctgtaatcctagcactttgggaggccaatgtgggcagattgcctgagctcaggagttcaagaccagcctgggtaatgtggtgaaaccccatctctactaaaatacaaagaattagctggacatggtggtgcgcgcctgcagtcccagctactcgggaggctgaggcaggagaatcacttgagcccaggaggcggaggttgctgtgagccaagattgcaccactgcactccagcctgggtgacagagcaagactccatttcaaaaaaaaaagaaaaaaaagaaagaaagaaagaaatgccaaagggtactcttccatccccctgtgaaaaaaactaaaaaactagtggtgagaagttaagagcaagatcacaggaacagatgacaaggaggtgtctgaaggccacaatgagagtgacatggaaaccagtcaaggcactgatggccatgggaagaaaatgatctcaaggaagagataattccttgagaggaggctgctccagctctgatttgttcattcattttacagtcaggaagccactccaccccagaagaaggtaatatgagtcctactacctttctgaaaggaaggtgagtacagaaaagcaagacagtaactttcccaagccagggaacccctgtctccccaacttctgcatcatgtagaccatttgtgtctacaacttacaggaggcagtgtagactagcagttgagaatgtgagtctagaatcagaatgcctgggttcaaacctcaactctgtcactttccagctatttggccttggacatattacttaaacatttgtgtgttttaaaacgtgtacacaatcctttgactctctttccatcaagaagtggagcctatgtcccctccctttgaacctgggtggaaatgtgggagtgcctagacaaatagaatgtggcaaaagtgacactgtgtgatttccaaggctaggttagaaaagaccctgcagcttctgatgattcctttagggacactcatgtcgggaggcttcagctgctgtgaaagaaactcagctaccctgaggctgccttgtagagggactgcatttaaagtgagagattcctgaggagttccagccatccagccccaagcagtgtgaacctcctagtctagaccccagcatttgagctgacctcagccccagccaccaattgactgcaaactcatgagacaccctgagtgagaactgcctagcttagtctctgtcaaccctcaaatttcaggaacaaaataaatgattgttgttgtcttaagaccactgtttggggatggtttcttatcatgcaatagatagctgatgcagacttttctataacctagaaacggaatgctgccatcacagaacctaagtcatgtggctttaggactgggagatgggtagagattgtaaggactttgaggatattgttgatggaagtctgatagttctcaaggaagttgctggtgagggcttaaaggaaagtgagaaatttttattagaagcaggaggaaaggggacaaacccttattacgtggtggaagaaagttagtaacattgtcacttgaagctatgtgagcaatagaaaatgtgccta

SEQ ID NO: 485 - DNA, 2931 bp, Homo sapiens
tttaagacagagtttcactctcgttgcccaggctggagttcaatggcacgatctcggctcactgcaacctctgcagtgtggtagaacgcagatgtggtagaaatagccaccgcatcggcccacatcaaagttttaaacaaagatatgctaagctgtgtctgttggatgtgccaaggacctgcaattttggttacctgcaaaatgctttcctactgtggccttgtgctaccagccaacgtgacaggatgccagaagcacaggccctttgaaactgttgtacttatgctgaggatgctgcccttcattgaaagagcataagagaatgtcttccgctttagcaccagaaagagttacaattcttctaagaaagtggctgcttcggtatcacagacactctgactcacattactaatcatggtcctctccctgcataggctgctgggaagctcagaaccagacctgaggccgtgctcctggctgcttactgtcctgccttctaaccacccttttgcttggaaacctcatcccaggacttattttggttttcctattcttattttcctgatttttcttacttaacacacccacaaacaattctgatctgtggttaaaaatatatcgaaattcagaataaaattaaatgcaacttgttttcaaataaactatgggagtataaactatatactgagagacatgatagggttctaaaatttcttactgagaatttggaacaacaatgttaaatgatggtaaggttcacagggcagtccaagtaaatttaatttaaccatgctgcagcaaaatgacagtgttaagagaagtcactcccagcgtaattctatactcatgttaaaaaagaaattcttattagaggatttgtgtttaaagagacatcattgattatctgaatttgtataggcactggatatattaagtcaactaacaaatcataagcatttaaataggagtaagtccaggggccttgtaaataacccatagtttattcagtcagttgacttgttcttttttccttacataaacaagtaacagggtgatttaattcagtgagagtggtgaagtgaatacagatctgtgaagaacaataaaatgttaattttatgatcctgtttattttgctgaagtttctacatgataggaaacaaatgcaaattttgacccagggtcagtccttactatttccagcagcagaaaatgaatctactaggatacctgaattttataagcaaatccaacctatttcatataaacataataaggtcttggacacagttattcatagtccgagactattaactgggctctcattcagcatttatgcatttgaaatctacctagtcaaattttcttgacaaaatgttagcctctaaaggaagaattctgcttctgataacccattatgctacttttacacgcatgtgttaagcaagcagcagaatcagatttggaatttagaaagatattctttccggtggcaataggcaggatgcctggcagagcaaagaacaggaggtagatagacccggagggggctgtacaaaatgcagacagaaactgatgaaccaacaaaaagcaatcaactcgtgagacataaagaaggtccggcaagggaaataagtgagagaacctgctgggcataaggacctactgactacggtaaagtaaggggagaaagtgaagtgacttccagcttgcacaaggaaatactgggatgatgagaggcaatgctggagtgttgagtttgcctgaaggattaggttggggatgggttagggatgatgtggagttttagtttagatacgaggtgttggtagcataaccagaaaatgcccaggaggcccctggaaaggacaaatggaggggaatcactagagcacacaaggttggagccatgagttgtgggcatctagggagggtgtgggaaggtcaagatggagtgcaaggggcctccaatgtcaagcggagccaagagaggagcagacaaggagaaggtggtgtcccgcacgctagggaaggaagaaagaagctggagactggttaattgggccaaagatacaatgaaggaaagtgacaagaaggaaggtggcaggccagactgcagcagagtgaggagtgagggcagctgacagccgggagagtgcacagaccattcccaccagctgcaggctgtcagggtatcactgacttcctaatcggcacaggccacattggtcttttcccaaggctcttccagacctgcagaatctgggtttctgctctatgagggtccctgagcataggcccttaaaaacattctcaccacccccatagggaacagtacctggccatggcgcagaacaagtgcatgagaggacagagagagaagggaagctgatgcccccggcagggatgctcatgctgcctgccgcagccaatcaggtggaacccagggcctgtggtctaggatctttccttccattaaggtaaacagggcaaaataagactcaaaacaccacaggcttcgaagacatcacctttcagtactccacctagctctgccaaacctagcctcagctgtatcctattgctgaaaactctccttacagtacatccaacctttccaggccttctctacgtctgcttgttccctgactcactctggtaaaatctcacctcctatctttcctttctcttcattttttctgccatccattattactactctgcagaagtatttacattaacactactccccctcctctgctgacactttggaatatggcatgtacccaagttaatttattttcaatgtataaaactgtaccctttgtgataatattaccttaggatactcaaacacaatacaaaaatatttacttaagaaatctaaaacaatagcagctgggagaaatatctattaaaataccaactgtg

SEQ ID NO: 486 - DNA, 2609 bp, Homo sapiens
ggtaagatcctggcccaagctggcccaaagcaccactcactggctactgggactggttgagggagtggaaacctgaccaaggccctaccccaggccattccagatggagttgaaagagaaaacagttttcctccaagtggcaagactgaaaggggcatgtgtgccctgtcaccggccccgtccccagcatctcctcctgccctgtccccctcacagctctggcactccaagtgtcatctcagtggaagggtttcctgactcctcccctggtgggggctgtccctcttctgtgctcctccatcacccttgctataacacatgataggtgttcaatcaacattttctgcagggagagggaggggagcagggctgatacatttatttttcaaggacttgcatactaataagaataaaggtaataccacagatgccagttcagaacaaagaaattatctggtcacactaggcagcttgtctctcttctgaatatagagatatgtatatcatcttctgaaatcaactcctttttgcagaaatgacttatttgcattaaaaatgacttatcccacatcgttccacatcatgttgcacttggttacctgcatacagcagtgaagtacaacagaaccccaattttttattactttaaaacaatttttttagagacaggggtctcactatgttgcccaggctagagtgcagtggattaccacgactgagcagactctgtgggcgccctcataccacatgctgcaggcaaccacagctaggatcttccttttcctttctcccttaccgctggcacccaggaccacaaaattcattaaagaaatgtttctcactgcttgtgaatttgttttcctttcaggcaatgtgatgacaggctaggttcttatgctttaacagcccatcatgggaatttttaacttaagcaattataaaataaaaatgtactgacgctaaagattcatttataaacctgtcgctttaatctttcttcatgacttgttggtgtaattaggcagctatatagtcacataaaatttcacggaaaaattatatgcttactagttgttggtcatgaaacaacttataacattggacttcacgtttattctcagactaaaaatctaaatgatagcgaaatttaataaaacttcttggaaggcttacagataatttttactttgtaaagcatgtgcatgctttgtaaagctttctcatgcttcagtaaatcagaagtaatgatgggggtacacattttcttacttaaaacttaatactgggaacaagagaactagcacgttgctacagtctcatcaacaactctgaaaaggcaacaagccaatacaaacaaatacagttttccaaaaatacctgataatacttctaaattaagagctgacttcaagggagtggggaataaggggagatttcttaaagaatataaaattatagctagacagacacattaaattctagtgttctgtggagtgctctatagtttatcatattaagtatttctcaattagctagaaaagaggtttttaaatgttcctaacacaaacatacaataaatgtctgaggtgacagatatgctaattactctgatttgatcactacacattgtttcaaaacattactatgtactccataaaaatgtgtcaattttttaaaatcttgttaaaaaactgatttcaactttattttaaaataatttagaagcatagtaatttctggacgtctatttaatgaaatgtaaagaaagaataccaaatatctaaccattcaaagtcaaaaaataacatagatcctacagattgagtctatttgaataggagtaatttctaaaaacaatcattagtttactacttattcctttgcattcatatagtagcttcctaatactcaggttgaaaacaagcttgataagatctactaattaaaatggtaaaactggaacactgtccagtttttaatgttaaaatttaaaatcccacaaactcaaaataaaattacaaaaaactaaggctgggtatacatttcttcatttgctgctctgacattcatcataattagatacagataggaaatttttcagtctctgtagtacatacaccaaatagacatgcaacttgttgttgttgttcaagtctgaaattctcttttcagttaatatatttactgacctcttctgggactctcatgattgaagagaatgccgttcactgcaaagagattatacgcctcacggaagttcaccacaatccaataggcatagagttttgctgcccctgttggaataattttttttaagcaatgaagtttgttgtaaaagacagtgattctcaccatcttcaacagtaacatcttggccgaaataataacttgtaatgcatccaaatacaaaaaagtatcaaaacccaaagacgaaataaaggttattacacctgtcaatcatgttcaccaggaaatattttaagaatttcttacttttgtaatgccaacagtgcattatttgacaatcgaattgattgaatctttcttagatctttttctctctcattctctctctctaacttttgaggaattagaatggaaaaaaatga

SEQ ID NO: 487 - DNA, 42664 bp, Homo sapiens
ctggccgtgttaggcttcgctggcgtaaagtccccgggagctttgcccctcacggagaacgttagttgaccctgatggggacccgtagggtaaaggttttgtttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctggagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagttatcttgattgttcactgccagttacagaccaaactccttgttctccttgtgctccacttctcaaccactgcacttggctagtcttaaacaaaaaaagaaaaaccctaattttaatagcttgtggggacagacgcagtggctcacgcctataatcccaacactttgggaggccgaggtgggtggatcacttgaggtcaaaagttcgagaccagcctggccaatatggtaaaaccctgtctctactaaaaatacaaaaattagccgggtacggtggcacacacctgtaatcccagccactcaggagactgaggcaggagaaatgcttgaacccaggaagtggaggttgtggtgaacggaaattgcgccgccgcactcaagctgggcgacagcgagactccgtctcaaaaattagtattaatagaatgtgggagattttgaaaccaagtatagaaattcatactttatattgtttaaggtccgtgactaggcatagtaacatgatgaaagaactgttttgggtttgtttggtttttttccgagacagagtctcactctgttgcccaggctggcgtgcagtggtgcgatctcggctcactgcaacctctgcctccctggttgaagcgattctctttcctcagcctcctgagtagctgggactacaggcacatgccaccacgcccagctaatcgttgtatttttagtagaggcggggtttcaccatgttggccaggatggtctcgatctcttgacctcgtgatccagcctcccaaagtgctgggattacaggcaggagccaccacgcccagctagaaagatctgtttcagaaagcaactctggcagtggaagctgaatacatactccatttctataaagcatttatggaggcctctagatgtgccaggcattgtactactgctttatgtaaattattgatgggtccgcgaatccattaatataaatgtgagccagttgttgtgcaccccaatttacaggcaagaaaatcaaggttctgagttgcagatgggctgagaaaaggctcaccaaccacatgtacgcacaagagattaggaaagaaaactgccattggagccaggctccagtaagcactgagtattcattggtttggatgaggatactgaaagaaaaaaatgacatgtaagagtgacttttctcaggagaaagaataggctgacatcaagagtctttgctgtcacattagtggtatgtataagggcacaacacaacagaagtacatttttcaaggttcgtaaaagaaccctggggtttgcttttaggtttgtttattacctttaacaaatataaaatgccaggtaaatatatctttgtatgtagtagagaaattaataagacatacccttccctactcaacatttcatctttgattttatattctcaaaaatattgtgaggtcttttaaggaaatgatctccttttggcagatgaggaaattgagggccagagaggaaaaattatcttcccaatgccacatgcctaattggtctcaaagctttgactggaacctgagcctccagaattgctgctatgctttcatctcccttagagagatagataacagtagtcagagtgagtggacaattcttctattcagtcagtctgatcttcctcagggatgcatatccagactcccatgcagctagtgatagttaaacaaagaggcagagaatatagtgcattataaatagcattcatacactcaaaaatattgtgtgccgatactgtgccaaacacttagcaaagcagggaaaaatccctgtcctcatagcagagactaaaaatattaataagtaaaatatatactaagacaggtaggataagtgttggcaagaaaaagtgaagcagtgagaggggaatagggtgagccgagagtagggagggaggtttttgtttataccagaggcagaggagccccactgagaaggcaaactgtacaaagatctaaaggaggcaaaggaacaagaaatgtgccttgggtggacagggaacattctgggtggaataacaagtgcagaaatcattaaggcagaaagatgcctactacattctgagaacagaaagcagtccagagtgatagaagcagagtacaggagggtaaaagtaggaaatgaagtcagagaggtaagaggaattcaaattgggcatggacttacaggccattgtaaggactttggctttttctgagggagatgggaagccatcgttgagtagaaaaatagtgaaattctacttatatatttaaagaatcacattgacttctagtttgacactagattattgaggagcaagggggaccacttaggaagctattgtaatactccaggtgagagataagtggcatagaaaaggtgcaagcagtggagggatgaggtatctggatatattcagggtggcacacaggatttgatgacaatttatataggatatgagaaaatgaagggagtccaaggtgactacgatttttggcctgagcattttgaagaatggtgttgtcatttactgaactgggaaagatggaggagcaggttggggatgggaagagataaattccattttgggccaggcagggtggctcacacctgtaatcccagtactttgggaggccaaggcaggcagatcgcttgagctcaggagttcaaaaccagcctgggtaacatggtaaaaccccatctctacaaaaattagccaggtatggtggcagatgcccatagtctcagctgcttgggaggatcacttgagccctggaggtggaggttgcagtgagccaaaatggcaccactgcactccagcctgggtgacagaatgagaccccgtctcaaaaagacaaacaaaaattctgttttggagcttaaatttgagatgcctgttagaatgccacatgaaaatattaagaagagagttagatatgtaggagtctggaatttagaaatgtccagactggagatgtaaatttgggagagagcatgtagagagtatttgaagccatgaaataatctacatataaagtgtagacagatgtttgagaaaggtatcttaggcactgaaacaggaggaaaccaggaaaagaatcccagttgaactgggtggggaggatggctcaaggaagaacaaccatgtcaattgctgggttctaactggccactgcttatgatagtggagtagtaaggataaaagcctgattggaatggatttagaatagtgggaacggaattggagagagggagaatagataatttgggtatggagttggttgtaaggatagcgggtagaaaagtgataactgcaaggggtcaagacagtggttttaaaattacttcacaaattttttagtatttctaaaagaattctttttttaataaatataacttcagaccgctattgttcctttgtatcaactaccctgttattcaaattaacccaactgtcttataaaattttttgctaccagctttattgagatataattcatataccatactattcactcatttaaagtatacaattcaacaactttagtgcattcaaagagttgtgcagggtgggcgcggcagcacatgcctgtaattccagcacattgggaagccaagacgaggatcatttgagccaaggagttcgagctcagcctgggcaacatgcaaaaccacttctctacaaaaattagctaggcgtggtggtgtgcgcatgtagtcccagctacctgggaggctgaggtgggaggattacttgagcccaggaggcagacattgcagtgagcgccactgcactccagcctgggcaacaaagtgagaccctgtctcaaaaaaaaaaacaaaagttgtgcaaccaccattacaatttgttttaggacattttcagcaccccaaaaagaaacattactatgcacttagggtgataatgatgtgtcagtgtaggttcatcaattgtaaccactccggtgagggatgttgataatggggtgactgattttgatttgctgtgtgtgtgtgtgtgtgtgtgtgtgtgtgtgtgtgtgagagagagagagacagggtctcactctgtcacccaggctagcatgcagtagcacaattacagctcaccacagcttcaacctcccatcgcagcctcctgagtagctgggacaacaaacgcgcaccaccatgcctagctaatttttgtgttttctgtagagacaggctttcaccatgttgcccagactcgtctcgaagtcagctcaagtgaacccctgccctggcctcccagagtgctgagattacaggcctgagccaccatgcctggccaatttgctttttttttttttttttttttgagacaggtctcgctctgttgcccaggctggtgtgtgtgcaggctggcacaatattggctcactgcagcctccacctcctgggctcaagcgatcctcccacctcagccttctaagtagctaggactacagacatgtgccaccatgcctagctaatttttttaatttttttgtagagacgggatttagccatgtcactcaggctggtctcaaactactgggctcaagtgatcctctcaccttggcctcccaaagtgttgggattacaggtgtgagccactgcacccagtagatcatgtgttttttattctttgttaatatgggccattacattgcttttatgaattcccagagcaaatctcacttgattatgatgtataatcctttttatatgtcactgaaattgatttgatagtattttgttgaagacttttgcatctttgttaataagagctattgaggcagggcatggtgatgaatgcctgtaatcccaacactttggaaggccaagacgggaggattgcttgagctcaggagttgaagacaagcccaggcaacacattgaaaccctgtctctacaaaaaatacagacattagctgggcatgatgatatatgcctgtagttccagctacttgggaggctgaggcggaagggtcacttgagccctggaggtcaaggctgcagtgtgccaaaattgcaccactgcattccagcctgggcaacagaatgagaccctgtctcaaaaaataaataagtaaataagagatatttgtctctaattttcttgtgatgtctgattttggtatcaagataatactggccatataaaatgagttgggaaatgttccctcctcatctattttttcaagaatttgtgaagttttgcattcattattattacttttcttttttgagacagagtctcactctgtcacccaggctagagtgcagtggcaccatcttggctcactgcaaccacctctgagttcaagcgattctcgtgcctcagcctgccgggtagctgggactataggtgtgcgccaccaggcccagctaatttttgtattttatgtatttatttatttatttattgagatggagtcccactctattgctcaggctcctaggctggagtgcaatggcgtgatcttggctcactgcaaccttcacctcccaggttcaagcaattctcctgcctcagcctcctgagtagctgggattacaggtgcgtgtcgccacgcctggctaatttttgtatttttagtagagacggggtttcaccgtgttggacaggctggtctcgaactcctgacctcgtgatccacctaccttggcctccccaaagtgctgggattacagatgtgagctaccatgcctagctattttttttttattttaagtggaaacagggtttcgttatgttggccaggctggtctcaaactcctggcctcaagtgatccacccacctcggcctcccaaagtgctgggattacaggtgtgagccaccatgcccagcctgcgttctgtgtttgtttgtttgtttgtttgtttttgagacagactcttgctctgtcacccaggctggagtgcagtgttgcgatcttggctcactgcagcctctgcctcctgggttcaagtgattctcctgcctcagcctcctgagtagctgggattacaggcacctgccaccaagcccagctaatttttgttttttgtatttttagtagagacagggtttcaccatgttgggcagggaatggtctcgagctcctgacctcataatccacctgcctcagcctcccaaagtgctgggattataggcgtgagccaccacacctggccatcgttgattattttttaaatgtttggtagaatttaccagtgaagccatttgggcctaggcttttttttgtgggtagtttttctttctttctttcttcttattaattcaatctctttattataagtctattcagactttctattccttctcaagtcagtttcagtagtttatgtcattctaggaatttgtccattttatgtaagttatctattttgttggcatttagctattcatagtattcttttttgattctctttatttctgtaaggtcagtattaatgtacctgtctcataatactgtttttttccagtgtgttcaaatcaggccaaataattctgatacacaatattcgatttatttgtctctgtggtctcttgtaatatatagatttccttccatctcattttttcttgatatatatttattgaagaaatgaaattacttgtatatttctcacattctatatttttctgattgtattcttggaagtcattaacatgttcttctatcccctagctagttgataggtagttctttattatgatttaggtttgatttttttatggcaaactatttcttttttttccaccagttgtcaaatgatcctttactgaaatattttcctttgtgcttcttaactagctgggcattccacagcaccactgttgatgtcatctatgatttcatgagggtggtggctgtcaacattacaacccaaagactgggcagtccccaggatctctttaatgtttccagagagttctctggatctctccagattggtgccacatctgttgagcaatgttgatgatctcatcaaaagtgatattcccactgtgtttaatgtttttctgtttatttctgtcttgatggttcctcgagggctttgatgatcagggcagaggcagaaggcaccacctcaatctgggcctgtctgttctgaatggtcagttttcactgtaatcctcaggcccttccagtcacccgttgtcttggcaatgtcgtcaccaaccttttttggagacagacccagggggccaatctgggggccagcgcagacgtggcaccaacttcacccccagtgcacctcaggtatacgactttgatctctttggggttgaactttggcagcatggtggaggcggctggtgtcagatgaacccggattcgggactaccaaagaaagttgcaccttggcctcctccgagctcagatccgaaagcagcaaaactatttatacatcgattatcaggcacatagtttccaattttatctcttttcgtgaagttggcagtcattgatgaccactgcctaggttcattattacaattgaaatagttcaatagaaggcagagtatgggcatcaatcagtccagactataagaacttttgggaggtgacttttgatgattatgagtactacattctatactattcttagaaccttggcatcagggctgggcgcagtggctcaggcctgtaatcccagcactttgggaggcccaggcaggcggatcacctgaggtcaggagtttgagaccagcattaccaatatggtgaaatcctgtctctactaaaaatacaaaaattagacaggcatggtggcttgtgcctgtagtcccagctactcaggaggctgagacaggagaattgcgtggatccgggaggtggaggtatcgtgccactgcacaccagcctgggcaacagagcgagactccatctcaaaaataaataaataaataacctcggagtcaggagatgggatctactcccaactctgccaccaactagctgagcatcctctttggcacctgttttcttatctgtagaatgggggaataaactaatacaatgtctaggacttttggctattctaacattctctgactaaacaagtagaggacttaatctttcccaaagatgatttgggtgagttaaaaaggaactgctgaccttgtgttattattcccatttcataccaaaaatgtttatttcaaagccaacatttatcagtcattaaatccagtaaagtatataacagagtccattaaaagtattatgaggcaaggtatggtggctcacttctgtaaccccagcactttgggagaccgaggcgggcagattgcttgagtccaggagttcacgaccagcctggcccacatggcaagaccccatctctacaaaaaatacaaaatttagccgggcacaatggtgcatgcctgtagtcccagctacttggtggggctgagctgggaggatcgcttgagcccaggaggtcaaggctgcagtgagccatgagtgtgccactccactctagcctggatgacatagtgagaccctgtctcaaaacaaacaaacaaaaaaagtgaaaagtatcaggagagcaggaagccaaggccaaaagcgttgttttctggattctagttctggctctgcagctaatcaacatgcactctcagtgtcctgtccatagggtaaaagattgcatgagtagctctaaaggcctgtaagctttatgattttatgcctattcttgatttttctcacagttttgaggatgctatttttgttaatatctttttttttatacttttaagttttaggatacatgtgcacaatgtgcaggtttgttacatatgtatacatgtgccatgttggtgtgctgcacccattaactcgttatttaacattaggtatatctcctaatgctatccctcccccctcccccaccctatttttgttaatatctttagcgctacttgtttttatctgcattctgattatgctttactcagcaactaactggcataggcctgccccaggtgtcagttcgtatagcaaattcagcttgagcataaagaactttctggaagcaaagacaccaaaatattagcaatttattatttctaggtggtaagattattggcgtgcaccaccacgcccaactaaggcatatttttataatattttaaaagttattcttaaggcatttgatagcatatttttgattgcatgccccagcaaagaggaatcactaaactttaggtcagtagatttctttctcttcctataattcagtttggcagcatcttccattctaagttaacctaaatactttagtaataaagacttacatgtatctaattagatagtcagctttacttaatcttcttaatcatctagattagatgttaagtgaaaaaatattttgtgcctacagaaattaagattcggaaagaacagtagcacatacatgctatcaacatctgtgtcataactcatatggaatctggatttgcgctacttggggaacaggtagtgtctgctagagaagtggtgtgacagaaacatgggcaaaggcagggtgtgtcttttgtaaatgatgaaaacagaagattaaaaacaagtttgctaaatcatgttcataaccactccctggagagcaattactctgattactcgacttacctggtaagtaccacccactgtaggagaaaatacagatgtttggttcactgttatgggtttccccatgtgcaaaggtgttatgctgctgctatgctcgtctttaaacactgtagtagcagttactgaagaatggtagagtaaggggtgccctcacagctgtcaactcactgtgtgatccagacgagtaacgtagcctggtcgcaagctccaaggttacttatctttagtggaggggatagttctagtttccagtgttatcacgactagtaaaattgatattataaaatccacttctcagtaaggaaggcagtttgaaagcgttcttgttgtgagaagcatgacaaatacaggcagttctatggacagtgtttatgtaaaacaaattattgaatagccatttgaacattaactgttgcccagtgtgttataatgtgtacctgctcaggcattttgaagactcttcttacacctagtgaggaccaagggcaaatagcaaaaagtaacctgacatagagttttagtttggagattttcttttgaattgccctcagggagatttctcaagcaacactggtccatgccaatttgcaaatggactcttgtgccagtggctcaatcaacccatccaaatgcagagaaccatttggaggcattcaaaaccaaatgaggggcaattttctttcatttatatgctgtctgttaacctctctttcaccaaaaattaacctgattctgggtatgcatacctgaaaaaacacaatttttacactcaaggaagtttcattttttcataggaaaaaatcaactattactaaactatacagttactacagtgatggagatgtgtgcaggctgctgtaggaacataaaagggagcgcctaacaggtgtgggtgagtcaaagagagctggggaggaatgaaggcaacattcttgagctaaaccaaataaacaaaacattgcaactcacaattatgacctatttcaaactcttagaactacagtaatgatttagactagttctcatttggacagggtttatttactcttacggtttcaagcaccccttaatctttccattttaacaagggtatatggagcttcacagataatatctccaaaaatgggcatattttgacttgtagaccatcacctgcacacacacttcaaggtcactttcatacagcaaagtgaggaaagagtttattagctagatgagaatgtgtaaatgaggccgggtgtggtggctcacgcctgtaatcccagcacttcgggaggctgagatgggtggatctcctttggtcaggagttagagaccagccgggccaacatggtgaaaccctgtctctactaaaaatacaaaaattagctggcatggtggcgggcgcctgtagtcccagctactcaggaggctgaggcaggacaatcccttgaacccaggaggtggaggttgcagtgagccaagatcacgccactgcacttcagactggtgacagagcaagactgtctcaaaaaaacaatgtgtaaatgaaactgccctactatttctgctttagtaaaaacaacagattctggtcagtatttgttcacttatattgggcataagataattcctgctgtttgttgcagatcttggcatactgcctgattgtcctgcatgggaatcttggactgctactacagcaatttcatgactgtgtttcttctatttttgtttttaccacgttagttatatcatgcagtacttgaaacgaaggtggagtctgtcactctgtcagcctgcagtttaaaaagttagatgatgcattaaaaaatcaacaaattttgccaggaaggcagtgtgtgcctgtggtcctaacttctcggaagactgagtcaggaggattgcttgagcctagcagtttgaatccagtctgggcaacatagtgagaccctttgtcttaaaaaaaatcaacacattttaaaagtatttcaagatttgtatttgccatatttccaagctagtattatttatttagagtttcctattgcgggtgaaattctcttgtcttttgctgtttgcagtaacttgagtcttttttcatctcttcagataatctacttatattcatgccaagttttctagttttcctattgcttcctctaattttcaaatagagtatatacaatattgagcatagtttctcattagtctgttcacagtcactaaactaatcctcaaatgtatttgattctatcactttccaaaatttgcctttgctggttcataatatagttacctaacttccccagctctgccctcgctcatgaactgtatttctctacattacccccacactgcattggcattctgagtcatcggggattaggtatccttcctgctattaactacataatatttaaacttccccacttgcccatctcctttatttcgtattcaaacaccacatgaattaaactaacgttggttgcttttaacctgtaattcctgactgcaacaggtagttagttgccacctcttgaaatgaacagatttgactagaagctgacacttcttactcccgctgaacttagtattttacatttatataaattcaaaaagcaaaatcatacctttcttatcaatgggccctctttgtccattgataacataatattgcaatataaacaaaaagtatttgtaccatacctcagaaaacaaattagattactattagtgcaaaacaggggaaaagtagaaaaatgttattgtaaagagactatcacccacttcaagggatttatcaggtaactgcctgtgtaagttacaaagacaatgctaatctataactagtgtatacctagatgagccgccaggacatttgtctaatggcagatggggtaattggactccacatcttcaacttaggcacatggaaaacagcatccctaaaagttgcctggggatgaccagtactgagccaaccagcttagtggaactgttacgagagagaaacttcagagccaaggaatttcttggcagagcctcacattctgccttagaatcatgaaaagttagatctagaaggtaacagagatcatttaatccactgcccttattttacggtgaaaaactgaaggccagagaagttaaggagtttgcctaaggtctcacactcgtagttagtgacagattcagagctagaactagatcatcctgactgcatttcagtagtcttagagctggccgacaaatctgacaactcacattgaacccatgttccaaaaggtattttatattgagcttatgaacaccgctttttaaatttatgttatttatttatttatttatttattatattttaagatctgggatacatgtgcagaacatgcaggtttgttacataggtatacatgtgccatggtggcttgctgcacccatcaatctgccatcctgttttaagccccacattcattaggtatttgtcctaatgctctccctcctgttgccccccatcccttgacaggcccccgtgtgtgatgttcccctctctgcgtccatgtgttctcattgttcacctcccacttttgagtgagaacatgcggtgtttggttttctgtatgaacacccctttcacagaaaattaggcaaacaggttggaatatttagaatagaaaacatttattataaagtcacaagaaatacctgtgtagacttgctgactggaagtatttggcttccgtaagacaaagaagagtcttagtcatctggttaaagttaaaaacgattgtgtcaccaggctgaaagcagacatgctgtggaagcagtaggctgaaattagaactgaatacaagagtttagagaaaattgaatttggagctatctcacaacactgggagttattctgtttttgtttgcttttaataggcacacaaaaaagaatagtgactacaatgaactccttgtgtagccccaccagaccccattttcttccctccccactgaatttggtgcttatatttccatacctattcatgtggttttcctataggtaaatgtatccctaagtgatgtttagcattattttcatattttaagctacataaatgctatcatattgtatatatgtgtctacaacttgcatttttttttttgcttaatactacatttttgagatttatcctattgataaataggatttctctaactaatttattttattttttggagatgaggtcccgctatgttacccaggctggaatgcagtggcagttcacaggcacaatcatagcacaatgtggccttgaactcctggacacaagtgacctcttgcctcaggctcctgagtagctggggactacaggccccagccactgcaccaggccagctaattcattttaactgctttatggtgttccattgtatgaatgtttcaacatttagctaatctcctattgattgacatctagtgagtttccagttttttgatttgctttgtttcatttgctgttttattttaatgttgctactgtaaacatgtttataaaactggtgcatgtgtgaaagagtttgtctagtaacatttacaaggtctcagtgtgtgtgtgcaaatcttgaatttagcaagaagatctcaaaatagcaggttatgagactaacacaaggactgtgtatttttagagttttaattttttgtgaatctgaagagtgtaaaatactgttgccttctggttttaatttctctgattccttgtggggctgagtacctttccatgtgttcacagacaatttggatctcctcttctccctagctcacttttcagatgagctgctgaactttttattgttcattctgaaaaatgttctatagtcattatgtaaatccttattatatgcattgccaatatcttctcctaatctggagcttgacttttcacttttataatgatatattttcatgaacatatttatcaatcttttattttttatttatacttattatttctttaaaacatcattttttcactctaaggtcataagatattccccaatatttttctttagtttttttaaagttttatttttttacaatcttcaagtcttttatgtgccaggaattaacttgtgtgtagtgtgaggtcaggagctagttttatttttttctacatcgacaagcaattgtttagaaaccattaattgaatattacatttcttccccacagttgggtaatggcactttcatcatatatcctggactctctatcagtcaggttattattcctgtgccttattataccatattaactactatatctttatggtaagtctcaatatctggaaagcccctatttgtcaagtggatgcaatgggagctagatggatttgcactatccttcttgaataccatccaagaggtatgaatactgtggggaaggaaacccagaaggatgttatcttagcccttttgtgttgctataaaggaatacttgaggctgtgtaatttataaagaaaagaggattatttggctcacagttctgcaggccttataagaagcatgatccagcctgaccaacatggtgaaaccctgtctctactaaaaatacaaaaattagccgggcatggtggtgcgcctgtagtcccagctactcaggaggctgtggcaagagaactgcttgaacctgggaggtggaatttgctgaaccaaaatcatgccactgcactccagcctgggtgacagaatctcagggaaaaaaaaaaaaaaaagcatgatgccagcatctgcttctggcaagggcttctggctgtttccaccagtggcagaagggtaaggggaactggcagattcagagatcatatggtgagaggggtggcaagaagtgggaggaggttccaggctgtttttagtgaccagctttcctgggaactaatagagtgagaactcagtaccacaaggacagcaccaagccattcatgaggcacctgccccatgactgagcaaaacaccttccattaggccccacctctaacatgggggaccacattttaacatgaggtttagggggacatgaaaactatatcggagactatggggtcagtcattgttgcagtagctgagtggggaaatgggaatcctggaactggagatcagtgtcccacatcaaggaactgtgctctgtggagacctgtgggccctctaagaactcacatgtgtgtctcctgagagacatccaggccttggatacctgaccacaaagggcctcttgtggtccttcagtgttattaagtagaacaacagcaaccagcagaggactccagttgcttccagtgaagtaaaaagtcactttctctgaaagtggagttaagaacacaattctccttacaatggctggacgtgctggctcatgcttgtaatcctagcactttgggaaactgagatgggcagataacttgcggccaggagttcgagaccagcctggccaacatggtgaaaccttgtctctactaaaatacaaaaattagcagggtgtggtggcacatgcctgtggtcccagctacttgggggactgaggcatgagaatcccttgaacctggcaggtggaggttgcagtgagctgagatcacaccacacacttcagcctgggcaacagagcgagactccatgacagaaagagagagagagagagaaagaaagaaagaaaattcttcttacaataacagcaaaaagaataaaacaggaatagatttagcaaaagaagtacaagacttgtacactgaaaactgttgaaagaagttaaagaagaccaaacaaaatcccagccagcttctttgtacaaattgacaaactaatcctacaattaatatggaaatgcaagagaccaagaaaagccaaactattttggaaaaaaaaaataacaaagttcctggaggactcacactttctaatttcaaagctacaataatcaaaacttactacaaacccaaaataatcaaaacggcatggtattggcctacatatagacatattgaccaatggaatagaattaagagtttataaataaacccatacatctgtgttgaattgattttcaaccagggtgccaattcggtgagaaacaaacatcctttcaacaaatggctctaggacaactggatagctacatgcaaaagaatgaagttagaccccttgcctcacaccatatgtagaaatctacatgaaactaaaactgctttaaaaaatagtctatttatttagaaacagggtcttgctctgtcacccaggctggagtactctgacacaacaatagctcactgcagcttcaaactcctgggctcaagtgatgctcctgcctcagcctcctgatagctaggattacagacatatgccaccatgcccagctattatttaattttttgtacagaccaagactgggtcttgccatgttgcccaggctggtctcaaactgctgggctcaagtgatcctcccacctcggcctcacagcacactgctgcaaattccatgagatgggtgaaaaactatgagttcccaacatgtgagaagggggaaacctgcctctgaacacacatctccactggggaacctcaaaacccagattatggaagaaggatttaaccttgcctagagctgaaatggatttagtataaaatataaaagtagaaatagtagcaggaagagccttgtaggcgctcccattctccagcttgggccagggaagccatccctgactgtatctcaccgaggccattgaggaagacagttggcagaatttgggcagggtcgcagggtgaaataagcttccaactgaactgtgtaataattttgactgggcgcaaactctgtcgagcagaaatcgggggtgaaagtgaactgctgcagaaaggagcataggagccacagctgacagtgtgggcagacagggaggggcaaggcctgaaagccatgcttgctttcttagtggggaaacttataccctggggctaggtctgagtcctgcacaccagctgcctggagataaactgtgctgttagcggggcacagtgggagtgaaactggccttgccaactgtgtggtagctgggtgagccctgtggctacttactttcccccacttccctggtgacagaggcgccataatccacactggaacataaccccatttgcctgagaatcagccccctatcccccacagtggctgtggcaaaaagagtctgagctcagacctgcctaatcctgccccaacctgatggtatttccctacccatcccagtgcccagtcacaaaagacaaactcttgggagctttatggccctacttatcacatgagaaacctgaacacttatcctgaccaacttagggcaagcttatatcccccttctactatcacagctggtgctctcctgaacataccacctcctggctggaggccaaccaactcaagatatgacagcaactcatgacaaaataacactgctccaaggaaggaaaaaacagctaactccactatctgcaacatcctggctaaacagaggtcctgtccatgtggcaacatcactgctatcataaccagcatttgagaaagccagcacactaaacatctacaaccaaggcttctcatagagtctatgtcactaccctgccacctcccccagaggaggtgctggtatccatagctgggagacctgaagatggattacatcacaacactctttgcagacactccccagcatgatcctggagcttggaagccccactggatgcctagacccagaaaagcaataacaatcaccacagtctggctctcagaaagccccatccctaaggaaagggggagtgcaccacatcacgggatcaccctgtgagacaaaagaatctgaacagcagcccttgagttccagatttttccactaaaatagtctacccaataagaagaaatcaaaaacataattcaggtaatatgacaaaacaaggttctataacacccacaaaagaccacactagcttcctagcaatggatccaaacccagaaggaatctctgaattgccacataaagaagtcagaaggttgattattaagctactgaaggagatactagagaaaggtgaaaaccaacttaaagaaatgtaaaaatcaagccaggtgcggtggctcacgcttgtaatccgagcacttcgggaagccaaggcaggtcacttgaggccaggagtttgagaccagcctggccaacatggcaaaaccctgtctgtactaaaacaaaaacaaaaattagcctggcttggtggtacatccctttggtcccagctactcaggatgctgaggtggaaggatcacttgaacataggaggtagaggttgcagtgagccaagatcatgcaactgcccaccaacctgggtgacaagcaagaccctctctcaaaacaaaacaaaaagttaaaaaaaaatacaggacatggatgaaaaattccccagaggtatagatatcataaagaaaaaacaattgggccgggcgtggtggctcatgcctgtaatcccagcattttgggaggccaaggcgggcagatcacctgaggtcaggagttcgtgaccagcctgaccaaaatggagaaatgctgtctctactaaaaatacaaaattagctgggcgtggtggtgcatgcctgtaatcccagctacttgggaggctgaggcaggagaatcgcttgaacccaggaggcagaggttgtggtgagccaagatcatgccattgcactccagcctgggcaacaaaagtgaaactcttgtctcaaaaaaaagaaaaaaagaaacaatcacaacttctggaaatgaaagacacacttagagacatacaaaatgcactggaaagtgtcaacaatagactagaacaagtagaagaaaaaacttcagagcttgacaaggcttttgaattaacccaatcagacaaagacaaagaaaaaggaattttacaaaatgaagaaagccaccaagaaattggggattatgttaaatagacaaaactaaaaataattggtattcctgaggaagaagagaaatctaaaagtttggaaaacttatttgagggaataatcaaggaaaacttctctggccttgctagagatctaaacatccaaatagaagaagctcaaagaacacctgggaaaatcattgcaaaaagatcacctaggcacacagtcatcaggttatctaaagccaaaacaaaggaaagaatcttgagagctgcaaggcaaaagcctcagacaacctataaaggaaaacctatcagattaacagcagatttctcagcagaaactctacaagccagaagtgattgaggtcctatctttagcatcttcagacaaaataattgctagacaagaattctgtatccagcaaaactaaccttcatatatgaaaaagagagaaattatttttcagacaaacaaatgctgagagaatttgtcactactaagccagcactacaagaaatgctaaaaggatttctaaatcttgaaacaaaacttcaaaatataccaaaatagaaactccttaaagcatacatttcacagggcctataaaacaatgaaaaacaaacaaggtattcaggcaacaactagcatgaagaataaaatagtacctcacatctcaataataaaatgaatataaatggcctaaatgctcctcttaaaagatgcagaatgggctgggtgtggtggctcacacctgtaatcccagcactttgggaggctaaggcaggcagatcacgaggtcaggagatcaagaccatcctggctaacacagtgaaaccccgtctctactaaaaatacaaaaaaataggccaggcatggcagcaggcacctgtagtcccagctaaccaggaggctgaggaaggagaatggtgtgaacccaggaggcggagcttgcagtgagccgagatcgtgcctctgcactccagcctgggcgacagagcgagactccgtctcaaaaaaaaaaaaaaaaaaaaaaaattgcagaatggcagaatggataaaaatctaccaaccacatatcttctgtcttcaagagactggcctaatgcataaggattcacataaacttaatgtaaaggagtgggaaaagatattccttgcaaatggaaaccaaaagtgaggaagagtagctattcttatatcagacaaaacagactttaaagcaacaagttaaaaaagacaaagagggacattatataataataaaaggatcatttcaacaagaaaatatcacaatcctaaatatatatgcacctaacactggaggtcccaaatttataaaacaattattactagacctaagaaatgagatagatggcaacacaataatagtcagggacagccgggtgcaatggctcacaactgtaatcccagcactttgggaggccaaagcaggtggatcacctgaggtcaggagtttgagaccagcctgaccaacatggcaaaaccctgtctctactaaaaatacaaaaagtagctgggtgtggtagcacatgcctgtattcccagctactcaggaggctgaggtaggagaatcgcttgaacccaggaggcagaggttgcagtgagctgagattgtgccactgccctccaacatgggagacagagcgagactccatttcaaaaaaataaaagaatagtagttggggacttcaatactccagtgacagcactagacaagtcatcaagccaaaaagtaaacaaagaaacaatggagctggacatggtggctcacacctgtaatctcagcactttgggaagccaaagtgggcagatcacctgaggtcaggagtttgagaccagcctagccaacgtggtgaaaccccgtccctactaaaaatacaaaaatttgctgggtgtggtggcacatacctgtaatcccagctaatcaggaggctgaggcaggaaaatcgcttggaccccagaggtggaggttgcagtgagccaagatcatgccactgcactccagcctgggtgacagagtgagactctgtgtcacaaaaggaaggagggaaggaaggaaggaaggaaggaaggaaggaaggaaaagaatttaaactataccatagaacaaatggtctcaacagatatttacagaacttctacctaacaactacagagtatacattctttttagcaacacatggaacattctccaagataaaacatggtgggccacaaaacatgtctcagtaaatttaagaaaactgaagtaatatcaagtactctttcagaccatactggaaaaaaactggaaattaactccaaaaagaaccctcaaaactatacaaatacagggaaacttaataaactgctcatgaatgatctttgggtcagcaatgaaatcaagatggaaattaaagaattatttgaactgaatgataatagtgacagaacttatcaaaacatctggcatatagcaaaagtggttctaagaggaaagttcatagcattaaatgcctatatcaaaaagtctgaaaaagcacaaatagccaatctaaggtcacacgtcaagtaactagagaaataagagcaaaccaaacccaaacccagcagagggaaaaaaaattacaaggatcagagcagaactaaatgaaattgcaatacaaaaatgtataaaatataaatgaaacaaaaagctagttctttcaaaaaaaatgatagactgttagtgagataaaccaaaaaaagaagggagaagatccaaataacttcacttagaaatgaaacgggagatattactactgatagcacagaaataaaaaatgatttaagactactgtgaacacctttacacacacaaactagaaaacctagaggagatggataaatttctggatatatacaagcctcctagattaaatcaggaagaaatagcaactctgaatagaccaataacaagtagtgagattgaaacagtaatgaaaaaaaaaatgccaacagcaaaaaaaaggtccaggactagatggattcacagatgaattctatcaggcatttgaagaagaattggtactgatcgtaatgaaattattccaaaagataaactggaaatcctccttaaataattctatgaaagccgggtgcaatggctcatacctataatcccagcactttgggaggctgaagcaggcagatcacttgaggtcaggagttcaagaccagcctggccaacgtggtgaaaccccatctctactaaaaattcaaaaattagctgggcgtagtggcaggcacctgtaatcccagctactcatgaggctgaagcaggagaattgcttgaacctgggaggcagagattgcagtaagccaagattgcaccactgcactccagcttgggcaacacgagcaaaacttcgtcaaaaaaaaaaaaaaaaaaaactctatgaagccagtatcactctaatacccaaaccaggaaaagacataacaacaacaacaaaaatgcagaccaatatccctgatgaacatagatgggaaaatcctcaacaaaatactggctaaccaaaaccaacagcatatcgaaaagatagcacatcatgataaagtgggttttatactagggatgcagggatggtttaacatatgcaagtcaataaatgtgatacatcacataaacagaattaaaagcaaaaatcatatgatcatctcaatagatgctgaaaaagcatttgacaaaatccagcatccctttatgattaaaaccctaagcaaaatcagcatagaagggacatacctcaaggtaataaccatctatgacaaaccctcaggcaacattatactgaacagggaaaggttgaaagcattccccctgagaactggaacaagacaaggatgcccatttttatcactgctattcaatatagtactggaaatcctagccagagcaatcagacaagagaaagaaataaagggcatccaaattggtaaagaggaagtcaaaccattgctgtttgccgatgatatgattgtatatctagaaaaccctaaagattcatccaaaaagctcctaaacctgataaatgaattcagtaaagtttcaggatataaaatcaatgtacacaaataagtagcactgctatacaccagcagtgaccaacctgagaatcaaatcaagaactcaacccttttaacaacagctgtaaaaaataatataaaatacgtagaaatatacctaaccaagaatgtgaaagatctctacaaggaaaactacaaaatactgctgaaataagtcatagatgacacaaacaaatgggaacacatctcatgctcatggatgggtagaatcaatattgtgaaaatgaccatacagtcaaaagcaatctacaaattcagtgcaattcctgtcaaaataccatcattatttttcacagaactataaaaataaaatcctaaaattaatatggaaccaaaaaagagcccacatagccaaagcgagactaagtgagaagaacaaatctggaggcatcacattacctgacttcaaactatactacaaggctatagttaccaaaacagcatggtactggtataaaaataggcgtgtacatcaatgcaacagaatagagtacccagaaataaagccaaatatttaaagccaactgatcttcgacaaagcaaacaaaaacataaagtggagaaggacaccctgttcaacaaaggctgcaccctaaccacaaatggtcaaatggtgctgggattgttggcaagtcacatgtagaagaatgaaacttaatcctcatgtctcaccctatacaaaaatcaactcaaaatggatcaaagacttgaatctaagacctgaaaccataaaaattctagaatataatattggaaaaactcttctagacattggctaaggtagagttaatgactaagaacccaaaagcaaatacaacaaaaacaaaaataaatagatgagaccgaattaaactaaaaagcttccgcagagagaaaaaaaaatcagcagacttggctgggcatggtggctcacgcctataatctcagcactttgggaggccaaggtgggtggatcacctaaggttaggagttcgagaccagcctggccaacatggcgaaaccccatctctactaaaaatacaaaaattatctgagcatggtggtgcatgcctgtaatcccagctacttgagacgctgaggcaggagaatcacttgaacctgggagacagaggttgcagttagccgagatcgcatcactgcactccagcctgggcgacagagcgagaccctgtctcaaaaataaaataaaataaaataaaataaggccaggcatggtggctcatgcctgtaatcccagcactttgggaggccaaggtgggtggatcacaaggtcaggagattgagaccatcctggctaacatggtgaaaccccatctctactaaaaaatacaaaaaattagccgggtgtggtggcaggcgcctgtagtcccagctactcgggaggctgaggcaggagaatggcatgaaccctggaggcagagcttgcagtgagctgagatcacgccactgcactccagcctgagcgagagtgcaagactctgtctcaaaaaaaataaacataaaaataaaataaaataaaaataatcagcagagtaaacagagaacccccagagtgggagaaaattttcacagactattcatccaacaaaggactaatacccagaatctaccaggaactcaaacaaatcagcaaaaaaaaaaaatcccatcaaaaagtgggctaaggacatgaatacacaattctcaaaagaagatatacaaatgtccaacaaacatgaaaaaaatgctcaacatcactaattatcagggaaatgcaaatcaaaaccacaatgcaataccaccttactcctgcaagaatggccataatttaaatatcaaaatataatagatgttgatgtggatgtggtgaaaaaggaacactttcacactgctggtgggaatgtagtacaaacactatggaaaacagtatggagaatcctttgagaactaaaagtagaattaccatttgatgcagcagtcccactaatgggtatctacccaaaggaaaagaagtcattgtatgaaacagacttacacacatatgtgcatagcaatacaatttgcaattgcaaaaataaggaaccagcctaaccctgatttccagtggaaatcctaggaagttatgatgttagttctgggcttgtaaaagaaaaacaacagcaaacaaacaaacaaaaaagaaaaaccttggaagcaagtaatttgagatggtttatgtcagtttttgtgatgaaaactattttctaatgtttagaaagatgtttccacaattttttgtttcttaacagaactaaatatttagcttttctgtatcatatagatgactcagacattttatgattagctattacccaggttgacataacatgactctaagttattgaaaaagattttttaaacaatgtaaagctcatttataaacttttatttattctcttttgcaagtaaaccttatggtaaataataaaaaacataaaaaagtaaataaagttttatttattcttaggaagtatgcttgagtagctcattaaacaaagttagctactgaaactgtctttgcagggctgagcagtggctcacgcctgtaatcccagctctttaggaggcccaggcaggtgcattacctgaggtcaggagttagagaccagcctggccaacatggtaaaactctttctctactaaaaatataaaaaattagccaggtgtggtggtgggtgcctgtaatcccagctacttgggaggctgaggcaggagaaccacttgaacccaggaggtggaggttgcagtgagctgagatcacatcattgcactccagcctgggcaacaagagcaagactccatctcaaaaaaaaaaaaaaaagaaaagaaaagaaaaaaagaaactgccttcgcaaaattataactgagacagtgaaagaaatctaacttaactgaccatcttgcctctagcatataagctgtctttgttcattccatcttgcctagggactagattgtctttgtaggactaacatttgacacaagattagaaattatgatttaggagtcatgcagctggaggctaaaagattatgaccctccctaaatttctctcaagatcagtgcttgagatattttgcagaccctgcacttgatggatcagctggctccacccagattgataaactggctcatctgatcttgtagcccctgcccatgaactgactcactgcaagaagacagcttcaactccctatgatttcatctctgacctgaccaatcagcactcctggctcactgggttctccccacccactaggttgtccttaaaaattctgctcccaaaatgctcggggagactgatttgagtaataaaactctggtttctgcacagctggctctgtgtgaattactccttctctattgcaattcccctgtcttgagaaatcagctctgtctaggcagtgggcaaggtgaacccattgggtgcttacaccatcatcttcagttttttctttgtaatcatgtttacattccacaaatgttaggaacttaacactttagccagaactctaaagttaaatacacgggtattttgttaatcagaggacacggttgttttcagtaaatcaacagtattaaactagtcttatttaccaacaatttacacaaatcatttgaactaaaaggcatttgagttagcttatatttttctcataaaatatataatttaagtgcttactttttctttaacccaattaattagagttttcgtgtattttggtaatgaaatatcacatccacatggcatatatgaacatatatacatacagacatacaaacaaaagcagagtctgtagcttgataaacttcttcatttgtcagggggtttttttgttttggttttggttttggttttctttttctttttttttttttttgagatggagtcttgctctgttgcccaggctagagtgcagtggtgtgatctaagctcactgcaacacccacttcctgggttcaagcgattctcctgcctcagcctcccgagtagctgggattacaggcgcctgccactgtgcctggctaatttttgtatttttagtagagatggggttttgccatgttggccagggtggtctcaaactcctaacctcatgatccgcccaccttggcctcccaaagtgctgggattacaggcgtgagccaccgcacccagaaaccatttgccagtttttaaatagtttctctcccctctttagactatggagccctaaacaactgttagcaacataacccttaatttgcacttccaaagacatgactcttaagtgaaaatttacatcccaaaggcacagcacttagatctaagcaccattctctgctgagatgaagaaggatatgggtaaagattcagtcgaagtgagattgccaggaaaagtatcttaaacaaaggcagggattgttatgtaaactttaaaccaatgtcttccccatcttaagagttttgtgggttttttgtttgtttttttttagacaaggtgtcattctgttacctggactggggtgcaatggtgcaattttggctcgctgcagtctccacttccctaaggccacaagatttgaagttaggataatacatgttacactgttaacttttagcaaactttacttttgttgaaaaccatgtaagtttgggatttttaattatcctttgctattactaagacctctttagtccaaatcaacttggaattagtatagatggttccttcctggttctgtaagtactttaaggcttggctgagtgcagagctcacacgtttgagcagactgattattaggcaattttcctaactctatttctacgagagtttccctatcaattactgaatactcgttgtgtctttttccctcaatcagccaggagaaaccatccatcatcctgtcctgaagggagttcctcctaggtctggtcggacctttgtatggtagttaattaagatttagatcccctgttaggaaacctgcagggttaagggaattatcagtggttaatgttaaatcatatttttctaacagaatggcctcatatgttaatattcttaagtcagtaagctgcctttttgcttttttgacttaggatagttctgacctggtgaggtgtgctcacaatgaggtttcctctaaaagttatttttgtactttcttcagttagcaaagcagttgctgctacagattgaatgcatttgggccatccccgggttactgggttaaggatttttgataggaaggctactggttgtcagtggcctccgtgcttttgggatatgcccttgtttacactgacaacaagatggaatagctacttgagggtaaatctaggacaggggcagttactaatagatgttttaacctttccacctgttggatttctggtaattgccaaatgaggagggggttttgcccatcttgcgtgagctttttgtataagggttttgtttttagggcataagaggctatccatagatgacagtatctgacttatcttaaagttttctaagttcttgtttggtctccggcagaggcaaggatatgatactttcagtccattcaagctcaatttgccatttacctttgctaattaaatgacttgttctaatatttgactaaataaatttgaagacttcgtaaacccttgaggtaagactgtctatctgtattgctattttcaatcagagtgagggtcttctcactcaaaggcaaataggtcctggctgtcttccgtgaacggacaaacccagaaggcatcttttaaatctattaccataacaacagggtgggtagtttggacttgattaatagctctaaggtcttgcactaactggtgtgacccgtctggcttctttacaggcagtattggagttttatagggtcacggagaagactttcaattataggttttacatttaccctggcttttaaaggaatagggtacattgctttctctttactacttctagctctctctctctctctctctctctctctgactctctgtctctttctctctctgactctcttaagtttttttttttttatccttctaatattttaacattagtcctgggggattattgggggaatattattgttgctagctttatttcttttatcctgtaccttacttggggtatttcccatttttggggtgaggctcaatttcccttaccagaaatatctcaccttttggagggaggctcaatttcccttactggcaatgtctcaccttttggggtgaggctcaatttccctcactggaaatgtcttgccttttagggtgaggctcaatttcccctactggaaatgtctcaccttttggggtgaggctcaatttccctcactggaaatgtctcaccttttggggcgaggctcgatttcccttaccggaaatatcttgcctctttttaatccccaagataccccgaccaaggaatacttcactgccccctgtggtttttctttccttagtcccggctaaggaatgctttaccacccctacggcttctttttccttggtatgtcccaaccaaggaatgtttcactgcccctgcagtttttctttccttagtccctaccaccaaaggaatactttaccagctcctccgctgtttccttctttggcttgtgcgtgatgttgtctggtccacgtggtatgtaaggatcctttaccccaggtcaccggccagtttctttccacattgctgagagtctgggtttattcatcacaccaggtaggtctcggttcctcacccctgaggctgccgaaatgaggcggcggggcacctccttacaagagaggactggagaccgcccagaggagagtgggtccctgcatgggccaccaaactgttagaaatgcaaaatgcttgttccctggtgctgcaaagaaatagcactcaaacatacatttaattttctcagcaaggcaatttttactttctgcagaaagggtgctcctcacagatggaacaatggtgagatcataccaggacaggggaggggcaggagttcttattcctgacgctagtagcccctactgctgtgttgttgccctaatggctaggattggaccgcacagtctaagctaattctgattggctatgttaaaaagagcaggagtatgagctggagtggtgaggtgagtagtttggtgggaagggcagttaggaacaggtaactaaaggtgacttaggtcagagcaggtgaccaccaagggaacagctgtgaactactgatttggactggcgggaaagttgtttactgaaactagaggcaaggagttgaagagaactaggaagttaaactttaaaatgaagaatcaaagaataagagagctggacatactgacatactgattctttgaagagaaacttagggttcactatatttaacaggaggccgagacaggaggatcgcgtgagcccaggagtttgagaccagcatgggcaaaatagtaaaaccccatcttattaaaaaaaatttttttttttgaaatggggtctctctctgttgcctgggctggagtgcattggtgctatctccactccctcaacctctcagccaatcctcccacctcagcttcatgagtagctgggactacaggcgtgcaccaccctgcccagctaattttcgtatttttttgtagagacaggttttcatcatgttgcccagcctggtctcgaactcctgagctcaggcaatcctctcacctcggcctcccaaagtgctgggattacaggcatgagccaccacacccgaccttaaaaaaaattttttttaatatgtggaaagcagacacgagtagaagccagcacaactagctaacttcccctagtgatagaggcaggagacaggcaaatgccatctatgtcattatatatagggagcttgcctaaacatgcccacagtggaaaattccatcccttaacacatgcacagtaagagaaataaatcaatgcagagtggccatttcctttattgccttctgaacatttacctttctagtgtcctttctttttgcatctcgcacattaatctctagcctcatccggctcttgaatccttgcctaacttgacttctttcacatctacatccacatccatgtcctctcacggtgctaatttttctttttatgagagctgttgctaacagattggcttttttttcttaagtctttaatttacttttttttttttttttttttttttctgagttctcctgctcctacggccagctggcggggctgggcaacggcacgggccttgcccccgcgcactgctgtctgtctctcctgttttcttctgattctctttttcacacttactcttagtgtttctttttcctttgctctttcccagttttgttccttggtcacagttaacatacaccttggtggccacttttatagactaggtggtattcatgcctgcagcttctgcttgatgttaccctgggcttgctttacaaataaaatattcagtgcatactgattttcagcagcctcagggttaagtggggtataaagccagaatgctttatagagtctcttataaaactgacttaggctcttgtcagctccttgaaggatttctgaaatcttttttatattacttgcttttttctaccaacttttagactctgcagaagtgcttctcagtacctctgcaaatgctgaagctgaattgcattctctgggtctttttttcccttttttctagagtttaacaggctcttttctttatacaattttttatgcacttggagggttaaacaggcatacccagagtcagtgtaaatgtttacaagtcttaccttcactgagttctaaggcccgaattaaagcaatgagctcagcttaacaacagtgtccagggttaccaccgcatattctgcacctctctctccttgggggttgatgaagctgttcccgtccacgtatagctcccagtctattgatgcccaaggctggtcctggaggttaggtctgctagagtaaatttgagtccaacacctctacacagttatgctcgacagggctttagctgccgggagcaaggtggtgggttcagggtgtttccagtttagtagatcaatggttgaaaagggctgatagatgaaagtctgttgtcccccccaaccccccggatgtgggcctggtcattataatagacaggtcctcgtgtctccctgagaggcatttgcatagcctctcagatctgagatggcccacttgactatcttgatttccttccttggtctctcgaagctccgatcctccccttcaaggtaaaacctggagcgtgttagctcctgaatctcatttctgagggggttgttggcctcagtaaagcggggtaggctgggatatatggagaaagaatttctgttatctctggcggctcccgcaaaactggcttctcttgctgtttctgggactccctttttaactctgtctgccggcgaagctgctcttttacttttggcttttttgcaataagctgttcaacagggctaaatttatgctggttttgcctatattatatttaaccatgagtcaatataaaggaatttgatctaggtacactggctgccctctgacccctgtcaccaccttaaatacatggccaatagttccctgtctatagttccttcggtgggccatctaacaccaaaagagggcaattctaattcacacagagttcttaacctctagggggttaacttaactctataatctcccacagaacctttcctaaggttctgtaacatgcattttaatagagtaagttttgatgctttgatgactttccttttatttttctttttgaaattttttaacatagttcctagcggagtgggcttactttgtgtctgacctatttttctcttgaaacaaaaaaaattcacactacaagaaggaaagggtaaaaggtcactcactcgtctaattcacactaaatcaaaatcaaaactaaaaccaaagtgttgttaaaggcacacctgttcgtcaagcaatttatgccaagtcaaaatcagaaccaaaaccaaagtaccaataaaggcatgcctgtttatcaagcaattcaagtcaagtcaaaatcaaggttaaaaccaaagtatcaagcaattcaagtcaagtcaaaaacaaaaaccaaagtgccagtacagacacgctgtgggtgatcaggccacgcttccactcaaacggagtgggcaagttccaaagaccagtcttaccaagtttcagatgtccggactccaagtgcctgttccttcccggtgttcagccactgcgttgatcctccaccggggcctgccacgcgctgctctggcaaggcgttccactggggcaaatgcctacccgggagcactctcaggatccgcattgctcaagccggagtcccccacagggatgctctacagagcatgcataagctgcctaaggggctacctcgaccgtcagttaatcacctcatttcccggtcagggaaccaagaaatgtagcaggacgagccacagacgaaactcctcagacaccgaattaaagaaggaagaggtttttattcggccgggagcatcagcagactcatgtcttaagagccgagctctccgaaaaagaaattcttggcctttttaaaggcttacaactttaaggggtccatgtgaaagggtcgtgataaatcgagcaagcgtgggaaatgtgactggaggctacatgcatcagctaacagaacaaaaagttttacagcgcttttttcatacagtgtctggaatttacagataacacaggtagtttaggtcaggggttgatgttactattattactttttttaactcctagggccaggtggtggtgccaaggttgtctggctatttatcttacttttgtttttttccaactttttgctttttatctcctcctgtcttgtgaactaggcaaggtggggggaggagggcagcaggagtagtagtggtctccttccttaagactaagggccagcatgcacactggaagaatggggtggagccaccaggaattcatgcctaatgctggagaggagccacgccttttcaacttgcatgtgatggccttgtattcaatttgtgaggtggatacctgcatataggaccctccttttgcttaataaattccgccctcctcacctttcttttcttttttttgagactgagtcctgctctgttgcccatgcaggagtgcaatggcatgctcttggctcactgcaaaactctgcctcccaggttcaagtgattctcctgcctcagcctcctgagtagctgggactacaggcatgtaccaccatgcctggctaattttttgtatttttagtagagatggggtttcactaatttgcccaggctggtcttaaactcctgacctcaagtatctgcccacctcagcctcccaaaatgctgagattacaagtgtgagccaccgcacctggcaccatcctcacctttcaatgtttctgcgtgcctaatttttctggatttagctgaaccaaggaacaaaaaattctgcatcattagttgtgctggcttccacttgtgcctgccagtatcccacatttacatttaatcttgggttcccaaagacaggaaccccatgagaccaggccacacagtgcttccacagcacacctttctgtaaagacattcccctgaggctagtgggcaacccaatgcaaatcagcccactctgtgatcagctcatcttccatcagagtcttaaccattggtagtgaatgttcccacaacctccaggtgttcaaacctgccttttaatctaagtgcgtaaagaacaaatagcccattgcaataataatcattcactacaaccctgtcagccactttccaggttttgccagtgactcgtcagccactgcacacgcaaaagtcaagttctctctcatagtaaaaagtaattcctggtaccccaaaagccaaagatcaggtactacttttaacagctcttggcctggcacagtggctcatgcctgtaatcccagcacattgagaggccgaggcgggcagatcacctaaggtcaggagttcaagaccagcctggccaacatgttgaaaccgtgtctctacaaaaatacaaaaattagccgggcatcatgatgggtgcctgtaatcccagctactcgggaggctgagacaggagaattgtttgaacccaggaggtggaggttgcagtgagccgagatcgcaccactgcactccagactgggtgactgagactccatctcaaaaaaaaacaacaacaaaaaacagctcttagaattcttcattagttacaattttgtttcctccgtggcaatatgaattgcaatttgtgaattaaaaacattagaatttgaaaaaattttggctggacatggtagcttatgcctgtaatccctagcactttgggacgccgagcgaggcaggcagatcacctgaggtctggagttcaagaccagcctgaccaacatggtgaaaccccttctctactaaaaaaatacaaaaattagcccagtgtggtggcgcatgcctgtggtcccagctactcaggaggctgaggcaggagaatcgcttgaacccgggaggcagaggttgcagtgagccaagatcatgccactgtactccagcctgggtgacagagtgagactcagtctcaaaaaataaataaataataataaataaaataaaataaaattcaaaattatctggacatctgaattttatctgacatgccctttcatcatattgctatatcctttgtctttcctcaattatattttatcaagaaggccttttccaaccattttatttagtatggctcccccacctccacttctctcataaattgttctggccctagcaccagcatacagcatagtttcctgtttatttgcttagtgtctgtctccttcagtatagaatgtaatcttgtggcggtcatggtggctaacacctgtaatcccagtactttgggaggctgaggcacgtggatcatttgaggtcaggaattcaataccagcctgaccaatgtggtgaaaccctatctccactaaaaatacaaaaaaattagtctggcatggtggcacaagcctgtagtcacagctactcaggagactgatgcaggagaattgctagaacccgggagacagaggttgcagtgagctgagatcgcaccactgcactccagcctgggcgacagagtgagactccatctcaaaaaaaataaagtaatcttgtgagggcaggattttgatgctatgttcaccactgactccaaaatggcacatagcgggctctcagtagatatctattgaacaaatggaagcataaataaacaagcaatgctacacttgctttctccagcaccatgggagcagatccagggagcagacagggaaagaaggctacagcccctgccccctggtggagctggaagaatcaataattttcatttatttattcatctaatgtgctttgcacgctccctatctgccaggatcagcttgttgccagggataccgggtaaacaatcccataaggttcctgtggtctggaggaagaaacagacattaacgcacaatagggagatggttacttaattatagtggtgaactgtcaatgaaggaaaagcaaaaaaaaaaaaaaggtctaacctggtataggggtcaggggagacttcctcaaggaagggatatggagttgaggcctgaggctgagcatgaattaactggaggcagagctctgtgggtggagatgtcattccaagcaggaagcccggttaatgcaggtaccttgatagaaggaaggccagggtgaggaaaaaggccgggttacaggcagttactaggaaccttgtggcctgacttgttgctgaggaggaagcaatagccagctcagagggccttgtagttcaggtgatgccccatttctgtgttagtctatttttgcgttgctataaagaaatacctgaggctgggtaatttatacagaaaagaggtttaatttggctcacagtttagtaggcgccaggaagcatggcgctggcatctgctcctggtgaaggctcagggagctttcaatcatggcggaaggtgaaggaggagcaggtgtgtcacatggtaagagtgggacagagagacagagacagggagagagagagtgcaagagagagcaaaggagggaggaggagccagccttccttaaacagccagctctcatgtgaactaacagagtaagtactcactcatcaccacggggaggacaccaagccattcatgagggatccgcccccaagacccagacacctcccaccaggccccacctccaacactgggaatcgcatttctttttctttgttttttaattttgtactttaagttctgggatacatgtgcagaacatgcaggtttgttacataggtatacatgtgccatggtggtctgctgcacctatcaacctgtcatctaggttttaagccccacatgcattaggtatttgccctaaagctctccctccccttactcctcccccatagaccctggtgcgtgacattcctgtccctgtgtccatgtgttctcattgttcaactcccacttatgagtgagaacatgtggtgtttggttttctgttcctgtgttagtttgctgaggataatggcttccagtttcatccatatccctgcaaaggacatgaactcattcttttttatggctgcatagtattccatgttgtatatttgccacattttctttattcagtctattattgatggacatttgagttggttccaagtctttgctattgtaaatactgctgcaataaacatacatgtgcatttgtctttttttttgagtcagagtctcgctctgtcgcccaggctggagtgcagtggcaagatctcagctcactgcaaactccgcctcccaggttcaagcaattctcctgcctcagcctcccgagtagctgggattacaagcgcacgccaccatactcggctaattttttgtatttttagtagagaaggggttttgccatgttgtccaggctggtctcaaactcccagcctcatgatctgcctgcctcagcctcccaaagtgctgggattacaggtgtgagccacaatgcctagccatgtgtctttatagtagaatgatttatattcctttgagtatatgccccatgggagggaatcacatttcaacatgagatttggaggggacacacatctgaaccacatcacacagcatattcccaactccagctccctcctctccacaagaatgtaggatacccatcactcccaggatcagcttccttgagcccaatcctctgtaactcactgagatgctatgaagtgcctggtaggtgccacactgtgccacagtcatgctccaagacagtgtggagtgagggccagagggccaggaggcaggattggtttggagacattgcctttcttcaaacctcagtttcctcttaaatcaaataaatgattgcagaagataagctcatattaattccatttctaggaaaaatctgtgttccaaacagtagcactgactaatggaaagtacaactggctgtttcccttgaacagtgggtttattgttgtttttccaattataaaagtaataagattatttgtaaactatagaacagtagaaaaagtttcttgaatgagatttggttttcaatcagggcaaataaagacttttctgggattaagagggctgtttcttctccattactttatacggacccgtactggggacttgtcagctgttcaagtacaacgcacccagttttggttctgtaccaggattaggcctacaatatttcagaattcatatacaaaccccaataaagtgttaaaggagatgactgccctataacctatgttttgctgaatgtttactatgaggttttttttttaccatcctcatgagtatggtattgtaactgaaactctccaggaaaattcctctgcttaaaactaaaaatcaagtgtatctcaggaaactctactgtcccatctgaaatgcctctgttgtgtgttgtctgcaaaggtggagtctccctgttttgttcaggctggtctcgaactcctgggttcaaggaaatctctctcctcaccctcctgtgtagcggggactgtaggcacctggctgtggtggatactattaagccaaattccagtcagcatcctcttttcaatgaagttgaaaggagagatgatgaaactggcagtgttactgaatgggaaataaaggtgggaatacacattgtgagtgaagacacggaagtaacttctgcaatacaaccttgtaagagtcttaatgctacactcctttgtttatcaaatgatgtacctttatcgtaagggaagaacctgggccattccctctggtgttgagaggcaatttggaaactctgccatttcttaggactgagtatttaatatactattttgtggaaatctgagaggcagaaatgggatttaatgatctcaactgtcatccatctaaaaaacctaatttgcaattttaaataaaatggcatgttgccttctactattctctttttgttttttgagacggagtcttgctctgtcacccaggctggagtgcagtggcacaatctcagctcactgcaaccactgcctcctgggttcaagcgattctcctgcctcaacctcccgggtagctgggattacaggcacacgccactattctaggctaatttttttattttttgagacggagtctcgctctttgcccaggctggagtgcagtggtacaatctcagctcactgcaacctctgcctcctgggtttaagcgattctcctgcctcagcctcctgagtagtgggattacaggtgcgcaccaccacgcctggctaatttttgtatttttagcagagacggggtttcaccatgttggccaggctggtctcaaactcctgacctcaggtgatctgcctgcctcagcctcagcctcccaaagtgctggcgtgagccacggctcccagcctactattccccttttaaaacaggaaccaaccctgcatttaattttatgaagtctgatttatttatttatttatttatttatttatttatttagagatggaatctcattctgtcacccaggctggagtgcggtggcgcaatctcggctcactgcaacctttgcctcctgggttcaagcgattctcctgcctcagcctcccgagtagctgggactaaaggtacctgccaccacgactggtgaatttttgtatttttagtagagatggggtttcacgatgctggtcaggctgttccactatgttggccaggctggtttcaaactcctgacctcaggtgatccgcctgcctcggcctcccaaagtgctgggattacagacgtgagtcactctgcccagccgaa

SEQ ID NO: 488 - DNA, 1103 bp, Homo sapiens
cgtgagggaagtggggagaagctgtcaccccaacttgagttcaagaagactccttggaagaaaagaccaccaaattgagaatgaaaagtaagctgtagctattcttgggatggggcagtggccccatgctctggtccctggcctcagcagctgtcccagctcataaccccaagtgccggctttcccatcccgtctcaggatctgcactcgacgggcaccagggctttcttcagcgaatatctaaactctctcaagtttctccagagactttcatacatctacaaagatgacctcattctgtaacagcatggatttaacccgctcttcaatgtcactcccccacagaatgcactgttcatcgtcaccctatccactatcgtcagtcttactaaaagtcaaacatcaacattagtagtaactctggcattgtagcgatatctccaagagaaaattgttttgaacttttctgggaaaagttcacatatgttttcttaaaacgctagtttttacaatctcgctaccatgtggctttcctgaaggattaaatttctaatgtccttcaactagagagaggtaaaaatttttctagaacatgaattgcccactcccctcattccttctcagaaactaactgaattccagtgggtgtgcctggcaaacccaaaagcagtttctgttcaggatgctggtcttacctgtgaaggcgttcatgaacgtggagagggaccggttcaacattttgaagaaagggtctctgcacggatatttctgagacccacaaaggacggtatgctcaagaatgtgaggaacaccagtactgtccatgggagtagtacggaactgcacgctagggaaggagaatgaccagaacgcaaaaggttcagcttagtgctgcggacacagttcccagatgcatcatcacctcaggctactagaaatcatcattctgacaccacaatcctccagcacagggttttccaactataatgtaaatcattgactcagactgtaaaattgtattttgatgagattataagtcagtgtaaacttttccttatttttcaagatgctctgtcaataaaaatactagtgagatgatattt

SEQ ID NO: 489 - DNA, 16448 bp, Homo sapiens
gtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaactcctgaccttgtgatctgccctccttggcctcccaaggtgctgggattacaggcatgagctaccaggcctggcctgttgattttttcttttttttttttttattatactttaagttctgggatacatgtgcagaatgtgcaggtttggaacatagatatacacgtgccatagtggtttgctgcacccatcaatcggtcatctatattagatatttctcctaatgttatccctcccctagttccctacccaccaaagggcccagtgtgtgatgttcccctccctgtgtccatgtgttctcttttttcaactcccacttatgagtgagaacatgcagtgtttggttttctgttcctgtgttagcttgctgagaatgatggtttccagcttcatccatgtccctgcaaaggacatgagctcatccttttttatggctgcatagtattccatggtgtatatgtgccacattttctttatccagtctatcactgatgagcatttgggttgattccaagtctttgttgttgtgaacagtgttgcagtaaatgggtgtgtgtctttgtagaatgatttataatcctttgggtatatacccagtgatgggattgctggatcaaatggtatttctggttctagatccttgaggaattgccacactgtcttccacaatgggtgatctaatttacactcccaccaacagtgtaaaagccttcctatttgtccacatcctctccagcatctgttgtttcctgactttttaatgatcgccattttaactggcgtgagatggtatctcactgtggttttgatttgcatttctctaatgaccagtgatgatgagctttttttcatatgtttgttggccacataaatgtcttcttttgagaagtgtctgtttatatcctttgcccactttttgatggggttgtttgtttttttttctcgtaaatttgtttaggttctttgtagattctggatattagcccttcggcagatgagtagattgcaaaaaggttctcccattctgtaggttgtctgttcactctgatgatagtttcttttgctgtttagaaactctttagtttaattagatcccatttgtcaattttgacatttgttgccattgcttttggtgttttagtcatgaagtctttgcccatgcctatgtcctgaatggtatagcctaggttttcttctggggttttcatagttagaggttttatgtttaagtctttaatccatcttgagttcgtttttgtacaaggtctgaggaagggttcagtatcagttttctgcatatagctagccagttttcccaacaccatttattaaatagggaatacatcccccattgcttgtatttgtcgggttcgtcaaagatcagatggttgtagatgtgtggcattatttctgaggcctctgttctgtttcattggtctatatatctgttttggtaccagtaccatgctgttttggttactgtagcattgtagtagagtttgaagtcaggtagcgtaatacctccagctttgttctttttgcttagaattgtcttgactatgcgggctcttttttggttccatatgaaatttaaagtagttttttctagttctgtgaagaaagtcaatggttgcttgatggggatagcactgaatctataacttactttgggcagtatggccattttgatgatattgattcttcctatccgtgggcatgatatgtttttccatttgtttgtgtcgtctcttatttccttgagcagtggtttgtagttctccttgaagaggtccttcacataccatgtaagttttattcctgggtactttattctctttgtagcaattgtgaatggaagttcactcatgatttggctctctgtttgcctattattggtgtatacaaatgcttgtgatttttgcacactgcttttgtatcctgagattttgctgaagttgcttatcaacttgagattttgggccgaaatggtggggtattctaaatacacaatcatatcatctgcaagcagagacaatttgacttcctgtcttcctatttgaaaactctttatttcgttctcctgcctgatgaccctggctagaacttccaatatatggtgaataggagtggtgagagagggcatccttttcttgtgccagttttcaaagggaatgcttccagttcttgcccatttagtatgatatcggctgtgagtttcttgtaaataactattattattttgagatatgttccatcaatacctagtttactgacagtttttagcatgaagctgtgttgaattttatcaaaggcgttttctgcgtctattgagataatcatgtgatttttgtcatcagttttgtttatgtgatggattatgtttattgatttgcatatgttgaaccagccttgcatcccagggattaagctgacttgattgtggaggataaactttttgatgtgctgctggattcggtttgccagtattttattgaggatttttgcatcgatgttcatcagggatattggcctgaaattttccttttttgttgtgtctcttccaggttttggtatcagaatgatgctggcctcataaaatgagttagggaggagtccctctttttctattgtttggaatcatttcaggaggaatggtaccagctcctctttttacctctggtagaatttggctgtgaatccatctggtcctgggctttttttggctggtaggctattaattactgcctcaatttcagaacttgttattggtctattcaagaatttgacttcttcctagtttagtcttgggagggtgtatgtgttgaggaatttatccatttctgctagattttctagtttattttcatagaggtgtttatagtattctctgatggtagtttgtatttctgtgggatcagtagtcatcttccctttatcatttcttattgtgtctatttgattcttctctcttttcttctttattagtctggctaacagtctatctattttgttaatcttttcaaaaaaccagctcatggatgcatttacgttttcgaagggtttttcatgtccctgtcttcttcaattctgctctgatcttagttatttcttatcttctgctagcttttgaatttgtttgctcttgcttctctagttcttttaattgtgatgttaaggtgtcaattttagatctttcccactttctactgtgggcatttaatgctataaatttccctctaaaaactgctttagctatgtcccagagattctggtacattgtatctttgttctcattggtttcaaagaactcatttatttctgccttaattttgttttttacccagtagtcattcagaagaaggttgttcagtttccatgcagttgtgctgttttgagggagtttcttaatcatgagttctaatttgattgcactgtggtttgagagatggtttgttgtgatttctgctcttttggatttttctgaggagtgttttatttctaattgtgtggtcaattttataataagcacaatgtggtactgagaagaatgtatattctgctgattaggggtggagagttctatagatgtctattaggtctgcttggtccagagctgagttcaagtcctgaatatccttgttaattttctgtctcattgatctgtctaatattgacagtggggtgttaaagtctcccactattattgtgtgggagtccaagtctctctgtagatctctaagaacttgctttatgaatctggatgcccttgtattgggtgcatatatatttagaatagttagaccttcttgttgcattgatccctttaccattatgtaatgcccttctttgtctcttttgatctttgttggcttaaagtctgttttatctgagactaggattgcaacccctgggttttgtttgtttgtttgttttctttatatttgcttggtaaatcttccctcatccctttattttgagcctatgttgtgtctttggacgtgagatgagtctcctgaatacagcacactgatgaatcttgactctttatcccatttgccagtctgtgtcttttaactggggcatttagcccatttacatttaaggttaatattgttatgtgtgaatttgatcctgtcattatgatcctagctggttgttttgcctgttagttggtgcagtatcttcataatgtcgatggtctttacaatttgatatgtttttgcagtggctggtaccagtttttcctttccatatttagtgcgatgatcttacaatttggtatgtttttgcactggctgatactggtttttcctttccatatcttgtgcttctttcaatagctcttgtaaggcaggcctgctggtgacaaaatgtctcagcatttgcttctctgtgaaggattttatttttccttcgcttacgaagcttagttttgctggatatgaaattctgggttgaaaattcttttctttaagaatgttgaatattggccctcctctgttctggcttgtagggtttctgcagagagatccgctgttagtctgatgggcttccctttgtgggtaacctgacctttctccctggcttccgttaacattttttccttcatttcaaccttggtgaatctgatgattatgtgtcttggagttgctcttcttgaggagtgtctttgtagtgttctctgtatttcctgaatttgaatgttggcctgtcttgctacattggggaagttttccaggataatatcctgaaaagtgttttccaacttggttccattctccccgtcactttcaggtacaccaatccaatgtaggtttggtcttttcacatagtcccatatttcttggaggctttgctcagagaggaggaactcagagaggcagtctggctatagcagatttgctgagctgttgtgggctctgcccagttcaaaatttttggcagctcctttactcaagcctcagtaatgttggatgccccacccccaaccacgcttgagcatcccagggcaacttcagactgttgtgcctgcagtgagaatttcaagcccgtgaatcttagcttgctaggctccatgggggtgggatctgctgagctagaccacttggctccctggcttcatccccctttccaggcgagtgaaaagttctgtctcactggcattcctggcaccactggggtatgaaaaaaaaactcctgcagctagcttcctgtctgaccaaaccgttgcccagttttgtgcttgaaacccagggccctggtggcataggcacctgagagaatctcctggtctgtgagttgcaaagatcgtgggaaaagcatagtatctgggccagagtgcacagttcctcaaggcacattctgtcgtggcttcccttggctaggggagggtgttccctgaccccttgcacttcccaggtgaagtgacaccccaccctgctttggctcaccctccatgggctgcacccactgtctaaccagtcccgatgagatgagccagatacctcagttggaaatgcagaaatcacccgtcttctgcattgatctcaccgggagctgtagaccacagctattcctatttggcctttttttcttttgagacagggtttcactcttgtcacccaggctggagtgcaatggtgcaatcttggctcactgcaacctctgcctcccaggttcaagtgattctcctgcctaagcctcccaagtagctggcattataggcactcaccaccatacccagctaatttttgtatcttttgtagagatggggtttcaccatgttggctaggctggttttgaactcctaacctcaggtgacccacctgcctcggcctcccaaagtgttgggattacaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgcattaaaaataagtcacattggtaataatatgtcaaaggaacaagggagtctactgaaagagctcccaaaggccaaagctggaagaagtagagcaagaaagtaaactagctttgaattataacccaaaatataaagtaaatatccataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatgaaaaaaaaaaaaaaaaaaaaacccagcaaagtccaatagaggaatattctacaaaatacctcactatactctttaaaagagttaaggtcattaaaatggagtcggagacaatgtcctcaacatgaggagtctaaagagacaggccaactaaatttagtatggtatactggatgaattcctggaacagaaaaaaggttattaggtaacaactcaggaaatctgaataaagaaagaaatcagttaataacaatgtatcagtattgctttattaattatgacaaaagtaccatactagtgaaagatgaataatcggagtaactgtgtgcaaagactgggtagagggg

SEQ ID NO: 490 - DNA, 16730 bp, Homo sapiens
gtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggcactgtgctaagcagttttcctggaagtgtctacctcatttcgttctctgaatagctctaagagcgtgaacaaccccagaaggaaaaagagtgctgttgttaaaggtatctggcatcatggacccaaccatcaccaggagtttctcacttcatctctgtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacagataaaagaaaataccgaagactgaaaatgcagaaaattcaaccatgcagcccattccaaattaaatatgtcttcctctctaattcctctcttctagcagagaaggggagatgagctatgactccatgctcatgcttaacaaaattgtgttagattggtgcaaaagtaattgcagtttttgccatttaaaagtaattgcaatgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaaacataggaaaaaacgctcaacatcacaaatgatcagggaaatgcaaatcaaaaccacaatgcgataccacctcactcctgcaagaatggccataattaaaaaaaaaaatcaaaaaacagtagatgttagcatggatgcggtgaacagggaacacttctacactgctggtgggaatgtaaactagtaaagccactatggaaaacagtgtggagattccttgaagaattaaaagtagaactaccatttgatccagcaatcccactactgggtatctacccagaggaaaagaagtcactattcaaaaaagatacttgcacacacatgtttatagtggcacaattcaaaatagcaaaatcgtggaaccaacccaaatgcccatcaatcaacaagtggataaagaaactgtggtatgtatatataatggaatactatgcagccataaaaaggaatgaattaacagcatttgcagtgacctgaatgagattggaaacttattctaagtaaagtaactcaggaatggaaaaccaaacatcatatcttctcacagatatatgggaactaagttatgaggactcaaaggcataagaatgatacaatggactttggggacttggggggaagggtgagaagtgggtgaggtataaaacactacaaatatgctgcggtgtatactgcgcaggtgatgggtgcacgaaaatctcacaaatcatccctaaagaacttactcatgtaaccaaataccatctatacctcaataacttatggggaaaaaagtaattgcaaaaactgcaattacctttgcatgaaccaaaggcctactttggagagtcagaggaattcttaaccataattcaaccaagacatacggtatgtgccttctctttggtggaacagtgaatatacaggctactagcctgtactgagtgtttcagccaaaacacattcttttaaaagtcacagttttaagtgacaatatcccaatgaaaatacaaattaaaaaatgcattggcatatctatattccctcccaaaataacacacatttggaatatataaagaactcttaaaagtcaatgagaaaaaaagcaatagctcagtagaaaagtgggaagaagacttggacacttcagaaaagagaatatattaaaatagtccataaacagaaataaaaggtgctcaactttatgagtcatctgggatatgtagattaaaaccacagtgcaatattataccacccctaccagaataactaaaaagagtaagttggaaaatactcagtgctgatgagaaagtggggtaattgaaactcttatacatcattctaggaacatccacttaggaaaacaacttggcagtgtctaataaagtccagtatatgcattccctataacccagaatttttactctcaggtgtatacccaacagaaatgcaggtgtgtgttcaccagaaatcatgttcaagaatgttcatggtatcactagtcatgaggcacaaaaactggaaatgttcatcaacaatgagtaggataaataagttgtgttaatatttatacaattgaaaattatacagcagaaagaataaataatctaaacctacacacaacagcatgaagaaatctcatgagtggaatgttagatcataacctaaataaacttacctggagcaggtgccactgaagccataaaatggtaggatgaattgctggaggctgactatggactagcttgacagtaaaaaatttggggaggtccattctgaaggaggcccctcacactttcttggattttatcttcaggaagcccaccagattttcatggtgaagatcttagaaaacatctctcatatcttggtcagttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaagaaagaatcagaagaaaatgacagaaatgaaaaacactgcaacagaaatgaagaatgcctttgataagctcattactaaactgaacataaacaaggaaataatcaataatttaaagatatatcaaaggagacattgcaaattgaaatactaagagaaaaaggactacaacctccattccaatatccaagaacaattacaaaaatataacatatgcataattgaagtactagaagaagaagaaaggagcagaggaagtgcagaggaagtacagtagttccctcttatccatggtggatacattcaaagacccccagtggatgcctgaaaatgcagatagtaccaaaccctacctatacattctatgttttttcctatatgtacatatctatgataaggtttaacttataaattaggcataaaaagagtttaacagtataataaaatagaaaaattataacaatactcagaaccaagcacaactgaaaacttgtgaaatgtttatttctgggcatggtggctcatgcctgtaatcccaacactttgcaaagccaaggcagatggattgcttgagctcaggagtttaagaccagtgtgggaagcatggtgaaacctcatctctacaaaaaatacaaaaaattatctaggtgtagtggcacatgcccatagttccagctactcggggtggtgggagggtgtgtggtggggggcagtgtggggtggaagggagctgaaatgggataatcgcttgagaccaggaagtcaaggctgtactgagccttgactgggccactgcactccagcctgggtgacagaatgagaccctgtctcaaaaaaaaaaaaaaaggaaaattattaaggataaagatgggcattaaataatgagaaaggggcaattatccaaaaaacataataattcttaagttatgcaggtaacacagcatctaaatacatgagacaaaaatttataaaactgcaagaagaaataatcaaatttaatattatttaataatatttttggagatctcaacatccctatattaataacagctaatttcaacaagcagaaatcaggaaaatgttcaactgaatagcactaacaatgaacaggatctaactgttcaagtagcagcagaataattaatcaagtaacagcagaatacatattcctctcaagtttatatgggactttatgcaaaatagaccacattctggggctgaaaaagatgccctcacaaatttaaaagaatagaaggtttactgcatgtgttcttagactataatgaaatttaactggaaatcagtgccagaaaaaaactcagaagtccccaaatagtttgagattaaataacatacttttatataacacataggtcaaagaagaagtctcaaaggaaatttaaaaatatttcgaactaaacaaaatgaaatgtacatcaaaatttatgggatgctcaggaaaaatagctagtggatgcttggcttcatacctaggtgatgggttgatctgtgcagcaaagcaccatggcacacgtttacctatgtaacaaacctgcacatcctgcacatgtaccctggaactgaaaataaaaattgattaaaaaagaaagagaaaggataattcctttcacccacagtttcctgtctcctaatagtccttctgttgtgtctttaaataaatgtgtctcaaatcttaagatattcataaaatctgggattgcagatgtattttgcattacaagtcctatttttattttttaatggaatgctgtaaaagcagttcttagaggcaaatttatagcagcaaatgcatatattagaaaagaagaaaaatctaaaatcactaatagaaatgtgccttaggaaagtaaagagaggagagcaatttaagcctcaagtaagcagaagaaaagacataaaactttgagcagaaatcaataaaattgaaaacatgaggtcaacagagaaagtcaataaacccaaaaggcaatgcctttaaaagatcaataaaatcgataaatccatagccaggctaaccaagtgaaaaagggagaagacacaaattataaatattgattccatagacattaaaaagataataaaagaacattacaaacaaatgtatactgacacttttggtaatttagatgaaatgaatcaattccttgaaagacataaaccatcaaaacttatggaaaagaaatacattacctaaatagatctatatttatttaaaaaatagataaatcattaataatctttcgaaaaagaaagcgtctcgcccagattctttcactaatgaattccaccaagcatttaaggaagaaataatgtcagttctctataatcacttttagaaaatagaagtaagaggtatacctcctaactcattcaaggaggcaggcattatcttaatatcaaaaccggggaaatacactacaagaaatgaaacctacagctcaatatattttatgaatatagatggaaaaattttcaataaaatattagctaattgaatccaaaaatatataaaaatagtaatacatcacagtaagtgcaatttattttaggcataccagactgatctgacatttattaactggctaaagaactattttatgattctgtcaattgatgcagagaaagcatttgacaaactccaacatctatttatgagaaaaagtcttagaaaactaggaataaaaaacatcctcaacttaatctggaacatctaaaaaatgggacttcacgctattttatggtgagaaatgatatgcttttcttctatattgggaacaagacaaggttctttttttgccactcttattcaccatcctactggatgtcctaattagtgcaacaaggcaagaaaaaatatatatacagattagaaagaaaaaaagaaaactacctctgttcaagatgacataattacttatttagtaaaactgaaagaattgactcctggaattaatatgtgattatagcaaggttgcaggatgcgaggttaatagaagtcaattgtgtttccatgtaccaccagtgaacaagtgaaaattgaagttgaaaacaaaatacaatttcattccttcccccagcaaaaatgaaatataaacaacaaaatatgtatacaacgtatattatgtatatggaaaattttaagtctgatgaaagaaataaaggaagatctaaataaatggagatgtaccactttcatggataagtagattcaataatgttgagatataaattcttcacgaattggtgtatacatttaatacaattctaataaattctcagcaagttattttgtggttattgacaaatttattctattttttagcttcatctcaaaagatgattttaaaatttatatggaaatgcaagagacccagaatagtctacataatactgaccaaaggactaagttggagaactgacactactcatagtactacaaagctacagtaattatgacagtgaggtatttgtacaagaatagacaaatggattaatagaaaagaggagagagcctcttttagaccctcaactgatccttgacagagcaaaataaattcaattgagaaaggacagtcttttcaacaaataatcatcaaaaattgtgcatatacatgcaaaaatgaatctagacatataccttatgcttttcacaaaaattaatttaaaatggaccttagttctaaatgtaaaacaaaaactagaaaacttctatgagatagcataggagaaaatctaggtgaccttgggtttgattaaatcatgatccatgaaagaaaaaaattaaaaaaaaattgaacttaattaaatttaaaaattgttatgtgaaatatattgttaagtaaatgagaagacaagccacagaatgagagaaaatattttaaaaacatatccagtaaaggagttaaatccaaatgacaccaaggtatttaaataattctatgtaatgatcaaaagatctgaacattcaactcaccaaataagatgtacagatggcatataagcatatgaaaagatgctcaacatcttatgttattagagaatagtaaattaaaacaacaatgagaaaccactacacctattagaatggctgaaatccaaattactgacaacaaccaatgctgttgagaatgcaatgcaagagaaactctagttcatccaattttcaaatgtgactgtaaaaggctgcagccactttagaagacattttgtctgtttcttacaaagctaagcatagccttgcattataatctgcagttgtgttcctctgtatatacccaattacactgaaacattatgtctacaaaaaaatcctgaaaacaaatgtttatagcaggtttattgttacttggtagttaccaaaaatggaaaacaatcaagatgtctttcaatagatgagtgaataaactataagatatccataaaatggaatattattcagcagtaaaaagaaatgagctttcaaatcatgaaaagacatggaggaaactcaaatgcatactgttacatgaaagcagccagtgtgaaaaggctacatgctatataatttcaattagatgacattttggaaagaagcaaaactgtaaagaaaaagatcagtttttgcctggcgttcagggaaagggaagaataagttaagcacaggagacttggggagctgtgaaatgattctgtgcaatattggtggaattttggcaacattatgcatttgccaaaggcaatagaagtttttgacacaaagagttaccataatgcaggcaaattttagaaaattatttagaaggtcagaggatcccagaagcaatgtggactttacagaagaaattcactgcattacaaagcatcagataaccttagtaaggtggagagagaaaatggtcttaacataaatatctttaaaaatgaatggaatctgtcagactataggcaagatgagctgcacaaaagcactgtactctagctgataaaattatttctcattggcttctggttaacagttctgatactgctatacatatatatgggaattgaataattaagcctataaatggcaaacattgggagttatatttctcacggtgtggaaatttacagatcaactaggggaacagtcttgaataatcaatgtgatgatcattacagttggagacatcaaggagaactaatgtttaacttaatatagatatgggtggttatatatagaaatattcaaagatgtttatgtaaatacacaaaagcacaaccatgacacatctaaaataaataacaccctggtaaccatgggcacacttagtactcaaatgctggagtgcaatggcgtgatcttggctcactgcaacctctgccccctgggtttaagcaattctccagcctcagccaccagagtagcagtgattacaggcactcaccaccacacctggctaatttttgtatttttagtagagacagggtttcaccatgttggccaggcttatctcgaactcctgaccttgtgatctgccctccttggcctcccaaggtgctgggattacaggcatgagctaccaggcctggcctgttgattttttcttttttttttttttattatactttaagttctgggatacatgtgcagaatgtgcaggtttggaacatagatatacacgtgccatagtggtttgctgcacccatcaatcggtcatctatattagatatttctcctaatgttatccctcccctagttccctacccaccaaagggcccagtgtgtgatgttcccctccctgtgtccatgtgttctcttttttcaactcccacttatgagtgagaacatgcagtgtttggttttctgttcctgtgttagcttgctgagaatgatggtttccagcttcatccatgtccctgcaaaggacatgagctcatccttttttatggctgcatagtattccatggtgtatatgtgccacattttctttatccagtctatcactgatgagcatttgggttgattccaagtctttgttgttgtgaacagtgttgcagtaaatgggtgtgtgtctttgtagaatgatttataatcctttgggtatatacccagtgatgggattgctggatcaaatggtatttctggttctagatccttgaggaattgccacactgtcttccacaatgggtgatctaatttacactcccaccaacagtgtaaaagccttcctatttgtccacatcctctccagcatctgttgtttcctgactttttaatgatcgccattttaactggcgtgagatggtatctcactgtggttttgatttgcatttctctaatgaccagtgatgatgagctttttttcatatgtttgttggccacataaatgtcttcttttgagaagtgtctgtttatatcctttgcccactttttgatggggttgtttgtttttttttctcgtaaatttgtttaggttctttgtagattctggatattagcccttcggcagatgagtagattgcaaaaaggttctcccattctgtaggttgtctgttcactctgatgatagtttcttttgctgtttagaaactctttagtttaattagatcccatttgtcaattttgacatttgttgccattgcttttggtgttttagtcatgaagtctttgcccatgcctatgtcctgaatggtatagcctaggttttcttctggggttttcatagttagaggttttatgtttaagtctttaatccatcttgagttcgtttttgtacaaggtctgaggaagggttcagtatcagttttctgcatatagctagccagttttcccaacaccatttattaaatagggaatacatcccccattgcttgtatttgtcgggttcgtcaaagatcagatggttgtagatgtgtggcattatttctgaggcctctgttctgtttcattggtctatatatctgttttggtaccagtaccatgctgttttggttactgtagcattgtagtagagtttgaagtcaggtagcgtaatacctccagctttgttctttttgcttagaattgtcttgactatgcgggctcttttttggttccatatgaaatttaaagtagttttttctagttctgtgaagaaagtcaatggttgcttgatggggatagcactgaatctataacttactttgggcagtatggccattttgatgatattgattcttcctatccgtgggcatgatatgtttttccatttgtttgtgtcgtctcttatttccttgagcagtggtttgtagttctccttgaagaggtccttcacataccatgtaagttttattcctgggtactttattctctttgtagcaattgtgaatggaagttcactcatgatttggctctctgtttgcctattattggtgtatacaaatgcttgtgatttttgcacactgcttttgtatcctgagattttgctgaagttgcttatcaacttgagattttgggccgaaatggtggggtattctaaatacacaatcatatcatctgcaagcagagacaatttgacttcctgtcttcctatttgaaaactctttatttcgttctcctgcctgatgaccctggctagaacttccaatatatggtgaataggagtggtgagagagggcatccttttcttgtgccagttttcaaagggaatgcttccagttcttgcccatttagtatgatatcggctgtgagtttcttgtaaataactattattattttgagatatgttccatcaatacctagtttactgacagtttttagcatgaagctgtgttgaattttatcaaaggcgttttctgcgtctattgagataatcatgtgatttttgtcatcagttttgtttatgtgatggattatgtttattgatttgcatatgttgaaccagccttgcatcccagggattaagctgacttgattgtggaggataaactttttgatgtgctgctggattcggtttgccagtattttattgaggatttttgcatcgatgttcatcagggatattggcctgaaattttccttttttgttgtgtctcttccaggttttggtatcagaatgatgctggcctcataaaatgagttagggaggagtccctctttttctattgtttggaatcatttcaggaggaatggtaccagctcctctttttacctctggtagaatttggctgtgaatccatctggtcctgggctttttttggctggtaggctattaattactgcctcaatttcagaacttgttattggtctattcaagaatttgacttcttcctagtttagtcttgggagggtgtatgtgttgaggaatttatccatttctgctagattttctagtttattttcatagaggtgtttatagtattctctgatggtagtttgtatttctgtgggatcagtagtcatcttccctttatcatttcttattgtgtctatttgattcttctctcttttcttctttattagtctggctaacagtctatctattttgttaatcttttcaaaaaaccagctcatggatgcatttacgttttcgaagggtttttcatgtccctgtcttcttcaattctgctctgatcttagttatttcttatcttctgctagcttttgaatttgtttgctcttgcttctctagttcttttaattgtgatgttaaggtgtcaattttagatctttcccactttctactgtgggcatttaatgctataaatttccctctaaaaactgctttagctatgtcccagagattctggtacattgtatctttgttctcattggtttcaaagaactcatttatttctgccttaattttgttttttacccagtagtcattcagaagaaggttgttcagtttccatgcagttgtgctgttttgagggagtttcttaatcatgagttctaatttgattgcactgtggtttgagagatggtttgttgtgatttctgctcttttggatttttctgaggagtgttttatttctaattgtgtggtcaattttataataagcacaatgtggtactgagaagaatgtatattctgctgattaggggtggagagttctatagatgtctattaggtctgcttggtccagagctgagttcaagtcctgaatatccttgttaattttctgtctcattgatctgtctaatattgacagtggggtgttaaagtctcccactattattgtgtgggagtccaagtctctctgtagatctctaagaacttgctttatgaatctggatgcccttgtattgggtgcatatatatttagaatagttagaccttcttgttgcattgatccctttaccattatgtaatgcccttctttgtctcttttgatctttgttggcttaaagtctgttttatctgagactaggattgcaacccctgggttttgtttgtttgtttgttttctttatatttgcttggtaaatcttccctcatccctttattttgagcctatgttgtgtctttggacgtgagatgagtctcctgaatacagcacactgatgaatcttgactctttatcccatttgccagtctgtgtcttttaactggggcatttagcccatttacatttaaggttaatattgttatgtgtgaatttgatcctgtcattatgatcctagctggttgttttgcctgttagttggtgcagtatcttcataatgtcgatggtctttacaatttgatatgtttttgcagtggctggtaccagtttttcctttccatatttagtgcgatgatcttacaatttggtatgtttttgcactggctgatactggtttttcctttccatatcttgtgcttctttcaatagctcttgtaaggcaggcctgctggtgacaaaatgtctcagcatttgcttctctgtgaaggattttatttttccttcgcttacgaagcttagttttgctggatatgaaattctgggttgaaaattcttttctttaagaatgttgaatattggccctcctctgttctggcttgtagggtttctgcagagagatccgctgttagtctgatgggcttccctttgtgggtaacctgacctttctccctggcttccgttaacattttttccttcatttcaaccttggtgaatctgatgattatgtgtcttggagttgctcttcttgaggagtgtctttgtagtgttctctgtatttcctgaatttgaatgttggcctgtcttgctacattggggaagttttccaggataatatcctgaaaagtgttttccaacttggttccattctccccgtcactttcaggtacaccaatccaatgtaggtttggtcttttcacatagtcccatatttcttggaggctttgctcagagaggaggaactcagagaggcagtctggctatagcagatttgctgagctgttgtgggctctgcccagttcaaaatttttggcagctcctttactcaagcctcagtaatgttggatgccccacccccaaccacgcttgagcatcccagggcaacttcagactgttgtgcctgcagtgagaatttcaagcccgtgaatcttagcttgctaggctccatgggggtgggatctgctgagctagaccacttggctccctggcttcatccccctttccaggcgagtgaaaagttctgtctcactggcattcctggcaccactggggtatgaaaaaaaaactcctgcagctagcttcctgtctgaccaaaccgttgcccagttttgtgcttgaaacccagggccctggtggcataggcacctgagagaatctcctggtctgtgagttgcaaagatcgtgggaaaagcatagtatctgggccagagtgcacagttcctcaaggcacattctgtcgtggcttcccttggctaggggagggtgttccctgaccccttgcacttcccaggtgaagtgacaccccaccctgctttggctcaccctccatgggctgcacccactgtctaaccagtcccgatgagatgagccagatacctcagttggaaatgcagaaatcacccgtcttctgcattgatctcaccgggagctgtagaccacagctattcctatttggcctttttttcttttgagacagggtttcactcttgtcacccaggctggagtgcaatggtgcaatcttggctcactgcaacctctgcctcccaggttcaagtgattctcctgcctaagcctcccaagtagctggcattataggcactcaccaccatacccagctaatttttgtatcttttgtagagatggggtttcaccatgttggctaggctggttttgaactcctaacctcaggtgacccacctgcctcggcctcccaaagtgttgggattacaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgcattaaaaataagtcacattggtaataatatgtcaaaggaacaagggagtctactgaaagagctcccaaaggccaaagctggaagaagtagagcaagaaagtaaactagctttgaattataacccaaaatataaagtaaatatccataagtctctactgatataaagcacaattgaataataactgggagagggagggagaataaataagttctacgtaaaagaatttcttataaattttgtagatatgactttctaaacaaattctcattcttaagaattcatagtgacttccttccaaaaattacaatatggaaaactgataaaaaatgagtaactctacagtggaggaatctgacacatactacatcagccaggttattgaggtcaacatcaacagccataaatcatgtgaacagtatgtacacttggtatgatgtaacgaatagcacttcacttctgtggtctttctccccaggctcattatctcagtataatcatgaaaaaaaaaaaaaaaaaaaaacccagcaaagtccaatagaggaatattctacaaaatacctcactatactctttaaaagagttaaggtcattaaaatggagtcggagacaatgtcctcaacatgaggagtctaaagagacaggccaactaaatttagtatggtatactggatgaattcctggaacagaaaaaaggttattaggtaacaactcaggaaatctgaataaagaaagaaatcagttaataacaatgtatcagtattgctttattaattatgacaaaagtaccatactagtgaaagatgaataatcggagtaactgtgtgcaaagactgggtagagggg

SEQ ID NO: 491 - DNA, 16589 bp, Homo sapiens
gcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtatgagtgtgcatgcacttgtgtgtgcatgcctaacatccaaaactagatataaattctttaaacttttcattagttggccaggcacggtgactcgcacctgtgatcccagcactttgggaggccgaggcgggcggatcatgaggttaggagatcaagaccatcctggctaacattgtgaaacccggtctctactaaaaatacaaaaattagctgggtgtggtggcatgtgcctgtaatcccagctacttgggaggctgaggcaggagaattgcttgaaccagggagtcggagcttgcagtgagccgagatcacaccactgcactccagcatgagactctgtatcaaaaaaaaaaaaaaaaaaaaaaattctgcgtgagttgtgtggaggtgtcagtacctttccccagcaagagaagcttctccatatcaggcatatcctagccatgaccctgaaactaaccagccaagagggaaatgtgagacaagcccaggcaagcttcctggatgttgtatgcaggaataggatgtgctctctggacttggagacttcctgcctgctcaagaggctgtgcctccttgtgtctcccacaggcctctgtgtccaccttccccaccctggcaggcctgctaggccagcagccctggagaggaaagggtgaggtggtgtttgaagggacctgcctcctacgagctctgctggttggactgtcggatgacagaaccgtgcctctgagcctgggagagggaggcacccctgtgttctggaagcccccagtgcttcagcaactcctcactgaggcagaatagtggaggaatcaagctgggatccaggggactgaggaggggatagagcagcacctgggccccacattcccttccaacagagcctggggtgctgtgtttccgggagggttttttttgttttttgttttcccgagacagaatctcgctctgacccccagcctggagtgcagtggcatgatctcggctcactgcaacctccgcctctcgggttcaagcaattctcctgcctcagcctcccgagtagctgggattacaggtgcacaccaccacacctggctaatttttgtattttttatagagacggggtttcaccatgttggctaggctggtcgtgaacttctgacctcatgatctgcctgcctcagactcctaaagtgctgggattacaggtgtgagccactgcacccggcctctttttttttttttttttttttttttgtgagacagagtctctgtcccccaggctggagttcagtggtgcaatctcggctcactgcaacctctgtctcctggtttcaagcaattctcctgcttcagcctctgaatagctgggattaccgacatgcaccaccacgcccatataatttttgtattttttgtagagctgaagtttcactatgttggccaggctggtctcaaactcctgacttctggtgatccacccaccgtggcctcccaaagtgctgggattgcaggtgtgagccaccgtgcccggccagagcctggggttctcaaactcgtttctggggaccgcccaccacttttcttgccagtgcccatcttccaggttcctcccaggctgcttctgcctgccttgtcctcttcctgcctgtcacaccacactctcccaccagcatcttcctcattccgctctgactctcctcaccacccagcccgacctgactgaaaaccccgcagtgggagagcaggaggcccctgcttctaggtgccgtgtgagaagcagctgtgaggtcgggttgggtggctcacgcctgtaatcccagcactttgggaggccgaggtgggcgggtcacaaggtcaggagttcaagaccagcctggccaatatggtgaaaacccatctctactaaaagtacaaaaaaaatagccaggtgtggtggcgggtgcctgtaatcccagccactcaggaggctgaagcaggagaatcgcttgaacttgggaggcagagggtgcagtgagccgagatcatgccactgcactccagcctgggcaacagagcgagactccataaaaaagaaaaagagatttaattggctcacagttctgcaggggttacaggaagcatagcacccacatcactcagcttctggggaggcctcagagagcttttactcatggcagcaggtgaagagggagcaggcgagtcacatagtgagagcaggagcaggcgagagagaggccagaggtgccacacgcttctaaatgaccagatctcgcgggaacccactatcacaaagacagctctgagccgtgagggatccgcctcatgatccacacaccttctgccaggccccacctctagcactggggatcacaattcaacatgagatttgggtgaggacagatatccaaactgtgtggacagaggtgatgctcctctacttgttgaactcttgaacactagtgaagagaatgctggtgtattagtctgccaggctgctgttgcagaataccatgaactgggcacttaagcaactgaaatagattttctcacagtgctggaggctagaagtccaagatccaggtgccagcaggtttggtatctcctgaggcctcgcccctgcgcttgcagacagccgccttctcactgggtccttacagggcctttttctttgagccagtgtagagagctctgttctttcttcctctttttataagcacaccagtcctatttaattagggtcccaccctatggcctcatttaatcatttgttgttgtgttttttttttttgagacgaggtctcactgtgttgcccaggttagtctcaaacccctggtcacaagtgatcttcccacattggcctcccaaagtgctcagattacaggtgtgagccattgcgcccagtctcatttaaccttaattactaatttaaaggtgccatcatggccaggcgcggtggctcacacctgtaatcccagcacttttggaggccaaggtgggcggatcacttgcagccaggagttcgagaccagcctggccaacatggtgaaacccccgtctctactaaaaatacaaaaattagctgggtgtggtggcacatgcctgtaatcccagctactcaggaggctgaggcaggagaatcacttgaacctgggaggtggaggttgcagtgagccgagatcacgccactgcactccagcctgggtgacagagcgagactgtctcaaaaaaaaaaaaaaaaagtgccaccaccaaagactgtcatattgggggttagggcttcaacctacagatttggaggaaacactatttagtccacaataactggagaagttgaatttagaagatgggggttggggccaggcacagtgactcatgcctgtaatccagcgctttgggagaccaaggtgggaggatcacttgaggtcaggagttcaagaccagactgggcaatatagcgagactccctctctacagaaaatttaaaaattagccaggtgtagtggtgtgtgcctgtagtcccagctactcggaggctaaggcaggaggatcgcttgagtgcatgggttgtaggttacagtaagctatgattgtgccactgtactccagacaggggaacagagcaagaccctgtctcagcaacaacaaaacaacagggagatagggggtcaggtgctgacttcaccttaacttcactgtgtgcttttacagcaagcctgttaccctctgtgagcctcaacttctctatgtgtaacaaatggccaactttatgggattgtcaagaagctgaaatgagaccctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcaccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggg

SEQ ID NO: 492 - DNA, 4063 bp, Homo sapiens
ctttccctgcctcgcgacacccagaccgagacctcgggaatgctccggccccctgccgccgtctcccggcccggttctctttcactaaaaataggcgattctggcagcgcccctcctatggggccttgggggcaattggggttttgtcttagagcccgtgtggacccggatggcgacggcagcccgaggagagggagggctgactgtatggttggctttccgacgaccagaccctgcaggattcggcctttccctttggagttttcctccatccccctccgtccctcccaggggatgcccgcaggccacagtggtcactgaaggtcaaccctgagccgaaggagaagtggcctcgaccctggggaccccttcaggtgcagcttgagggggaacggccgcctttcccgttgggcacccagctgtggctgtgccctgtcctcgcccagctcccggcataggcatgcgctctgggccggggccggggccccccgcctccccgggaggaatcgctgggttgactctgggtcagcaaagggagcccggccctttctagcggggggacgtcctgcagccgctggaggaggctgagtcacgcttttcccaccagaagtctacctgtgcctgcgcccgccggacctgccggcctcttccttctcatccagggggcctcttctccagcctcacggaggtgggaagcttgctggaggcccctacctgccttttggggaagaccccgaggctggcccacgccctgctggcaggacccttcctgactgggtccaccgttcttctgggtctcaccacttctcccagcccctgggctgcttcctctctcccgtgtctgggaccccagaggcaccacttccattccatacaaggagtccacaggacctgtacagttggaaccagcccctcaggcttccctgccagagcccttttctccaggagcagaggcatccatcccctcctgccagcattccagaccctggagggcttgcgcggtggcaggttttcccttgaatgctgaggcgaggctgagggaaaggtgcgtggccaggaccagagggcctgctgactgccagctaaaactctgtgcaggaggctttcccacgtactttacgtactttaagatgatgagcaaaatccttactgtctccctgcaaaatccgtgtggcttcctctggcgtgtcccatactcttgtgtttgtggccagactgggcctccgctcttcctccaaactcattagttctctcccacacagaacacacattgttctgcctggaaggcccatcacatccctccccaaccctctcggttcaatctaagctttcttggggtctcagcttaggttgcctgttcagggaagcctctgggaccctcaggtctaggtcacatttgtttcatgctttcacagcggtggtgtagtgtatactggttcttcttatccctcaggtgtctcctcacaaggactgctctgtttctgctaagtgttgcattctcaccacccagtggaggctttggcctgtggaagattctaattttggtggccagcctcatgggttgaaaagtaaaggtcaagtagttaaaggaagggcgttccaggcagagggatcagcgtaggtgcagaggtaaggtagggatagctttgagggctccttaggagggagtgaaacccctgagggtcaaggagccctagtttggaaggccttgctactaagggatctggattttgtcctgaagcctagagtagtttctttaagagtctgatctcggccaggcctagagtagtttctttaagagtctgatctcggccaggcctagagtagtttctttaagagtctgatctcggccaggcgcagtggctcacgcctgtaatcccagtacttcggaaggccaaggcaggcagatcacgaggtcaggagttccagaccatcctggctaacacggtgaaacccgtctctactaaaaatacaaaaaattagctgggcctggtggcacgtgcctgtagtcccagctactcgggaggctgaggcaggagaattgcttgaaccggggaggtggaggttgtagtgagcagagatcatgccactgcactgcagcctgggtgataagagtgagactccatctcaacaacaacaaaaaaagtctgatctcagcactgtcctgcctagactgcttctttttttaggacaagtttttattgctacctgctaaaaacgcacttattgtcacggtgcaggctaggttggaggagtaaaactagagacaagaagagttaagaagccactgcagtattcaagacaaatgagtcaagccaaaggctgagatgctgtacaggaaggtctctagggggaccctaaatttagctgggggtggtggtgcaagattcctacgaagtggcactaaaggagggactgagtacttactaaagaccttatgactaagaggtctctctcatccctacactacttccttcactccagtgtctagaattggcctctgtatataggagctctttggttgagcatggttcacacctgtaatcccagcagtttgggaggctgaggtgggaggatcacttgaactcaggtgttcaagaccaacacagtgagaccccatcgctataaaatttttaaaaattttagccaggcatggtggtgcacgcttgtagtcccagctacttaggaggctgatgcaggaggatcgcttgagcccagaagttggaggccgcagtgagctatgatcacatcactacactccagcctgggtgacagggtaagatcctgtctcaaaaagaaaaaaaaaaaattaagcacaaaaagtttggagaccaggaaacaggagtacaagtataggtgctgtcccactcttagtgaggtcggctgtgaaattaaatcagttcctggaacaaatcttacaaagagatcagagatcacttgcagtttttttttttttttttttttgagacagcgtctcactctgtcacccaggctggagtgcagtggtgccattttggctcacagcacccttcgcctcctgggttcagacaattctcccacctcagtctcccgagtagctgggactacatgcctggctaatttttgtcttttttggtagagacagggtgtcaccatgttggccagcctggtcattaactttttaaaaaaatgtttattttcctgataaagattcagcataaattttaggcagaagtctgacgtctagcagtcccccagaaagcattctgttgtctgttggggcttccttgggagatggactgtgggctaggcctgggtgctttggcagatacagagtcagaggctgtggaaaggggatggtccagacaggactataataaatgcatgagccaccgtgcctggccctcagggtacttttaataaagtgctagctaggcaagcctattcttcctctcaagagtaggtgttccacttttgaacacctatgccaggcaccggctatagtgcctacaagaggatgatatgtggacatgaccactttccctgactacatcagtggttctcaactggggatgattttgcaatgtctgcttatgggacatttggtaatgtctagagacatttgtggttgtcacaactagtggaggggtactacctgcatgtagtgggtagagtccagagatgctactaagtatcctataatgcataggacagctgcccacaacaaagaattatctcactcaaaatgtcaatagggtcgaggttgagaaatcctggtctaggctgggtgtggtggctcatgactgtaatcccagcattttgggaggccaaggcaggaggatcacttgagcccaccaggagttcaagaccagcctgggcaatgtagggagatctccacaaaaaataaaaataaattagctgcactatagtccttgttacacagaaggctgacgtgggagcatcacttgaacgtaggaagtgagtgagctgtgattgcactactgcactccagtctgggcaacagagtgagaccctggctcaaacaaaacaaaaacaaaagcattgaaagaaagaaagaggccgg

SEQ ID NO: 493 - DNA, 1012 bp, Homo sapiens
cttttgatgggcgagtttagttcatttacattcaatatattattgataagtaaggacttactcctaccattttgttatttgttttctaattatttagtaatcttctcttccttccttctttccttcctgtcttcctctagtgaaggtgattttctctggtggtatgatttagtttttttgctttatattttttgtgtatccattctgtttactgctttgaggttaccatgaggcttgcaaatactatcctataacctattcttttaacctgataatgacactatttgcataaacaaacaagcaaaaataaaactaataaaaactctataccttaactttgtccccctgctttttagctttttgttatgtataattatatcttattatattatgtcttagataattgctgtagttattatttttgattggttcattgtttagtctacttagaataagagtagtttacacaccatggttacagtgttataatattctgtgtttttctgtgtacctaccattaccagtgagttttgtacctccaggtgattatttattgctcattaatgtccttttatttctgacctgtcctacaagaaataactttaacatttgtaggacaagtctagtattaatgaaatccctcagcttttgtttatctgggaaagtatttcgccttcatgtttgcagggtatttttactggacatactattctaggatgaattttttttccttcagctctttaaatatgtcatgtcactctctcctggcctgtaaggtttcccctgaaaagtctgctgccagacgtattggacctccattgtatgttatttgtttcttttctcttgctgtttttagaatcttttctttatccttgacctttgagaatttgattattaaattccttaaggtagtcttttttggggttaaatctgcttggtgttctataaccttcttgtactttgatatttatatctttctgtaggtttgggaagttctctgttattatccctt

SEQ ID NO: 494 - DNA, 2270 bp, Homo sapiens
gtgcccaacttctgcgctgccctcaaccgcatgcggaagagcacacagtccgacgtggccttcttcaggttcccgcggtacccggccagatgccagaagtgggtagagaattgtaggagagcagatttagaaggtaaaacacatgatcagctaaataaacgttatcgattatgtgccaaacattttgcgacctctatgatttgtagaactagtccttataggacagttcttcgagataatgcaatatcaacaatatttgatcttaccagtcatttgaacaacccacgtagtagacacagaaaacaaataaaaaactgagtgaagacgaaatcaggacactgaaacagaaaaaaaaattgatgaaacttctgagcaggaacaaaaacagaaagaaaccaacaatagcaatgctcagaatcccagtgaagaagagggtgaagggcaagatgaggacattttgcctctaacccttgaagagaaggaaaacaaggaatacctaaaatctctatttgaaatcttgattctgatgggaaggcaaaacatacctctggatggacatgaagctgatgaaatcccagaaggtctctactccagataactttcaagcactgctggagtgcggaataaattctggtgaagaggttctgagaaagcggtttgagacaacagcagttaaaatgttgttttgttcaaaaacacagcagaggcagttctagagatctgtgagaactgtattggagaagaaactctcagggaagtgagagactcacacttcttttccattgtcattgacgacatagtggacatcagaggaagagcacctacctgtgttggtgaggtttgttgatgaatctcataacctatgagaggaatttgtaggcttcctgccttatgaagctgaagcagaaattatggctgtgaaatttcacactatgataactgagaagtggggattaaatatggagtattgtcgtgaccaggcttacattgtgtctagtggattttcttccaaaatgaaaattgttgcttccagacttttaaagaaatatccccaagctatccacacaatctactcttcctgtgccttaaatatgtggttggcaaaatcagtacctgttatgggagtatctgttgcattaggaacaattgaggaagtgtgttcttttttccatggatcaccacaactgcttttagaacttgacaatgtaatttctggttgttttttttttcagaatagtaaagaaaggggtaaagaactgaaggaaatctgccattctcagtggacaggcaggcctaatgcttttgaaattttagtggaactcctgcaagcacttgttttatgtttagatggtagaaatagtgacacaaatattaatggaataactgtataactggccaagcatttgtactctgcagtgcagtaacagattttgatttcattgttgctattgttgttcttaaaagtgtcctatcttttacaagagcctttcggaaaaacctccaggcgcaaacctctgatgtcttctttgcagccggtggcttgactgcagtattgcattcactcaacgaagtgatggaaaatattgaagtttatcatgaattttggtttgaggaagccacaaatttggcaaccaaacttgatattcaaatgaaactccctaggacattccgcagagctcaccagggtaacttggaatctcagctaacctctgagagttactataaagaaatcctaagtgtcccaacagtggagcacattattcaggaacttaaagacatattctcagaacagcacctcaaagctcttaaatgcttatctctggtaccctcagtcatgggacaactcaaagtcaatacgttggaggaacaccatgctgacctgtatagtagtgacttacccaatcccaacatggtctcagccgagcttcattgttggagaatcaaatggaaacacaggaggaaaaatatacagcttccatccaccatctatgaagccctccacatgcctgacatttttttcctaatgtgtatgcattgctgaaggtcctgtgatgaaggttgagaatgagcagtatgaaaacggatgaaagcgtcttaaggcctatttggggaacactttgacagaccaaaggtcgagtaacttggctttgcttaacataaattttgatataaaaaatgacctggatttaatggtggacacatacgttaaactctatacaagtaagtcagagcttcccacagataattcagaaactgtggaaaatacgtaa

SEQ ID NO: 495 - DNA, 5914 bp, Homo sapiens
ctccagcctgggcaacaagagcaaaactccgtctcaaaaaaagaaaaaacgcagagccctcatgaatgggattagtgtccttatcaaagagactccagaaattccttacctcttccgccatgtgaggacacaatgagaagatggctgtctataaaccaggaatctggctctcactagacaccaaatcacaccttgatcttggacttcccagcctccagaatggtaagaaatagagctatattgtttattaactattcagtctatggtgttttgttacagcagcccaaacaacaagggcccacgtggcttagtattttgcttgcatatactttgagggaattattttgtaaaataaatgggccgggcatggtggctcacacctgtaatccaagcactttgggaggtcaaggtgggcagatcacttaaagtcaggagttaagaccagcctggccaacatggtgaaaccccacctctattaaaaatataaaaattagccgggcatggtggcaggcgcctgtaatccaagctactggggaggctgaggcaggagaatctcttgaacctgggaggcagaggtggcagtgagccaagattgcgccatcgcattccagcctgggcaacaagagcgaaactctgtctgaaaataaaataaaaactaggccaggcatggtggctcatgcttataattccagcactttgggaggctgaggtgggtggatcacctgcggtcagcagttccagaccagcctggctaacatggcaaaaccccatctctactaaaaatacaaaaattagctgggcatagtggtgcatgcctgtaatgctagctactcgggagactgaggcacaagaatctcttgaacctgggaggcagaggttgcagtgaaccaagatcgtgccactgcactccagcctagatgacagagactctgtctccaaaaaacaaaacatattaaaactagctgggcaagttaatcctgtaatcccagctattcaggaggctgagacaggagaatcatttgaacccgggaggcggaggttgcagttagccgaggttgcagtgagccgagattgcaccactgcactccaagctgagtgacagagcgagactctgtctcaaaaataaataaatgacagtgtgtagactatggtgcgatggtcacaaacccagtcttttcaggagcaggaaacttaaggcaggtggaatgaactggaaccgtttttgttgttgttctagctgattgttgctagatcttaagaattttttcaggagaagcaagaaaattaggtatttatatacatgtctgtgggccacatttaaacacagccctttaattctcactgtctggactagcaaaataaagatgggttttggcattagaccgaagtgtgaattttggcaccaggatgtcctagttgtgtgatgttgggtaggtaacttcattctcaaagtgtcagtgtcctctcctttgaaatgagggcagctctgcccacttggcaatggggttgtgataggtataggagggctgtctaccacacatgcagtgactagcacttaggaaactccagctgaggtcgtctgtctgccagcttctaagtgactccttccaatttgctagtcccattttccagagcttttgctaataaacatgactgtcctcaggagaagcctattgggcagatgtttgtagagtgtcatgctgcacaccaggtgtctgcacatgtgtttgcaccgctccatcccacatctggaagcaacagctccaggtgaaggagcaaagctgtcgatcacagaggtgtatgtggatcctccgaccaaactgtggctttgcttcctcagtgtcagccaccaggattggttttaggtgtgttaggccattcttgcattgctataaataaatagctgagactgggtaatttataagaaaagacatttggctaggcaaggtggctcacgcctgtaatcccagcactttgagagcccaaggccggtggattacttgaggtcagaagttcgagaccagcctgaccaacatggtgaaaccccgtctctactaaaaatacaaaaaaaaattagccaggcgtggtggtgggcacctgtaatcccagctactcaggaggctgaggcaggagaatcacttgaacctgggaggtggaggttgcagtgagcagagatcttgccactgcacttcagcctgggtgacagagtgagactctgtctcaaaaaaaaaaaaaaaaaaaagaaaagaaaagacgtttaattggctcacagttctgcaggctgtacaggaaacagtgctagcatctgcttctggggaggcctcaggaagctttactcatgatggaaggtgaagcgggagcaggcgtctcacatggtgaaagcaggagcaagagagagagtggaggcaggtgccacacaccttgaaatgaccagatattgtgaaaactatcacgaagacagtaccaatcatgagggatctgccccatgatccaaacacctcccacgaggcctcacctccagcatttaggattataattcaacttgagatttgggcagggacaaacatccaaactataagaaataaggatgaaaaagggaatcagttgtacattttaaggctttccttttttctgtttaaggaagaatgagtcttttgagaataagaacatttatattgcctccttccaaattctccttgaaagagatcctctggccacctttgggattgcacaagcctgtctcatgccctctttggggccagtgtgtttcagctgctgctgcaaaagtaagatgtgtcagtgcttgttaagtaggctctcagttccaggtaagagcagtcatacacctagatgccatcaatgtgccaggcattttgctctgcagccggggtacaaggataagggagagtcctcatgttgctcctgagtaaaggaggatggcaagtgacttcatagtgaaagagtgcagtgtgaggatgactgtgacaaaggtctaatacccaacctgggagaagggtgcagggttcttagtaaacaactggtgaaggggaaatattagtggctagcaagcaaaaagaattgggggtacatttggcaacagtttagagggaagggtatttacagtggagagacatcataatcaaaggctagaggtgagagcacagcatggctgggctagtggagtatgggggacgctggggatgaggctggaggtcacagcagggaggactctgagtgccttgcaaaggagaatagttttatcctgaccgctctgcacttcagtgattttgagagatgggtgctaagatgaagttacattttacaaagataactctttgctgtagcaaggagaacagactgcaggagcagggatggtggtgaggtgaccatagttgggggattactgtagtaacttcaagagaaatgatgaggcccaggcaatagaggcttgaggaaccacagtgaggggctgacttcagaaacaggcagagggcgaggtgagtgcagggagtggaagagggagtggttgaagatgactcccaggttgtcgtgttggtgacagaatggaacgctgtgccatggatcgtgaaatgggacccaggaagagaagctggtgttggggggccaggagatgtaggcaggggatgtgcccagtttcagaggttaagattttggcaggataagggcccatagtgggcatttacacggactggtttagtgctcaggagagagatgacattgagataaaaattttggagtcatcattaaagacatgggttagatgaaatcatctacagagaatgtgcagatagagaagaggagacactggtgaggagggaaccctggggaaatggagacttcaggagcgggtagaaaagcatagaaacgagagtgactgagagaccagaggaaaatcaggagaaagccaattaggagcttccaggagagagtaacgtaaagtataggggaggatcccttgaggccaggagtttgagaccaacctggcaacatagtgacaccccattgctacaaaaaaaaaaaatgaaaattagctgggtgtggtggcaagtatccacgggcgggggacaaggttattttggtaagcctagcaaactctggggcagagaagtggaggggtagaagcttgcctatcttgagctgaggagggaggaggaagtgagaaatggaggcagccagatgctctcctttgagaaggacctaattcctattctcattggtgtaacttaaaaacaaaacaaaagtgattaaatatttcaaacataaaagtaaaatgaagctgggcatggtgatatgtgcctgtaatccaagttacaggaagccaaggtgcaagggtcgtttgagcccaggaattcaagaccagcctgggcaacccagtgagaccctgtgtctttaaaaaaaaagaaaagaaaagaaaagaaacactcatgacccaattaacagtaaacattttgctgtctttgcgtcaggtttttactttttggacaaaacatgactagtgtttgaaaccccacatttaccctttcctgatcccatttccctccctccatgaggtaaccaccatcctgaatttgatgtttcattcccttgcgtggtttatacttttattacataagtttatatctataagcaataaatataattgttttgcaaatttttaaagtttattatagagatggatcatgctgaatatactgcctcttgcttttttcattatcagtactgttttggagatttatttatgttggcacatgtggctctagttatttcaactgctatatagtattcctttgtataaatataccacattatctctccattctcctgtggtggacatttagttggtttccaattttttgttcaaacaaggttgcaatgatcattcttctacatgtctcttgtacacatgtagggatatttctggaatatataactaaaagtggaacttgctaagccatggattacaggcaccttcaacttcactagatacagtgtcaaactttttcccaaagtgatggtaccagtttacatacaaaatagccatttatgacaattctagatgcttcacgtcctcaccaatatttcatttgttgaaaatttaatttcggccaatttgatgcagttatattctatagtttcctttagatttttacaaggccaccaataatgtagtgtagataccacacaactctaggaggtgctgttcacattttagtctttgtgaacggtgcattctagagttggtacaataacagtggtcttgagtgatgttaagaattttgtttattgacctgttaggttttctcttttgtaggaattacacaaaataattgattatatacatatgaaaaaatagattcctatattaattatacataaaataaattcaaggtaaattaaagagctaaatgccaggccgggcatggtagcttaagcctggccagcactttgtggggctgaggcaggaggattgcttaaacccacgaatttgaggctgcagtgagctatgaacatgccactgcactccagcctgggcagcagagcgagaccccatctctttaaaaaaataaaaactttacgatttttctatgttaataaatgagatctataatttcttttttctcttacactgtctttttgtttctgtgggttttgttttgctttggacacagggtttcactctgtcacccaggctggagtaaagtggcacgatcatcactcactgcaagcttaaactcctgggctcaattgatcctcccaccttggcctcccaaagtgttgggatgggattacaggcatgagccactgtgcatggcctcatgttgtctttataaagttttaacactgagatttggtaaaattgacaaatccactgttattgactgatattccaaat

SEQ ID NO: 496 - DNA, 4068 bp, Homo sapiens
agctgccagtctcattgttgctcttttgtagataatgtgtcttttttcttctggctggtttttccatcttctctgtctttggttcagcagttttattgtgagttgcataattgtggttttctctatacttatcctgcttgagggtttgctgagcttcttaaccagtgggttaaatgtattttatctgctttagaaaattcccaaccattatccctttgaatattgcttctgctctatttctttctccttgccctctgaaacttcagttttacatggtagacctttcatacttgtcctgtatgtctcttacatttgtttcttattttttctctttctttttttcttccatgcttcactttgtatatttttcattgatatgtttccagttcacaagtcttgtattcaatagtgtccaacctattgttaaactcatatattgagtttttaaatttaattttgaaataatttactttgaaatatttttatcagaaaagttgcaagaacagtagaatgaactcccacattctcttcatccagattcctcagttaatagtttcatattttctccatctctttttgtaaagatgatagatagatagatagatagatagatagatagatagatagatagatgtgtattttcaaggatatgataccttttttgaatattttgagagcaagttaagcaagttgaaacctttatgtcctatcatctgtaaatattcctattactacttctcccaaagacactctcctacagagtaattgccaagcctttcaaatcagaaaatggacagcgataaataccagcattcaaaccacagttcattattatccaacgttccaggcttatcttgaaatttctctacctccatccttgaatcatccacttttacaaggagtccttgttgtttgttatggaaattggaacctacatacttgttattaattgctactggggtgtcattgcacctaggtcctctccatggtcagaattttgaaatatatgtatgtattcatggatatgtacacagacatattcacttgcattgataattttttttgtttctttcctcccttccctttcactctttccttctttccttccttttgctctttccttccttccttcttccttcttaccataacaatagcaatgagttatttttttcgcttccccttttcatatttgtaaatttgttttcccacagagagaaatccagcttccattagcttcaatatagatactttcttgatcaatcctcctttacataattaatttcctaaaaatgctaggtactgccatggccaactcatcactcctgatttcatctccaggcaagttgtcacttttgaactcttctccccaccaaaccctggtctgtttgatatgccactgcctccatgcccctgtctccaccttctggctgttagacacattgttaactgtgcaccccaacttactcttaccttcacctccctggtgcttcttctgctgagcatacaactgccaccatatgtaccccctatacatgcttccttggacaccaggcactctgctgcctccacatggctttcccattatgacttcttttgcccctatgcacatcactatctgtatgcccgccaccctactttcttggctgttggacacactgctatctctactgatcctttccactgcagttttctccatatattgatttcttaactgacgatagtatattttttcaaatttagaatgcctaaagaaatcttttttataggttagttttactgaaaattgtccatttcctcatcaattttgcactttattttcttaaacatattcataaaaattatttgtaaattctcatttgctgattacaatatcttgatcatctataattgtgtttctattgtgtgtgtttttttctcttgattattgggcaaatgaacttgatcttccacatctagtaatttaaaaaatgttagacattatgtataataaaaccataaagggtccagatgatattgccttccaccgaaagtgttccctttttcttctgttgggcaggtagaatagcctttgatcacctcaatcgagtcagagattattctgaatcagaagctggtttcagttttgctaagtgtacctccgattcacttctgttcttagggtgtagccctccagggctttcaattgagagcctggtggatctctgtcttccagccctaaaagataacagcaagttttcagtttagctctttaacctcctgctccataaagcttcaaaattcagcaactcgcttgaaaggaagactggcaatgtgtttgggacactctatagtcttctgtgaagaatagagatctcttttgttgttttctttgagggacagcctgtagctttgctcagaatctgtaaatattcccatcaaaaaaccacctgtaaattaccaatgtcaattccctactccctcttatgtttttatattttacttcttttgttttggggctcctcttttccatagcagttcgttgattctctagcaccatgacactgtgggggacttcactttgcatttcagaagtttggggactactgttttagcctccatacagtctcagaattcagttaatgtcttaatcatgtatttagggtttctcacaccttcagtgagtcaccaaagccccatataactgctaaaagttttgttagtttaacttttttccgcagctgcatctttctgcctggactcagcctcatccttagcctgcactccaacctggcaattttgccaagaggaaaaaattgtggacatcatcaagtcattactggaaagttctcacttctctggaattttaatccatttagttcttgtttttaaaaccctctgattcctttataaatatataatttacctaggtttttctcgttgttagtccaagtgttggcctgccacactgactatatcctttctggaaatagaaattctctctgttgcccttaatgaatttaaaaaaatattttataccactttattgtttattcttagtccaaaacatgttttctaccattgttggaagcagaagttctggaattggtttctatatattttcagatcccgtaaaaatgaattaaggtgaatttgattaatgtaaattagatttatgtgaataaaggataaatagttaagttcatcattgttgcaattagagaagtggtacaggttccccattctagcactgagtatttgaaatcatacctctgctaagatcctgcaaatatttcagctcactccctgtgtgcattgacacatattatcagccctctcttttcttatattaaacagggccacaagatgcaacacacgctttctcattgcttcacaattttttcttctttcactttcattcagtcacttcatatcagctatgtgttaagcataggagatttgtcagtgaaaaaagtatcaaactcctcatctttatggagattacattgtagtaggaagagacaaacaataaacaagagcaataacacgcttcatagtagacatataattccaagcatgtgtacctattagtcttaaatacaggagagacactcaagacagaaataaaatgtaataaaatccaaaccctacagtctgcaggggacttggacaagaccccaagattcttcaaggataggatagggggggacaacctgtaacaattaatgaaggtgtagtattcagctcttctatttctactgataaagttctttctccatacattataaaacttagattgttattgttttaaattgggaaggttgaaaatgttgtgatgtacaggaataaggaaaatgaattcttacggtctgtatatcttggtttaaaaaatgtatgccctggagttaagtttcaggtgccattttcccctctcctatgagtctatcccatacaaatgttgtaacatctccccagtttctactggttagatcagtatttgtttttgtttccagaattttctgatttcttgctgatccatgaaataggaacttcttcttaccttctgaaaatattaaaaggagacttacaccc

SEQ ID NO: 497 - DNA, 3620 bp, Homo sapiens
ttaacatgaggatgtctgggaggactgattcctaagagatccagtggctctgattaggttttttcttcagaggaacataattagggtctaatctcacccaacaggtcagcccctcctgcgccttgagcccctgccacacagattcaggtagccacgacatgagtggaccaaactagttcagggagtaattgccctggaaagctaggtccacaagcagaacccattgggtctgacacactccttgaattggttaaattcaaaggaaaactctgaattctggggaacaaggcctctaagttggcttaagcctctgcagctgcagaacatgaagttctacccttagaaactcccgctgggtatatgcaaaatacttatggtaaatcattcaaatatttagtcaagtggatgttgagttctaattagggataagaagtcaggctggtgggagcaggagaaagcaagaacaaaaaccaaataagccataaatctgcctttttttcgtggtccaggacacacagccctactgcgcaaataagtcacaatcttcctgcacccagctgtcaccagacatcttaactaatcaaaaagaacacgtaagttagctcactgcaaccttgctgttatcagtattgcacacagccctcttcagcacacagcacaaagaccatcctataaaatcctcaggatgcctttgtctccttgcagttagctcctcttttgctgacttgcctgttgcttttttgaaacacatttccctactttgtctaataaatctgccttttaaaaatctgcaaccattttggtaagtattttttaccacccatgcaacatcagccccagatagtcaatacctgtgacagtggcccattataaccacagaggttctaacttaacagtggcctagatggggatcatctgagatgcccaaattagtgtacctgggaactaggatggaaaatgcatgcacaaaaactcaacagccagaatgggagagctactttcagtggtacctagagaggtagcaaaaagggggaagactgcctcacctccttacaggaggccaacaaacaacttagagatactaactgataactctctagtgctttatctctcttaaagaaatcttcagaattgcttacatcccccttggttcttcccccacctccaggtacatccccagcttactccgacctctctgaacttcctggaccagatctgtttcctctgcctgcatgctctagcctaccatcttcctctccttgtctgctactcactcaacagaaggcaacagggtggtctacttctacaactccgtctcctgatgatttcacaacagtctccctggcagcctttcatctggaagaagtggaaaagggggaacctgtaggaacatctctcatgatcacaccatatagggaatgaccagtaacaggtagggaaaccccagtgatggtctttcaaacctggtcaaaggctgagctaggaggcaaagttaaaaaatttcctgactcccataaagatttgcccaagaatttgagctcattgtcaggtcactcgtcatatggcccgtgtcattcagacccttaccagctgttccacatgttggttttggatgctaaagctaaggaatggctggaaaaagcacagtggtcagaccatttagcagagtcaatttccaaaggtccaataggatgacaacaagtccccaaaagttcagaagacaggctcaaagatgccaaggcatgagccactgctctgttaattataattccttcagcattccaaaggtttgtggattggaataaaatccagcaatgccaccagaacccaaaggaattagtttgagattatttttcatgttttgataaaactttgagacaatattatgggatgtcagctgattgccttgagaacaataaaaatggcgcttattaaatgcaaactttcaaaacagaccagatgatgatttagccactcttgtaaaacaccacataacaaattgggccatggtcagaactaaggaactagttaacttagctgaccaattatcctgtgctatgataaaggaaaaaaaaaacaaaagactgccagagttatgcatttatagttaaagcaattaacttctcaaacctgttagcctcagaataatgaaaagccctctcggtctgaggactcttccctcagcctgttactattgtaaaagaccaagacaccttaaacaggactgctttaggtggaagtggaagccacagcaggaggatacaactcaggaagactaggggtgctctgaggaagttaaagggtttcacctctcccagtattctaccttgacaaattgggaaagattaatataatcataacgtgagctctccattgccttacttgacataggagcaactatatctgtcataaatcccacctgctttagaaaccatgttcctcagagtaataaaaggactagcatgatgggtgtgtctaagaaaactatctcatgctttaaatccaaacctataccttaccgttttgtcaggtttagcaccccctcaatcaagggccctaaatacaacagtcagtcagtcccatgtgttcctaatatgctgggtaagtgtctgttttgtggaccagccttctctttgttcagtttccagagtcaagactaggagaaaatactagaaaagtcttttttggtcaaggcatcaagtcacattccctactcatcgtctaaaggtgagcctgccgcattatcacggatgctgtgatgggcaggtgtgttcgtagtcctctgaaaatagtggatttcttacgtgtgaggttccttggctgtgaccaacacatggcaggtgcaccttccatctggctgctctgttttgtgcagtgagacttggaaggagtgtgggggaccaaggagaatgaacatgcacatgaagcccatcctggctgctgtgccacgagaaagctgacctcaggtgatccacctgccttggcctcccgaagtgttgggattacaggtgtgagccacgatgccaggcctgtagagctcctctttagaaactgtgtgcagagggcagggcacagtggctcatgcctgttatcccagcactttgcaaggctgagatgagaggactgcttgaggccagcctgggcaacatagagagaccttaaaaatacaaaaaattagccaggcgtggtggcgggtgcctgtagtcccagctactctggaggctgaggcaggagaatggtgtgaacccgggaggcagagcttgtgagtagctgggattacaggcatgtgccaccacacctggctaatttttgtatttttagtcgagatggggttttaccatgttggccagactggtctcgaactcctgacctcaggtgatctgccaacctcagcctcccaaagtgctgggattacaggcatgagccaccacgcctggctctctttttttgagacaaggtttcactttgttgccaaggctggagtgcaatggagcaatctcggctcactgtaacctctgcctcctgggttcaagtgattctcctgccttagcctcctgagtagctgagacgagaggtgcacaccaccaagctcggctaattttgtatttttagtagagaca

SEQ ID NO: 498 - DNA, 6205 bp, Homo sapiens
attcttccaaacagaactgatctggcatgaaggagagagaagaggtgtatgagtgaaattcatctgacaagaaaaagaaagcaagagtgccactgggttagggtctccccgaccgagctggtctcggcaagtggcgtccatcgtgggggctcgaatccaagtcaaaggattgctggagcgacggttggaatggaaaactagctggaggacacccgagtactcttaaagcaatccccgtggtgagtaagaaggggagctcagaagcgtcagggtaatgatgggacaggtatggtgtctggtttgtatcaccttggaactttttcacactgataatgaggaggaacaagagtatagcgaagtaacaaaagaggttacagagcatgtttatttaccagctaaagctaaagcggcaaaggaaggagaggttcatccctacccttctgcaccccctccttattattttgaagacaaagaccctccagatctttcttttctggaggacactgggcaaaaagtagttgccccagtgactgttcaagcagccccttgagcgacggctcttagttctattcaggcaggaattcagcaagctagacgagagggtgatttagaggcttggcagttccctgttagaatacaccccccagatcaacagggaaatattatagctacatttgagccttttccttttaaattcgggaaagcacattcagttgattatatcaaggcctgtgatggtatcggaggtaatctgcataaagctactttgttggcacaggcactggcaggactgagagtggataaaggaaatactccatttcctggagcttgttttaactgtgggaagcatggtcatactaaaaaagaatgtagaaaaaatcagcgagtcaggctgccagataggggaaaaaagaaaactgttgagcctgaaatatgtccaaaatgtaaaaaaggaaaacattgggctagtcagtgtcactctaagtttgataaagaaagaaacccaatttcaggaaatgccatgaggggcccatcccgggccctgttctaaaccagggcatttccagctcaggccattccctcacccctgtacaatgtctgttccctgccacagctagtagtgccacagtagatttatgctgcacaaaagctgtgagccttctgcctggggaacccctgcaaaaggtcccaacaggagtctgtggacccttgccagcagggacaataggattacttttaggaaggtctagtgtaagtttaaaaggagtacaaatacatacaggagtcatttatttagattacaatggggaaactcaaattgttgtgtctacttctgttccctggaaagcagagccaggagagtgcatagcacagctcctgattgtgccacatgtgggaatgggaaaaagtgaaattaaacaaacaggaggatttggaagcacaaataaacaaggcaaagcagcttattgggtaaatcaaattactgataaacgtcctacctgtgaaataactattcagggaaagaaatttaaaggtttgatagatacaggagtggacatttcaatcatttctctacagcactggccatccacatggccaattcaacctgctcaatttaacatagttggagttggtaaagctactgaagtatatcaaagtagttatattttgcattgtgaggggcctgatggacaacctgggactattcaaccaattataacttctgtacctataaatttatggggaagagacttattacaacaatggggaacacaagttctaattccagaacaattatatagccctcaaagtcaacatacaatgcatgaaatggggtatgtccctggtatgggactagaaaaaaatttgcaaggtttgaaaaaactgcttcaagcagaaaaacaaagttcccgccaaagattaggaaataatttttgatggtggccattgttaagcctccagaacctatacctttaaaatggttaacagataagccaatttggatagaacaatggccgctaagtaaagagaaactggaggctttagagaaattagttattgaacaattagaaaatgggcacatagctccaacattttccccttggaattctccagttttcataattaagaaaaaatcaggtaaatggagaatgttaactgacttaagagccatcagttcagttatacaaactatgggagcattacagccaggattgccttctcctgctataattccaaaaaattggactttaatagtcatagatttaaaagactgtttctttactatccctttagctgagcaagactgtgaatggtttgcatttacaattcctgcagtaaacatcctgcagcctgctaagcattatcactggaaagtgttgccacagggcatgtcaaacagcccaacaatttgccagacatatgtggggcaagcaactgaacctattcttaaaaaattttcatagtgttacattattcactatatggatgatatactttgtgctgccccaactccagaaatattactccaatgttatgatcacttgcaaaattcgatttctcatgctggtttaattatagctcctgacaaaattcacactactactgcttactcctacttggggaccttagtgaatgacactaccattgtgctacagaaagtaaccatacatagggatcaactaaaaacattaaatgactttcaaaaattactaggggatgttaattggatacgacctgctctaggcattcctacctatgccatgagcaatctgttttctatccttagaggaaatcctagtctcactaaccctcagcaattaacaaaggaggctgaggcagagttacaactgattgagaagcaagtccataaagctcagataaatagaatagatccagagaagactctagatttgctaatttttcaactcagcattcacctactgctgttattgtccaagaacaagacttagtagagtggctttttcttccacatactaattcacagactctaactccttatttagatcaaatcaccatgatagggattggagaactcgaattgttaaattacatggatatgatcctggaaaaattattgtccctctcacgaaggcacaaatacagcaagcttttataaatagtcttacttggcgaacccatttagctgactttgtgggtattctcaataatcattttcctaaaattaagctgtttcagtttttgaaattaactaattggattctccctaaaacaactaaatttaaaccaatttaaggtgctgagaatgtttttacaaatgggtctagtaatggtaaagcttcttattctggctcaaaaagtaaagttttccagacgtcctatacttcagctcaaaaagcggatcttgtagctgtaattgaggtattgactgcttttgatatgcctattaatgtgatttctgattcttcatacatggttcactccacacagctaattgaaaattctcagttatgatttcatacagatgaacaactgatgactttatttacccagttgcaaacagcagttaggagtagaatgcacctttttacatcactcacattggagctcgtatacctgttccaggacctttgactgaagggaatcaaatggctgattgcctagttgctaatgcaatatctaatgctagacactttcacaatttaacccatgttaatgcctctggtctcaaacgcagatacagcattacctggaaagaagctaaagctattatccagcaatgcccaacttgccaaatggtacattcctcatcttttacaggaggagttaatcctcgaggactggaacctaactctctttggcaaatggatgtcacacatgttccctcatttgggagactagcttatgtacatgtatgtgtggacaccttttctcactttgtctgggctacataccaatcaggagagtcttctgcctgtgttaaacgtcatcttttgcagtgttttgcggtgatgggcattccagcttctagtaaaacagataatgccccaggctatactggccaagctctagctacatttttctctatgtggaatagtaaacacattactggtatcccatacaattctcaagaacaagccatagtggaaagaatgaatctctccctaaaacagcagttgcaaaagcagaaaggaagagacagagaatatggaaccccacagatgcaactgaacctagcattattaactttaaattttttgagcctgcccaaaggccagatgttttcagcagctgaacagcatctacagaaaccagctgcaaagacaaaaacagaacaactgatttggtggagagatctgataacaaaaagttgggaaataggtaaaataataacttggggtagaggttatgcttatatttctccaggacaaaatcaacagccaatttggataccatcaagacacctgaaaccttatcatgagccagatgccgaggaagagactccaggaagatcccaaggacaccccagttgcagccatgtcgagactgatgctgaggaggaccccaactgtcacgagcaacacccgtcgaacacagccacccacctgtggacagatcaagaagctgtcacagatggcggaagaaaacctgaggaaagcgggacaaacagtcacaatgaataatttaatcgtagctatgatagcggttatcaccactgccatgagtaatccttcaataaggactggcaataatgcctggatgcaatcactctatgacacagttacacatactttctgatctcagtatttaccataataaatctgctcctatcattgaggcataccaccctcaaaaaactatttgtaaacaggattggacccagttagaaaaaatgaatgtacttgtttaggaagattgctttgcagaacaggcagaggtgctgcacaatgattcctatggaatcattattaattggtcccctaaggggatgtttagcttgatttgcacctctcagtctgcatgccatggtcacactatgttcagatgatctgaacaaaatggtcagatggtagaaatgataagaagtacggcaaaagttcctgttatctgtaaccatgatggtatagtggcacctcaacctcaaatgatatggcccgctctaggagctaaacataaggatttgtggaaactattaaatgcaaactttgggaaagaataaaaaagcatctagaaggacactctacaaacttgtttttggatatagcaaaattaaagaacaaatgtttaaagcatcccagggacacctgaccttaatgccaagaactggagtgcttaaaggagctgcagacaaattagcagctagtaacccattaaaatggataaaaacacttggaagctctgtgatttcaatgatgactatgcttttaatatgtgttgtttttgtatagtctgcagatgcagatcccgactcctgcgagaagtagctcaccatgacaaagctgcccttgcttttatcgatttgcacatcagagaagggggacatgttgggagcaagccccccaaaatctggccataaactggccccaagactggccataaacaaaatctctgcagcactgtaacatgttcgtaatggccctaacacccacgtgcaaagttgtgggtttacgggaatgagggcaagaacacctggcccgcccaaggcagaaaactgcttaaaggcattcttaagccacaaacaatagttgcagtgatctgtgccttaaaggcatgttcctgctgcagttaactagcccaacctattcctttaattcggcccatcccttcgtttcccataagggatacttttagttaatttaatatctatagaaacaatgctaatgactggtttgctgttaataaacacgtgggtaaatctctgttcagggcttacggctctgaaggctgtgagacccctgatttcccacttcacacctctatattttggtgtgtgtgtctgtaattcctctagcaccactgggttaggatctccccagccgagctggtctcagcaaatataggcctggggaaattgggcttgaactagtgaaagcacttgcccaatataaagctggcagattgtagggctatttagcattctctaaggaagtactttccattgataatgagctgcaggctcctgattattgatagatggtacagtaaaagcaaattttttgcaacc

SEQ ID NO: 499 - DNA, 2379 bp, Homo sapiens
caaccagtcaatgcgggagccttctcagctggacccagggccacacctctgcccaccggctcacacctgggccatgcaaggcggggtggatgcacctgcctggcccttgagcgcgtgggggagccaccgttgcccacttgggaggctcagttctgaggtcgggattccaggcactcccttctcccccattccgaaacctcctgactggaagaactctctcggcacagccttttctttcagggtcccaaagtgcctgtgagcaggcagctcctgatctcctctgtgacacccacagactcaaagacacccatatgctcactcatgcagacaggcgctctcgcctgtggctctgaggctgagccggctttgccttggtgaaggacaaggccctggcgacccagattctctcgtgggtggctggggacagaagggcggtggcgcgctgggctggctggagggctcaggctccggcgcgagtcctgcaaggatgctgcctccaagtgtgcttgtgggtggcggatcccagggcctgccgggagagtgtccactcctcaggaggcctggctgctcagcggcgcccctctgtggcgagactcgcccaggcccatgtccggcccatctcgccccagccaggctcccctgggcagcctcaggacagagaaccctgaattcagagggaggctggaggtgtggggcctctaggcacttgcagggtggagctaccccacacccagggctcaccctcagacctacccaggcgtctccagcctcacgctcccagaggtaaggaaggggcttcaggaaggtgggggctacctccccgcccagtaccgtcaggctctgaattcgtacctgggaactctgccttggctgacttggggaccccttcactgctcagccttcccctctcttcctgccgggcggtccacctaagctccctgactcttcccacgcggccctgggtcccctccccacaggctgttccctgcacccgcgggtgggactggacctttccctgcacgtccagtctgtttcccgcggtcttcctccgtctgaccctggcagcccgctcctctggccccgggctgtgtggggaccgctttcccccaggcccgtcgtcagtgtcctgagctccgccgactcccgcccattggcgtcgcaggcctggtgacaagctgtcgctggcatctagggctcctgggactcaggcacatggagctccctcggggccaaatttgtgtcacgcgcagggacaccggaggcgcgtgcacagtccgtgtaacggctttgcttggcgcgtctccgtttctcttctgaggggctgagagtcgcggagtttcctagttggaggctgtggcggacgcgatttgcttcctcatatagggttccggaggcggcgaaaagtccagcgggtctccgaagccggtagacggagccatgaagaagacgtcgggcttcaggagggggaagggcgggctgccctggggctcggtcagcagccccgggaaggtgggcgcgggcgccgggagtgagagtgcggaccacgcctcctcccagcccaggcgccacgacccggacaaggggttcgacaggctccgcagagctgccggccgacaccggacagagacgatgcggcggatcctttctctgccgaagagtggcgtggatgacagagacgagaagaacaggctgtccaacgaacagagttctggtgactcatggctttcaatagatgatgaactctttgattctggtaccaagactacctttgagaatgttccacagaaatatgatagtcacttaactggagctgatgatggtcaaagaggaaaaattacaataaaggaacaagaaggaccacactctcagtagcaagggtatagctgtgccttcagagaaatctcgaagaagagcccttggatcaccactcaagacataacaggatcaagggaaagcatgattttccctttatttctgagcgtgtctctggccagaggggaaggagaaagagatgaagaaacagaaatcatcattggaagatactactgctaaatgaagagaagagaagtcatgggaatagtccatcaaaaggcggcagaaaggtcagaatcaggacaacagatctagagactacttttgcaaaggaagagggattgtgagtggaggaggagggaggaaagaaagaagttggctagttaattttggagttgataatagggaaacttgagagctgtcacttctagtgactgcaatatattggcactcaaacagaagattaggtgattgctgttccaggaattactggaaggagggagtgctagaatgggggtaaaccacaggaactaatttcttctctctgtaactatcagacatcaaaga

SEQ ID NO: 500 - DNA, 719 bp, Homo sapiens
taaggcgggcctgatggtcagagggaggaggaggatgggcagagggaggagagtctgatgccagagggaagaggttgatggtcaaagggcgcacagtgatgatcagagggaggaggatgatggccagagggggaagggtctgataattcgagggaggggtctcgaggctccatgtgaagtaggtctgatgaccagcgctcaaagttcataagtcagtctaataacctaaagaactatggacagtagaaagaatacagcgacatacaagagggctattacatactggacattataatctgtgcttcaagatattgttgccaattattacagcaaattgctaaagtgagtattattatgacttctattacccacatgaagaaacacaagctcacagagactaggaaacaggctcaaagtcactcagctagtaagtgatagggaatttaactcccatctctttctagtaacttaggtttattttatataatagatgggaggtatgcttgttaaaataagtcatttcaagatcatatcacaggtttgtaggccacttcttctttccttgactatatttggttctctttccagtgtgatttttaactggatcctcagtacccgaaattctttacatttccacgtcaccactgctgcccctccacaccacgccaccaccacctctgatcattctggccatgctacagtcctcgctcagaaacacg

SEQ ID NO: 501 - DNA, 1644 bp, Homo sapiens
gatggattagaggaagagaaaggcagaagtagagagaactatttaggaggtgagggcagttgtttaggcaagaagtagtggaggtttggactacagcagtgttgtggtgggagtggagagaaatttaagagcagtgtcaaaacttaaaggcactgttttgtttttttctttttaaatctaggtcattttataatttctgggccagagaatgggcagtaaggggaagaaaacctaagagaaaatatctaaatgtagacatggcttttacttactaaatttgtgaaggcattcatctataatacagttccaatttttttgaatttccttttctaaggatgcctattttttcctttgaaaatgaattatataacatagacaataattaaaaggccccagggtcaaaagctcttcccacaaataactgtccacacactattagttcatttcctatacactctcctggcaaggcccaacaaaagctaaaagaagatggatggactttgtagggtgacctgagggtcaactgattcagggagctgaactcatcaatacagacagcaaattccatcacagaattccatccactattagtagcatgtattaggttggtaaaaaagtaactgtggcttttgccattacttttaatggcaaaaatctataattacttttgcaccaaccaatacaaacctttcctgttgcaagcatccaactgtgcctcgaaaagtcaagtatagcatatttctcacaaagctgccccaaagtcaaggcccagccctttcttgccacagtggttttacaaatagcacatttagaacacaaatacctaatgcatgtggggcttcaaacctaaatgataggttgatgggtgcagcaaaccatcatggcacatgtatacctatgtaacaaacctgcatattctacacatgtatcccagaacttaaagtacaataaatctaaaaaaaaaaggaatataaaactgcatatgctttattaacaaaactattatggtggattaaatggtaccctttcaaaagatatgtctgcctctaaatgtgaccttatttggaaaaaggatctttgcagatgtaattacgaatcttaagatgagctcattctgggctagggtaggcctaaatccattgataggtccttataagagaagggaagggaaacagaatacacagggagaatggcatgtgatgatgcaggcagagacggaagtgatgcatccacaagccaagaacaccaaggattgccagcagccactggaggctcggagagaggcacagaacagtctccctcagagcctccagagggaaccaaccctaatgacaccttgattttggacttctagcctccacaaaaacagactagaaggaaatcacagactagtgctaagtgtactggtgattggcttataaagttgtgcttgttttttgcgtaaatcgctggactttgctgcattttccaaattgtctaaactgcatatttatcatccaacaatttgatcaaaattattttagaataagaagtacacctgccttaaaaatgtttttatcaaggagatacagaggactactagagggtagagaagaaaaaggagggcaaaggctgaaaaactacctattggatactatgcccact

SEQ ID NO: 502 - DNA, 2941 bp, Homo sapiens
gtggggctgcgctgcgggaaaggtgctgacgaggcgggcgcgcgagctcggcggggaggggtgcggccggtcggcggctggccggtccccgacttcccggcaccctgggcgaccgctccctcgtgcgagcgggaccacgcctggaccggggcccgcaggttttacagggcagcgggggggatttggggcacgtggggtcgggccgcaccccgacctcgagacggcgcggcgctgcgagcaaagagccgtcgcgcccggagccaggccccgccctacctgggatcccgtcgccctcccgtccccgggcctacacccgccccacctgggatccagtagccctcccgcccccgggcctacacccgccccggtcagctccggccaggtcggggaggaggagggcacgcgccgggaggaccgcgactggccgcctggagcccgtggctcaggctttcccagccgctgttttcccctttgtacatcgggatccgcttcgcacacttagtttctgcctagcacatgctgggtgttgtgtccagatacactaattctttttccccttcttccccgccagtcactagagccggtctggaagggcactaacgcctgggtagtccttcaaacaaaaagcgttgtgtgtcttgcttactggccgttaatagaagtttccccttgagagtggctttggttaggaaaaaggtggcaaagggcccatccctgaactgattagttgagcctgggacctgatcagaattgaggggaggagtgttaccagaattttctctgtgccccgcacttgcataagtgcttatggctaggagccctgtgtagggcacacattaccttggggcgcccttcgcttctttctcctcttgctgccccttcccggaatctctcacctcatgacgtgactatggtcaagtcatcgtttctgggatggcctgacccctggggacacgccagcctccaggagcttatatgaggctggtttaccagagtagacagtgtaaggccctgtcctggaaggaggaacatgaatatgtcctgaagtgcttgtgtcatgtgtcaggggttgtgctaggcttttcacatgagtgatctcatttgattcccacagcggtcctgtgagctagggggaatcatcatccctctatgtagttgaggaaactggttccgccggtttaagcaacttacctcacatttcacagtagggaggtgatggttgtagggctttggcaagaaagtgtcagtacctggtcaggcccctagggtgtgagacgctcagggccatcctggagggtatgggtgaaagcatgtaacaccgtgggtttccccccctctgtcaccccattctcttggccaccgctaccatttatatcaaggcaaaaccaggttaggtggcagatggatagtgttcgaggcagaagaagccccagagggcaaagacagggcaattccttctacccctcaccccacacacactttgctttggtcatggatgggttaatggaaggactcctgtgtatcagacttgggtcttttttagcaccatctggcagaagtcacctctcctcacacttgctgcttctacaaaacattgttcacttggcagtcagcagtgcaaaaggcagaagtgtggtgcgtgtgtgatttggattcagtggaccccagagacaattgtgttgtttgcattatgttgcgattgacagcccatagacactgctgtgttgtatgtggaaccacaaaagacgagaaaggcaacaaaagcagacgttccctctccttttaaaattatcttgtcgctgggcacggtgtctcatgcctgtaatcccagcactttgggaggccgaggcagacggatcacgaggtcaagatcgagaccatcctggcaaacataatgaaaccccgtctctactgaaaatacaaaaatcagctggacgtggtggcgcgtgcctgtagtcccagctattcaggaggctgaggcaggagaatcgcttgaaccagggaggcggagattacagtgagccgagattgcgccactgcactgcagcctggcaacagagcgagactctgtctccaaaaaaaaaaaaacaacttgcctgcaggattggatagagaaattcccaggagaaagcaaacaaataagggtgcaggcatttgtccttcaaaacaggcgggcagatcacaaggtcaggagccaagaccacgccattgccctccatcttgggcgagtgagactccgtctcaaataaaacaaacaaaaaatccccagggctttgtaggtagacgctttttggctttgaacaaggcaggtagcttcagtgtttcagatcaaggagtggatgtaggttgaagtgggcaaatcacttgaggtcagaagtttgagaccagcgtggccaacatggtgaaaccctgtctttactaagaataaaaacattagctgggtgtggtggcacacacttgtaatcccaactactccggaggctgaggtgggaggatggaggattgctcgaaccggaaggcgggggttgcagtgagccaagatcgcaccactgcactccagcctgagcaacagagcaggactccatctcagaaaaaaaaaaacaaaaacgagtggttgagcctgattgacccagggacacgttttgtttgtttgtttgttttttgttttgttttgttttgttttagatcaaggaccctctctgttgcccaggctaagtgcagtcgcacaattatagctcagttaacctcaaactcctggggtcaagccaccatcccacctcagcgtcctgagtagctaggaccacaacaagcacatgccacggcgcccggctaatttttaaaattttctgtagagatggggtctcgatacgctacccagcctggtctggaattcttggccttgagtgatcctctcgcctcagcctcccaaagcactaggatt

SEQ ID NO: 503 - DNA, 1167 bp, Homo sapiens
gaatattctggtgttcctatagatcaggttttgctgatttgggaaaataaagactatggatcaactaggaatactgttcatattaatgagaaaatgcttctgttagaaccttgttgaaggcacaattttgagttgatccagttcttgaactctgtagactctgataattctgaatctgttgttttgtcttttgctgatattttgtgtgtggcaaatgtcgaggaagccagttttctcagatttcaaaatagtatatggaaaaatgaagagaaaatgcaatgtgtccatcctttgcaactagtttgggatccagtgtcatctgctctaaaacacaacaaaccagtgaaaaatgatctgcttgtaaatgaagctgcaattaaaaaaaaaataggtgcccttgaagatgagctaacttttcttcactctcagattcctgcaattttggaaatgcaggaactgaaaaacagtacaaattctagttcctttggcttgaatgatgggcccattagtttgggacaaatgccatcatcacgggctgttcagctgagtggggagtcacacatatatatttgttctttactacatttatactctgttcctttgtagagtgtataataagccttaacataataaaaatcagtttccaagttcaatgctttcttctcctcctccactaccacttcctcctcagttttcttctctctagcttccatgttttcttcccatacaactaggatctaataatatttgtgactcagataatccagctactgaaatgaacaaacagcacccaggtgctagtatagtcatcatccaaaaagccacagaaataaagatgttctaaacatgttggatgttctagaggacataaataaagtgaagctctgtgcaattgaacagtcacctggtggcagatccattcataagaggaaaataaaaaattcatattgggatccgatgtctttaacgtctcatgcacttaagcagaaatttgcatttcaaaaagatgattcatttgagaaagaaaatagatcttaggagccttctccattttcttgtccagaaacttcaacatttggacatcacatttctcagtcagaaggacagtgaactaaggaagaactgataagcacaaaggctgttgaccaaggtatcagcaacaaaagc

SEQ ID NO: 504 - DNA, 1340 bp, Homo sapiens
agtcctgcttccaccccaaccagctaggtgctcatgaaagtgttctttgggcctcagttcccccatctgtaaaagaaggatgggtatgttagattttaaggtgggttctctgtgatttatttatttatttatttatttatttatttatttatttattttgagacggagtttcgctcttgttgcccaggctagagtacaatggcgaggtctcagctcactgcaacctccacctcccaggttcaagcaattctcctgcctcagcctcccaagtagctgggattacaggcacgtgccaccacactcaggtaatttttgtattttcagtacagacggggtttcaccatgttggccaggctggtctcaaactcttgacctcatgtgatccgcctgcctcggcctcccaaagtgctgggattataggtgtgagccaccgcgcctggccttctctgtaattcttgagttgtctttgttaattagcaggagagggaggcaggaacggagggaggagagacagattttaacagctgttctgcgtgagcccattttggcccccagattccctccatcccctagtctgttctcctttatggagttcactcccctctaatcccgtttctacctaggctaacccacccaggagagctttgaaatttcagtggagtcaaccacaattctacagcctttgaggaaaaggcctaataatgacgatagcctacagatgcaaagctcctcctgggagcacaaggtcttgcacctcttcgtgtcccttgaggtcccattcacagggaccggctgcaggcccaggagtgatttgcccgagggactgggctgggagtcaaaccaacatgtgtggactccagaacttttgactcttcagctagctttgtctttggcaccttccatctgtgtcctgggccacatcttcctggcttcagttgtttctttctctatctggcactcagggctcccaagctgaaggtcctgatgcttcagcatgagccaaagcattcccacctgagagagaccaggaaggaaggacaaaacgaggacccatggaggacaccaggcagtgtggcccctgcacccaccccactagctggacaggctactcagcattggtgacccctgcctgcctccaggtccctttccattcttggtgaccccaggcagagcccccaaagccagtatgctcgccaaagccccatgcagttggctagagcccaagccctccttttctgcagcgactccaccgggctgggctggggctcgagcttggccactttcctgggccgctgctgtatcgattattttggctccctttttgctggggatatcaattt

SEQ ID NO: 505 - DNA, 3337 bp, Homo sapiens
agagcgagctacgctgcaggagcgcagttaccagccggctgcgatcacgtgcctgggaggaggagctgagacctcaggggaggggcgcgcggtagcgtcccgggtcccctagcagggctctagagaccacgtgaagtctcctcgacagctgctttgcctcaggcataaatcagaagaggaaaaccagcttctggacctggagagaggatgaaagggaataggaattgagggaagcggaagggaagaataagggacccctggagagtccctaccaagccagacataacaaacaaaagtcctctactactgaggaagacagaacagggaagccagcaggggaagaaaaagatgctgctgctcttgatgcctcaaaaacagcaaggaagaacccaagcaactgatgtacacacccttggaacaaatctgccccagaagtacaagacacactcttcgaattcatggaataaatgggaggagctggtgtagtgaaggatgaagagaaggcaatgcattggtttagacaagcctcccagcaggaccatcctggtgctgcctttaaccttgcagtaggaacactgaaaaacatgactgcctccatggaagcaggggatgtagaaatgctccttaatgttgctgcaaaatgggggatccaagaagcccaagaacttctggagaatgttatttggactaaaagcaagctcttgccaactgaaagaaccaggagttcttataaaccataatgtgtgcctgcatgctcttcctggaacatgggatgttctgctctcacttgtccactgtggccttgcaatgctttgtggcattttcaatggaagctccttttacttatagtctcatatgctgctgcagcattaatttgctggttaaaatcctttaaatgaagtgttacttatatgttttcctgggatctgagtttgatctcttctggatagaggaatattttatttgggtttcattactgctcacttcagctaaagtttcattcaagccagtgagcattctataacgtggtaagtggaaaataacgaagaaacctgtcataccagagattggcttcttggatgtgttagctggcactcacagatccactgaaagagctagactcatcattagcctaatctatgacatgtgatgttctgcctaaaataagcctgttttcatttctctccatttcaattttctgctctattaggtttctatagtattttattacactcactttttgtattatagaaagtcctttataggggtaaaaaggctgttattgttgtcaattaaagggaaaaggataaagtataagacctaacaattattgaccatctgccacatgcaagatattttcttagctgtttaacatatatatatatatttgagactgagtttcgctcttgttgctcaggctggagtacaatggcatgatctctactcactgcaacctcagcctctcaggttcaggatgttatcctgcctcagcctcctgagtagctgggattacatgcgtgcaccatcacatccggctagttttttcatttttagtagagacggggtttcaccatgttggtcaggctggtcttgaacttctgacctcaggtgatctacctgccctgccctcccaaaatgctgggattacaggagtgagccaccacgtctggcctgcttaacaaatattttaacattcactagttataaaagtcttataaggtggatcttataactcctattttacagagtgaaaacaggtgtagagaagttgtgatatgtgcaaagtcacagagtgagtgatagagtggggtttttagtgctggcagtctgattctagagtcaacattcttaaccagttctaccaacattactctcccaagtcattaacatctctttcctaacaacaaagatgttctaagaacagataactgggtttattactggcatatggtgaacacttatcttagcaaataactcagccccattttctgactatgatttttttaaggacaaaccacgtagtcctattcttcaaaagtgatgtttttaaccttaattataattagctgtatttatctcatttagattatagcgcaattttctccttggaatatacatacagaaacacaaattgagggtgacaaaagtgtcaaactggaattcaatatgatgattaagctgtgtttaaaatatttgtttcccttttgattgccttgtttacactgtatacatatggaatatgactgtaagccttcagcaatcttctctttgtccaacgtgaacacataaacctttaaagatgtacatgaaatggtcacatgcaattttaaattctttaatgtagaaaatcccaaattcataaactaaattcttcacgtgaacctttggtaatagtatttttatcttctctagaagcactttatttttcttacatttttcccagagaaaccagtcttcatttcagtttatgttgttcaagatacaactctggaaattttattctgtgccacaaacacttataaaatactaggacaataatttcaatcatcgtgttagtgtgcatttttttaaccttcacagtaatatcctcttaactgtcttgtaatttaaatgcttgtttacagtaacaacccaaacttacaagtatgaaaatataccataggaatatgatcactaaatagtgtttttttattttaaaaaattcctttaggtgtcttctataaacatctccaactaacattgatttaggttgttttagggttctaatgtcttctaacagttctttgttgttgaaataaagtaatagagtagttgaaaaagcataacaacaattagaaagactttgtaaagcctcacatataaaaccccttcacttttaacttcggtaatacttgggtttaagatcgggaataacctaccagtccatcagggttgaaaaataatgcttcatgcaaaaccagaaaatgtgatggatgaggattcccctgaatccaaagctctgcttctacttcctttgctgtatctgggcaaaaattcaggggaaaagcaagacataagaaagaaattggatcataaagagagtgagagcatgagagaatgagaatggatttgcatgtgtttggccggttcagataccccaggttctgcttgctttcttccttccctgtgctccttctgggccacagaggttgagaacctctgcactcttttagatgccccaggtttcctatttagccatttgatgtcttgatcctttttctcaaggtctgccttaatgttaatataaaaatattttacattaaatatgacatatatttacagtacacatatcttaaat

SEQ ID NO: 506 - DNA, 3090 bp, Homo sapiens
gattctgattcagtaggcctttgccagggcagaggtatgtaggtgatgctcacgctcagctaggtttgggagcaaccagactagaacccattcacatacagactcttagtaaatgttttctgctctcatcttgcaaagtgaaagtgcccagcacaggcaatggtgttagtacgttgtagtcattcacaaactagggctgcccagaagagagacaggctgggactttcgagagagaaacagctgtttcatttgaatgcctggtgtgggaagaagaaggacagcctagcttcatggaaccttcttgcaccaaacaaagcctccagatccctccacagtgctccattcaatccctgtccattggtggtggaccaaagaagaaaccaatttgccttggccacatgtctttgagaaaaaaagccactctcccttctgggactcagagcatctgtacctgtaatataagaggggaatgtggaaaattctaactggatgatcacttttctgtggagggaaaaacacattttttgttttaaggggctagccagcatcaaacctttttttgagatggagtctcgctctgtcacccaggctagagtgcaatggcactatctccgatcacttgaacccaggaggaggaggtttcagtcagtagagattgaactactatactctagcctggatgacaaagtaagaccttgtcaaaaaaaaaaaaaaaaaaaaaaaaaaaaaaagaaggataatcaagacaatgagctaacacagaagccatagtggactttcttcaatattttaagaaaggtgaaaaatagcaggaatttaacctctcaaaaatgctattcccattatctattcttcctcagctacaaagcccctgatttcacctaggcacatggctgcccaaaaaagacaaccctgtctggccccccttaaacctgattgtagctatctaagttgtagccaatgaggtgtcagaggaagtaccatgcagtgcaacttcttaagtagcctagaaagatggggtcacatccccctgggttgtttccttctttgtgtcattttgatctctctcgctggaaaacagaaatgatgtctggagtgtaagcagccatcttgggctaggagactacatgctgacatggtgacacaccacccagaaagaatctgagtagtcgatgatcacagagctaccatatcagcactagactctctacctccacattttatttgtgtgacatagaaataaagtttaagctttgttttttctggggtgtatgtgtgtacacatgtgcgtctctgtctgtctcacatgcagtgagacctaattctaactgatatgccggtaggatggggggaccttgccacaaggtataattgtggtgggatggctgtgtcttgctcccattcaggatccatggaaagctcctcctccttcctgttcccctggatgccaagcgatgggcctgagaccctggctttgccatgtggatgctccccctcaggactttggatgtgcagtgattgctacaaaaagggcaatgaagatgcctggaccacagccacacagtctccatcacagcagtggtattctgtggaatgagtactaattttctggccacattttctgttaaaaactggttgttgagctgcccacttgtcttggtcaagggatgctggagtggcctgggaaggcagtgttgtttgcttttcttaggatggaacacacttaggcatatttttggtcaaagcaaaagaagaattcaaaggtgagagaagttgaagataaaaaggggaaaatgagggtagcagatgaagcaaagtcacacagaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattccaaaatcaaaaaaaaaaaaaaaaaaaaatctaaagtctgaaacactcctggtcccaagcattttgaatacaggatactcaacctgtatgacactttcctattggaccctctttcctaccccaaataatacttaataagtttttgtttcaaaagtgccactctgagcatctttggctataaggagcagagtcacattctagctcccctggcacctgcttcacaggagcccatgtgagaagaccaggttctggtcaggacaggcatacctgagagctgttggggtctgtgatctgctgaaaaatgacttctcaatgttcttcacatcctaatcctcagaaactgtgaatatattactttatatgacaacagggattttaaagatgtgattaagtaaatagtttggagatggacagattatcctggattatccagatgggcccaatgtaaacacaagggccctcatgagagggaggcaagagggtcagagaagatgctgtgacagcagaagcagaggacagagagtcgcagagagatttgaagatactacacagctggctttgaaaatgcaggaaagggccatatctgttgcttcacaccactaagtttgtgataatttgttacagcagcagtgggaaactaatagagcatctttcctttttttctagttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcag

SEQ ID NO: 507 - DNA, 2132 bp, Homo sapiens
actaaccagctgcatgaccttaaaaaagatatatcactggggctttatttttcttacctttaaaatgaaaaagttagactacatttggcgtagtccaaaagtatgtttttttaaaaaagcaacaaaatcctttcttcaaacaaaattgtataaggaacatcaatatgggggaaaaatgaagaaaagcttttctgattaacatgcgggagggggcagaataactttttcaccttcaagaatccctaatgaatgctgggagcaatagagctcctggcatgcacaactggaaaatctttggcctggatgatctttgaagtcttttctatttggtccaaccagtctcctccaggaaatttctaaatgacatgaattcattggataagtgataatatcagatatagaaatatgactaaatgtgctattatgaatgaggattgttatatacatataacctgctccgagaaaggactttttgaaagagaaaggttaagagatcagagtaacttttgagctaatgaggacactaggtgacatcaagcccaaacactttctgaacaagtggctggtcctgagaggtgatcgaggtcacacaactataagatataagcaggaactgaaaaatcacatctccagactcatcacttggactagctatgtctcatgattttcacatatattatacagaagaagaggaaatgctcaaagatgatgcttagctcaacttatttcctttttgcaataaataatattccatcatctggatgtaccacagtttatttatccattcactactgaagatcgtcttgcttccaagttttgacagttaccagtaaagctgctgtaaacatctatgtgcaggtttttgtgtagatataagtgttcagttcatttgggtaaataccaaggagcacaactgctggattatatgagacaggatctccctatattgtctaggctggtatagaactgggctcaagtgatccacctacctcgacctcagaaagtggcttttaaattttgaggcaactcaaatatggatgatgattgttttctcaaatttgctagcatctttttataagatacctgcttgggcataactatttgtattcaactggtaacagactaacttcacttttgatcctatcggagtagacagtctggaatgtggtgatactctgtagctatcaaatctgcagggcttggccatggacttgcatatcattgctgagagaagtctcaacagcagcttaagtactattgaagacctcaagatgacaaattttctccatcacttctaaggctgaattgtcatatccaatgtgctttatgactatgctttgagagatggtgatagaagacaaatacatcgcatcatcatccactcagtgagaaatggcttttgcagatttgtgctgatggatctaaggtgtgcacctctggaggctttgaggtggctatacttcagttgtggataaagaggtgaagaaggacatctatggtgatgctcagtaatatctgcgaagaactgtggagacagacaaatagtcaaaggagaatacagatgactttcagaagaagtgtgaacatcaagctgaggagcttttttgaagagcaggatctttctatcaacatgggatagtggaagattaaagtagtgatgactacatatagaaatacaaagttgaagtgagagacgcaagtctgatactgcaaaagaaaaatgtaagaaacttaggactcaactttatcaatgagttcgttcaactatagaaatgcactagggactgaatggtgtccccccaaaatttatatgtcaaagctctaatcctcaatatgatgatctccagagatggaactttggggtggtaattgggtttagatgaggttatgaggatggggtcctcatgaagggattagtgcccttataaggagaggccagagtgctcacttgttcgcatatgctcttgtattctctctctctcctcaacccccaccatgtgaggacacaacaagaagatggttgtctacaagccaggaagagaaccttcacaaggaaccaaatcagcgggcaccgtgatcacgagactcccagcctccagaactgtgagaaataaatgtctgctgttgaagcc

SEQ ID NO: 508 - DNA, 2607 bp, Homo sapiens
aatacccagctagttgcaaaaccttcttttattgctgcaataggaccttttcatgtgtctaaagcataatttattcagtgagtaccctgctgttggccatggaagatagtagtctttttcactattgcaaacaatgtttcaataaataacaaaatttttttcacacctaaaacagcaggtattttatatagcatttataattgtaaataagatcactattttcttctctctttctctctttttcctccttctctcactaattattgctgatattaaaagattaattcttgtagtctgcctgtgaatagccactgcactccagcctgggcaacatagcaagctatgcctctgtttaaaaacaaaactaaaaactactcataatcttactcaaaatgactagtttacattttggtctttatttgcatatatacctacatttttagaataagattctactttacacagtattcctgttgtgaattctgtcattgccaaccttcttgaagattcttactagtttccattttcttccactgattctcttgagttttctagatctatattcttatcatctgataacgaggatgatcttgcctctttcttttaagtagtcttactttttatttctttttcttgtttaactgcactggctgacccgaaatgaggctaaatgatactgaggacagttggtatcagtgtctcacttctttctagagtggaaatggttctttgtgtggtttatttttgcctgatggtgactgttggtttgtaattgatcttaactgaggagtaacaaacatggtaaaacatttaacacagaatctttcaaataataaatacacaacaaatgtttttgttattattatatttttgtcatggtaaagaggtatactttaatttcctgtcattaagatttatttttaaattgagaatggatgttgaattttgactcctgcctttcttaaggggatatctatttaaataattacttatatttttctttaaactgttaatagaatgatatattagcattgatatagttgtctttcttggactgcaaaaccaattttgtcaaaagtttgttacccttttgaaataatgctaggttttattttctagtattttattagagtatgtgcatctattttcatgagttaaactgtcctctatcatgatttttcagagatagctttgttaagatttgaaatcaaggttatgctagctttgcaaaatgaattggaagttttctttttccatcctccatctcccttaccaccccttccccagtatgttctgttccaagaaattttgaaggagcttacatgtgaaattgccctggaaaagaatcttttaaaatataaatatacatacaaatatatatatatgtatatatatatacacacacacacaatattttccatttattctataattagtacaacttttagactttcttctcagtttgaattaattttggcaattgtactttcaaagaaaatcattctgattccattgagtttattggcatagagctgcaaacagcctctgattctgaaatagctcttctggatcagtgattatataccttttttgttttgtatcactgagtgcttgtgctctctctcttatttctgactgaagttgctaaaaatttaattagttgatagaaccagttagtgtacaaattagtgttggattactaattattttaatttattatttccttttaaatataaaagaacttgcagctgtaagttcttctctaacagtaggtataactgaatcctagatgtgttcatatgtaatatttttgttactggtgtgttctaaatatctgtggtggttgttttgaattatgcttttgcccaaaggttactcggtgaagactgtttcttaaatttcaattggattggctctttgttcatattttgttattaaagtctaattttattgcattttaggtagattttgtgacctaaattatacccaattttggaaatttgtagtttttgtgtgtgtatgcatggcatatgtacaactaatttttgtaactattatatgggcacttaagagtatcttcacaatgtataattaatatatcatgattaggagaaagtgtgtttatgatgttattcaaatattttctttctttttttttttttttgagatggaatctcactctgttgcccaggctggagtgcagtggcgcaatctcggctcaccacaacctccgcctcctgggttcatgccattctcctgcctcagcctcccaagtagctgggactacaggcgcccgccaccacacctggctaagtttttgtgtttttagtagagacggggtttcaccgtgttagccaggatggtctggatctcctgacctcgtgatatgcctgcctcggcctcctaaagtgctgggattacaggcgtgaaccactgtgccgggcctcaaatattttctctctctatatatttatttttgttctcttgattaaagttgttaggaatgtgttaatttcttccactgtgattgtgttttgtattttcttgcattatgccatggaaattgctggtttcctaggtcaaaacaattaaatattgtcagttaca

SEQ ID NO: 509 - DNA, 1272 bp, Homo sapiens
gtttggggcagtgccaaggctcccaccagccctggagcacttcacatccgctgtcccatcccaaaaccttggtgggcagagaaatagaggcgaaaaatgactcttggagaagttaagtcacttgatctggaccacatagcaagtacagaattggggtcagagttccaaaggcaccttgcacacagccctaggaggaggtgacctcctgtggtcatctgacgctgacccttggtgatggctcactggttcccaaccacttccaaccttcctgctgtcctcactgctctagtctggtggggcagtttccgggttagctggctgcctcctctactaactcccagccactgacttcccatcagaggaccttctctgagttgagactgtgtggaaaaggctaacattccctccaaaatgtgtgctccctcttccataggccagagtgagccctgtgaagtagctgcatttcccagccctctgcagtatagagagatgggggcatgtcattattcttgccaatgattctgcctgggtgcacagactcaattcctgggggacagtggagccacgggatgtaaagggcctgcacccctgaatgccagaatggaggtgcactgcccccaaccagggacatggactgttaggtgagcaaaaaataaattttgattaggataagccactaaaatgctcacctgttacagcagatagcattgccctaacccagtagtgaggtgccaacaatgggacacattccgtgatgttccccattcaatcctttgatccccgcaacagccccacaaggtatatattagtactgtcatcctcattttcaggtaaggctcagggagattaagggatgcacccaaggtcaaacacaaccagtaggcagtaggccaggattgaatctggatgtctgactccagagacttctggaggttcagttaccagcacacggtggagatcttcctccaccaccaccacctagagagaatgagcaggaaacctcagaagaaatggcacccaaaagagccagaagtgtcgcctcagccagctaaggttggaaccacttaccaacgcccagaatcacgtctttccaatcaaacccaatgactgttcatctctgggtttcagtttcctggtttgtaaactcccatgagtaaacaatctctgattatcccgaccacagagagggttcaatcaggtgtgctggtggtcttcaatcaaacatggatttacctcccctattctattcttcaaagagggtgacaaatctgc

SEQ ID NO: 510 - DNA, 2488 bp, Homo sapiens
aagtcaggaaacaacaggtgctggagaggatgtggagaaataggaacacttttacactgttggtgggactgtaaactagttcagtcattgtggaagtcagtgtggcgattcctcagggatctagaactagaaataccatttgacccagccatcccattactgggtatatacccaaaggactataaatcatgctgctataaagacacatgcacacgtatgtttactgcggcattattcacaatagcaaagacttggaaccaaccgaaatgtccaacaatgatagactggattaagaaaatgtggcacatatacaccatggaatattatgcagccataaaaaatgatgagttcatgtccttcatagggacatggatgaaattggaaatcatcattctcagtaaactcttgcaagaacaaaaaaccaaacaccgcatattctcactcataggtgggagttgaacaatgagaacacatggacacaggaaggggaacatcacactctggggactgttgtggggtgggggtagtggggagggatagcactgggagatacacctaatgctagatgacgagttaatgggtgcagcgcaccagcatggcacatgtatacatatgtaactaacctgcacattgtgcacatgtaccctcaaacttaaagtataataaaaaaaaagaaaagtcatacttaaaaaaaaaaaaagaactgcttctattgggtgaaaacagtgatttttctgagattctaaggcattacagtttttcctgccactgagcagtttaatactagataattgcattttggtatgcaatcattggcctaaatatagtataactatagggaaaaaaagcccctttatctttgctattatttacttatttatttatttattgtagaatatttggagttttttttatcttattggatgtggctctcatccttgctaacctaattttcactgatagcaaagtttatattcctttggattatcattctattttttctagctattgccttattttttctcatgaatggtcttcttcgagtatttgtagaagggtaagtttgattattttcataatgcataaagctattttgtacttttataagaagcactttgtgagactgaggcaggaggatcaggaggtcaggagttcaagaccactgcacccagcctaaatcattgtcttataaagatacatgcatgcatgcatagacatggaatcaatctaaatgccatcaatgatagattggataatgaaaatgtggtacatagagagaatgggacatctggcttccgagcagaaacctttgtagtgccagcgatgaaagagataattaaatacgggtgatgttgagaaaggcaagaagatttttgttcagaagtgtgcccagtgccacaccgtggaaagggaggcaagcacaagactgggcctaatctccatggtctcttcaggcaggagacaggtcaggccattggattctcttacacagatgccaataagaacaaaggcatcacctggggggaggatacactgatggagtatgtggagaatcccaagaagtacatccctggaacaaaaatgatctttgccggcattaagaaggcagaaaggcagacttgatagcttatctcaaaaaagctattagtgggtaacaattttccactgccttatttattaaaaaacagaaatgtctcctgacttttttgtgtgtaccataatttaatagatctcatacaccagacttcagatcatgaatgactgagagcatattttgttggacagtcctgatttaaaactaagactggcttgtgattaaatgaataagtttggtagtttggtttttgaattttaataagtaattttaattcagtaaatgctatcactgtttaccccttctaaagatatgattagactttgttaataatgttcaacttttcacaaagatggtgagtgccatcttaaaacttattggagagtggttttatatttagatttatataactggttatgtgaatatatttaaatactggggaaattccttcactgtctcaaaaccatgcaagattcacatatattttgtgtttatttgcttcttaaaggccagggttgaagataaggtagcaatgtttactttatatttttggccttaactatgccaatctaattagaattccctgtatttaaaatggttccttttacttattgaatggtattttagtgtggtttatgtgtaatatcaaataaagattatttaacacttaaaaaaataaaaaaataaaatgtggtacataaacaccatggaaaactatgcagccataaaaaggaacgagattacatcctttgcagggacatggatggagctggaagctgtcatcctcagcaaactaacacaggaacagaaaaccaaacactgcatgttctcacttgtatgtgggagttgacgatgagaacacatggccacatggtggggaacaacacacactgg

SEQ ID NO: 511 - DNA, 1112 bp, Homo sapiens
cctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcacta

SEQ ID NO: 512 - DNA, 1110 bp, Homo sapiens
tgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcacta

SEQ ID NO: 513 - DNA, 4924 bp, Homo sapiens
actttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatggtagagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagaacagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccaggtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaaactagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggctagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctaccctggaccgacactttagaagactttactctgacctctggctctgccccacaggataagaatccatactgccaacgtgatgtgcccagctagaacagatgcccccttctagaagtgcatctaacacccaaatagcccaaatagctccaagccggcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagctt

SEQ ID NO: 514 - DNA, 4920 bp, Homo sapiens
actttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatgagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagaacagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccaggtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaaactagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggctagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctaccctggaccgacactttagaagactttactctgacctctggctctgccccacaggataagaatccatactgccaacgtgatgtgcccagctagaacagatgcccccttctagaagtgcatctaacacccaaatagcccaaatagctccaagccggcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagctt

SEQ ID NO: 515 - DNA, 1456 bp, Homo sapiens
ctggaggggctctgctcggccctcaaagatggacaaaatgttggaatcaagcacattcctgcaatccagtatgacatttggattcaaaccagcaatgaggtcattttgcttcaccaaattatcctgtctcatatccaccaaacaaggagcgtatctacattttggacgctgctccacgtgaaagaatcgagcttcgatgaacattattatatagagccatcatttgagtgtcggtttgatcccttggaagttccagatgggccatttggtttctctccccttatagattattactgcggcatgaaaaaccctccattaatcagatcaacagggagattcatgtggattaagtttagttctgatgaaaagaactaatattcatttattccagatccagactttacttacctaggagattgtgggtttcagctcttgggagccgatggaatagtgcactctagtcaggtacaacaagaagagaaaacaaaacctggccaagccgttgattgcatctggaccatgaaagccactccaaaagctaggatttgaggttcctagattatccaatggagcactcaaatgaatccaagagagacattgttgcagtctacgatgaaagcagttctattgaaaacctgaaggccaagtttcgcagcactgtggccaatgatggaatgcttaaaacaggaataggcgtgatacaaatgtgggcagatgaaggtagtcggcttagctcaaattctctttacttcctttgttgagccctgcacaggcagcactgtcttttgccatagcaacatgtgcatcaataatcctttagtctgtaatggtgtccaaaattgtgtatacccttgggatgaaaatcattgtaaagaaaagagaaaaggcaggactatctgaacaaatcactgaaactcatgggacagttattggcattacttcagagattgtcttggtctttctcattatttctgttttagtacaagtgaaacagcctcaagaaaaggtcatggcttgcaaaactgcttttcataaaaccgggttccaagaaatgtttgatcctccttattatgaactgttttcgctaagggacaaagacatttctgcagatctggcagacttgtcagaagaactgaacaaccactagaagacgcggcactcctccaccacctcccagtgcatccatgaccaccactgtgggtcgctgacctccagcgtcaaacaaagcaggaccaacctcagttccacggagcttcctttccaaaatgactttgcacaaccacagccaatgaaaacatttaatagcaccttcaagaaaagtagttacactttcaaacggggacacaagtgccctgaacagcccctagaagatcaagtaatggaggagattccttgtgaaatttatgtcggggggagagaagattctgcataagcattcatatccattgaattctaa

SEQ ID NO: 516 - DNA, 4622 bp, Homo sapiens
cattttgtttactcattcatctgtcaatggacatgggttgtttccacctcttggctatcgtgaataacactgctataaacatggcaggtaagcagctgttcgagcccctgctttcagttcttttgagtatcctgagctcccgggttcacgccattctcctgcctcagcctcccaagtagctgggactacaggcgcccgccaccacacctggctaattttttgtatttttagtagagacggggtttcaccatgttagccaggatggtcttgatctcctgacctcatgatctgctcttggctttccactgcatttagaatgcaatcggtctccttctctggttactagctacctccaaaccacctctcagcacttccctgctggctccctgagcaacccctagggctcctttctcttcagaggcaccaagctcctgcccagctctccctcccagccctgaccatcgcagcacaaagaggtcttccctgactgcctgagctatccgccagaggtcacctttaaactgtccgttgtggaaacctctggaaacaaatgcttacacctgtgaggacagctttccactgtgcctccctgtgtccccctcccttactcaactcatctgaccctcttcctcccagctcaagccccgcctcctcctccaagaagcccacccagcctgtgggttccctctcagcccacagtgcttcctccctccttggagtcccctgaacccccaagccagagctgcctggcttgtctcagcatggtccccgtctgctgaccccagatttgcctggacgacctctccaacagacttgcgctcggttgaaacttcctcactggtctgtgcacaccatggaatgttattctgctttaggaaggaaatccgtcaaaagcccccgcgggatgtgggtggggaaatagccactacagtccggagtctccccaccctcacatggtgggaggggccgaggatccctccgggtctcttttataagtccatcaatcccattcaggaggactctgccccaccacctgtttgtattgtctcccaaaggccccacctcctaagactatcactttgggggtcaggatgtcaacatgtgactttgtggaaaagggggtgcggcatgaacattcagtccgttgcactgcagtagtcagactcgtggagacaggaggtagaatggtggtgacgggctgcaggaagggggaatggggagctagtgtttcctggggacagagtttcagttttgcaagatgaaatgttctgaatatggatggtggtgacggctgtgcaccattgtgagtatacttaatgccacactgaactgcacacttaaaaatgtttaagggctgggtgcggtggctcacgcctgtaatcccaacactctgggaggctggggctgggggtggatcacttgaggtcaggagtttgggaccagcctggtcaacatggtgaaaccccgtctctactaaaaatacaaaaattagctgggtgtggtggcacaagcctgtaatcctggctactgcggaagctgaggcacgagaatcacttgaacccaagaggcggaggttgcaatgaggtgagattgcaccacagcactccagcctgggcaacataatgagactccatctcaaaaaaaaaaaaaaaaaagttaagatggtagattttatgttatgtgtattttaacacaataaaaaatcaaaggtagctaattcccattctgccccaatttcagagaaacacgtgggcgaagacagggaggggtgactgtcggtgctgcccgggccctgctgccttccagatctctggcaccagggctctttctagctccctccccagaagaggacatcagcgacttgcacaggccccttcctgggcctgcctgaactgctgggggcaatggttgtggagagaacccagtgtgtgggcagagagcaggcagcgtgcccccttcccattctgctccagcatatcactcttgttgcaacacaggatgagtgttcccacattttgtttaatattcacacgctatagagtgcttcctccagctcctcagtcttcaggacagcctggactccgggactggtggtgagaagcagcagaaataacaagcatccctggcccagctcgctggcccctggttgctttagggagtcctgtgccttctctgagcaggaagtccctcattgaaaatgagagggttggacaagacgatccctgagaagccttggagtgccagctttctgagaactggcctggcacaaatgccccatttagtacacacgaagccaaaacagagaggaacagggccccagcaggaggagtcagcgagccggcccagagcacgcttcttagaaaaggacacgctcagggacaagggcaccatgaccttcccaaaggcacaaagggcacagggctctgcatctcctgtttgttcccggtagaacatctcgctgtcccgggagaatatatgaggagtgcataaatatacagccccgcactgcttcctgggctcttgtgtgattccagggcctgttctccagcagctgtgagcacccacccagaccccactggcctggggacggccattgagccagtcccacctgtgagcccttcagcgattctctggcccccagccccacctgtctgtccacttttcctggcaggctggttaggggataaagcagatgcacgggacactttacttgcccctttcccgtccaccccagttcaaccctccaggttaccctccggcagcagagccacccctgcccaggacgcgcactgccttccattaggcaacagtttcatgaggcatttgccgtcctcaagaggctgacgtgacagtgcctgattcacagaggcttccctctgacccaggtctagctggctccccagtgggacaccccagggcctttcctggcccagatctgccgctctgggctgtcctgagtgaggaacacctgaataagccacaacatcaaggaaaggaccatgaggatgggagcacccgggagcaagcccctccctgagccttggaaaccccgtgactcctattttccatgtcattttctccatcatggaatgaacacttagaaactggaagctcgtgagcagaatgattctgtcctagagcctgaaggcgtgcatcagggctgggtccttccctgcagcatagcttctaaaccaacgattgatatcttcatttaccagcacgataaaaaaggaattcgttttcttagaagctgtgcctgtcactctgctcagaaacagtccaagcagccgttccaagtgtggccttcagcccatgccaaacttagatcaactgcaggcttggagctttctgaggcgagaatggaagtatgtgtgctgcagtggtgtgtgtgggtgtgcactcgtgtttgtaggtagcatttacacacacccaccgtgggcatgtacatgtgtctccctgtgccagtatgctgagagcttcaggacatggcaggcactccacatgcaggggatggaaaagccatcacatttattgtctgtccttgtgcggtatttaaaatacaactgagaatgtgtgcagatttttaaatgttactggaccacttgggttttttttgagaccgggctgactctgagccagactgcatctgtctgcgttgaaagggaccattctttccctcctgctcccgccctgccccctccacacacaccctccttcatgtgaaacccgagcatttcctttcccgtaagccttcttctagaagcctgtgctcagcacaggggccaagccctgcggctcaggcaggcccacgtgactcttgaactgcagactcaagtcccaaggtgggaaaccgtttgtcaacggcccccagatttacaaccacgaggccaggctggtcttggggtgcaaagccattgttcaaaccatcagtcatgcaaggagttcctaggattttttattttcccctccaaaaagctctcttcagctttgaagaaatgctgtttcctcctctggttacttctgcctgatgagaatgctgatctggggatccaagtaaagggtggaccacagagcaccttgtctctgtgtaaaaggacacccctgttactcagcgtgcctgaaagtgcctgagtgtttcccagtcctcatcagtgtaatcttaagctagaagttccccttgggcaatgcatcaggtcttccactttttttccaatagacaccatgggccatacttcctaaaatacatgtttctaaatcttctactttttttgaaaaacaattttgaatcattaaagaaatttttgaaaatagctttctataacccacaacacctctttgtgaaccccatgattttcatttgttgaaattttccgattctgaccatgggaatgtgtgtcttaccaaatttcaaccagacatccagtgtttccacctaacatgccatttaaagccacttccatattcaattcagtctgcgcaattctagttccaaacgctcggtttctgttccattcagagaatgtgctgagatttcttctgtcattcccttattcctggacatttaggtgcaacaagtgtagacgggttgttttttccactgaatcatttccttcagatgaatt

SEQ ID NO: 517 - DNA, 3210 bp, Homo sapiens
ctcattttttctcttgctgccaccatgtgagaagtgcatttcacctcctgccgtgaatgtgaggcctcctcagccatgtggaactgtaagtccagtgaaacctctttttcttctcagtctcgggtctttatcagcagcgtgaaagcggactaatacactggtcatcctgataaggttttagggagcccgatcttttcataatgtaaagcagaagacaccttctaatgagaggctgagtaggataacactagtgggagtttggagatcttatgttaaggattcccctgacctctacaacaagtttggttgtctcatattctctccagttccttaggccagctcaagttttatcagtatcttttggacccaatgagtccttcctggcctcactccagaagaagactggcctcagtccagagaaacaaaaaatgtgaaattcacccactggaactctccttctccaagtatcagtctccttccagaatttccggcttctggtctcttttcaaggaatttagaagcttctgggagccttctgcattccgtggtttgggtccctttcctccatcttcaaaaccagtctaacagcattttcatatctctatgatactaatttcctcttttttgaggcataaacatattttcattgaaaatcgtgaagaattgagaaggaaaggagtctgaaattttaaatggtgagattctacaagtcatcaggttctttcttgctggctaagccctaacctctggaattcataatcggaggacctcataaggattatggaaacagaatttcatggtaaaataagtggaagtgctaaattctcaaggaaacattaacctttaacagtggttgcttctaaagttccaaacataaggttataattctgagaggaatagaaggaagaaaaacttttgtccctaaattttccacttttctcctcgttctcttgtccacaccatatggctagacatgaccactttgaaatgaaggtgatgttgtctttcttggattccatttcccacatgttgaactcatttggtgcaactaaatgctgcatgcagagacttaatgaatactttggatgattatgatgacaaggcactaacatggcagactgaattttccctcatgggagaagaatcagatactgtataatggattgaaatgcttaagttcatggccagcttcaaaagtaagctgaaggaaggactacttttcaaatgaagaagctaattatttgtgctcgattagatgatgtgggaaatagtgtttctagtttcacttttaaatatcaacaagcaagtcaactgattatagattacgagttgctctttagaaatctggacaaaatgatattccttgtcattgccaatagctcttgtttgcacaaggttcatttatcatctcttcttgttttcaggtttgagcatgagtcattgtggtaaggttcttgtatgtggctgatcatattgaatgctaattcagaacatattgtacaatagacataccaaacttcaataatgattaattttatttagtctattgcttgaattacttgtaaaatatggtttattgttctttaaaagatcaaatattctatcgaaatccaaaccacattaatcatctgtttctaaatactatatatccatgctttgtgtaaatacaacttgatatctaaagctattaaactaaattttaaaattcctattttatgtctgatataaatcagcagtgcaaactcaaaaatgcattcacataagccattttttagatgcctctcattttattgaatatcactcttttatgtctattgaaacccttttttgttgttggcatttaaaaatatactttcattctgagaacacgtcttagttctagatacttgaggtcagataatatgatagcacaagagctttaaaaaattttcgcaaactagttaatctctgagtagcttgtcctgtttttttcctcagttatgattaaatatttatggcctctatcactcacttgctcctgaacagatttttccttattgatataaaatgtcctcatattttgcctatatgtgctccatatgtcagctacatattgaatcacaaatactcattagctttctttgtgtattactcagagcaagaagatgaaacatatgactagggcaaaactcatgaacactccagtaattatcataaaaggcacattcttcacgagtagctgattattgtatacaaatttctacttgcaaaatagaaattaactatgctttgttattttatttttagaattaatccttcttaaatgtattagagtgaaacattaatagaattatgtcagaggataattttgcataagatattgaggcattataccagtacagaaaggttagaaagtatattgactacttttagacttttgtcttatgtatattataatttactatgtcagacatagcaaatttttttctgaaggaactcttggaatggaaatgatcttaaaagacctgaaaaaaaaaatgcttctttgctgggtttaggtcaaaagtcatcatctgggagcaccatgaaattcaaaccaaggaagggaattttcccagtaatggtcccagcaaaatgggtggtcttatgccagaataatgtgtttagaatgactatgtgcactctttaaaagttaggataataaagaagtgggtcaaccagtacactcattatttacaactggaatgataatgtagcagcaaaagctcctacgagaatgtattgaaagactattatacttcaacccctgtacatatctccttccatatgatttcttattgtcacaattctattacattgtagaaataaaatctgagcaatattttgaacctcattgataatgtatagaagggatgaactctttctacccgataatattttttaaactttaccacttggtgattagaataacatcaacaacaaataaataatatagaataaaactcaagcaaacactgagtagaatagagaagcattattagatatagggatagattatggtaaaagaatagttgcttccagataaagttgaggctttctgaagcatttttaaaaatctggtcaatttggctgctgttccaagtcccaatcacaccacaccgtaagaagacaacttattcaagcctcgaagaacattccatgctcatgggtaggaagaatcaatatcatgaa

SEQ ID NO: 518 - DNA, 4432 bp, Homo sapiens
ccaaaagttgggagtcttatgactcttaaggccctgttccggttgctatggctacataacaaacccctccagactgagtgctttacatcttactatgctcatgggctccacgatcaggaatttggaaagtgcacagaaaagatgggctgtctctgctccctgatccctggacctcagctgggaaaactgaaaaacagggaaggttggaatcatctgactcccatctggactgaatctggcagccaacatggatgttggctgggacctcggtgaggactgctggcaggaacacctacacgtggccttttcctttggctgctggccttgctcacagaatggtgaccgggttccaagtgtgaacccaggtacaggaagagacaggaaacggaaactgccagtttccttaaaatctgggcccactaactagcatggcatcatttctatcatcttctattagtcaagcatcacaaagcccatattcaagaggagacaacctagacccagcctctcaataaacagtgtcaaaggctttagagagcatggtgtcaagctcccagattctaaggctgtgactcaacccagtgcactgggctgcctggctgtacacaggtgtccatattgatgcaaagcccccaagctgctcttatcctcttgtgaagcacccttagcttggttagtatttaaataattcaggaatctttcccctcctggattttgagagacctccacatcttctcctcagttctcccactctgttccctcatcccacaaaacaggctcctttccccagaactattctacctgaatacaggcgaaagatcgctcaatgagttagccttcccccacaccccagctctgactccccgagggctacctttccaaaaggagactcaacccaatttcttatagctttcatctgggaggggcaggtgggggcggggagggagaatgaaaggggcgaggtggtcttggatgagtgacctgattgcagggagtcacggctttttctgcacacatcactagctggatggctgtgtctgacctaggagaccacagtgagaacctgtcactaaagcaggtgcccatgatgggaagaactggaaattttatctaaagagagaggctgaagcattccttaaaccacagaagaaaacagtgaaagtacaaaatgacaacagccgtcttcaaatactgcttgtcagagggacaagagagaacagaggtgctgtgctgctccacaaggcaaaacaagagcaaacaagtctgtctgagtttcaagaggctggccctgaggctgcactgtggcagtctaggtgaggatacaactagaagccagcagtctacaggctggaagaaggccctcaccagaacccaacccttggacttcagcctccagaactattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtgggcgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaagggtaagaagaggatgtaaggcagctggtgttaatggggagaaaagctcagagagatgcattttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaaccggaaaatgggagacaggattttctaaaagctagaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcctcaactgctctttttgtcttacatcccacatccagtttgtcagaaaagcctattagagataccttgaaaatgcacccagaatctggccgtttctcggcacctccaccattgcccccggcctaagaagctctcttatcttgcatcttgggctggactcctacaacagccacaacctccctgctggtctcccagcttctagccttcccccatctcctgtcgttttcgacacagcagccagaaggatcctttaaaaacagaggttgatcctgtcgttcctcaaaatcctccaatggttttcctactgcactcagagtaaaagccagtctctgccttagatgctctgggatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagtcagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgctgaat

SEQ ID NO: 519 - DNA, 16176 bp, Homo sapiens
ttggggatattatataaatcctcaagtggggtcatggggatcaaaatgcttgggatttattgctatacaggaaaaaaagtgtattttctgtttaattcttcaaaaaggtcacacatgggatctcagcaggtttagtaaatcatatatcctgggggaggaacccagatggtgtggagctactgacctagcacagagactgaggcatgctgctggaggcataaagcttggctggcctctgtgggcttgggttgtggctgtgtcacggtctaccactttgccatttgtctctgtggatcctgaaagctgcagataaaaattttaaaggcttagctgcctgtaatttaagaaagaacttggttagaagtcagatcaagtgaaagaaaatgaaatgtcattgcacaaaaggaaaatgaccaatctggtggaaatggagcattttttaaaatagttttttgtttgtttgttttccattagttatttttatctactttttgtcttagcttttgacgccaatacttctttttttggctgaaatctagtaacttttaatgtttaggacaaaaagaagacagctaatctgagaccaatgaaagaaaggaatgcagaagcctgatgcctgggcatcatcagctatgcagtagcatttcctccttgggaaaaatattgacagtttgaaggagacttgagatgttaacataattacttaagacaaaggctgagcagggagagagagtggtcatttcaaattatatggtcaaaaataggtaaatcaaagttacatgctttcaatttgatgtatgtgcttttcattttggtttatgattcagaccacttacagttgatctctgtagaagtgcttttaagtcaaagtttcaaaaatgttagggaatagtgctttttagttattttttagtataataaaaaaaattccttgcttctatgtgtgactatgcactttacgtatcaaaaagtaatcttaaaaattcccagagttgagtctatttattaactcttgttgagatagtttctgggtttggatttaaagtctaaaatgtgaaactttatgaaaagtagagcccagggccaggtgtcgtggttcagatctgtaatccaagcactttggaaggccaaggtgggagctttgcttgagctcaagagtttgagaccactctgggcaacatagtgagactccatctctacaaaaaataaaaataaaaaaaaacttagccagttatggtagtgtgcacgtgtagtcttagccacttgggaagctggggtgggaggatcacctgagcctaggagttcaaggctgtagagaggtatgattgtgccactgtactccaaactggatgaaagagcaagagccaaaaaaaaaaaaaaaaaaaaaaaaaaaaatgctcagctctagaactgactatagtaataaaaagaagacattctttagtgacataaaacttgggtgttatatcttacattggctattattcttacgtgcaacaacataacaatgagaaaaacaagccagatacaaaaaagtatgtattgtttgattcccatttatataaacttaaaaatgggcaaaactaatctatggtgttgaaagtcagaattgtggtgtacctcagggagaggtaaacactgagaaggggcaccatggggtctgccagcttctggtagtgtgccagttcctaatctagggactgataacttgagtgtgttcattttgtgttcatcatactcttcacctaatcatttgtacacttttctgtaacctttatgttacattttaaaagaagttaaagagttatgttatagaacttaatgtgcattctttagaaaaattttatcctaaagaaatgtaaatttatagtcagttctagagcttatgatgtgtctttttgaaagtttgacctgcacctgtaccctaaaacttaaagtataataataataaaaaaaaagaaaaaaaagaaatgcagaaaatgatttgacaaaaaaaaaaaaagtttgacctaatcttaatcatggcagatttgggaatgctaatgtttatatatatactttcataattacaccaaaattgatgaatctttctctgggagctatccattgatgttccttgtaattagcaacctgcttctgtttccgaaattgtattttcaatcatataagtgtgttcaaaggcctcagcggggaccagaattagctacaatttatattcagttcagaacatagaattcgtttctcaaatttctcattagcttggcagtttataaacttggatgtgtgtatgtgagttttaggaatctgaggattggacaaaaaagagagacagagaatattaaggcagtaaagaagagtttggaagagtagagataagtagaaataatgacattagaaggcagaagtcttcagatagtcattcagaagcaagatgatgaaatactcttttggccagacacatcatacttactcaacctttgtatttagcttcaattgttggttgaatggactcagctgttcacactgtagaagtagtggtagtggtagtagcataaggagtgtagattttgctttaaatatcactcatttaaaatacttttgttctttgccaggtgatatgatatgatatgatatacatgtcacatttcttgtcatgcatgaacctaccctttagttggagaaacaaggcatttggaggtgaaatgttcaaatgaaaatatatgtacaagataagtggtgtaaatacacacacagtaacagtaacaatatttgatacattttgcatttgtttgtatgccagccaaataataaagaccagctttctaacagaaaaatgacaaaggactggattggacagtctgtgaggagcgatatataaatcaccaatacatacatgaaaatatgttcagtatcactggtaatcaaaggatcacaaattaaaatttcacctatcaaattggccaaattgagaaaaactgataatagccaatgttggttaagttttaaggaaatcaggagtggcaatgggcataatctttccaatgggaaattaagcgatgcatgtcaaaatttaaaatctacatactctgtgaccaaaggcagatacagggtttgtggagcccaagcctatgcaactggggaagggagagagttcttttaaaaaaggatcccaaagttataaatacaaatttaggtatgacattaaatatttagttcgaatgagaaaaaatcacaacaaatttttatgaaattggtaaataccataaacatcacaaaatccatctctatgaggcaaacttgggaatcagtctggctccagggcatggctcttaacagctgtgctctgactgcctcagaatgtatcattcatctgtgtccattgactactacagaccaaaacacatttgcaacttcttgtcacctctgctgctagtgccttggtccaaacctccatcgtgtctctcttggatcatgggaacactctcctaactggtctctgtattttgcccttgaacagaatgcatgtattatgtttttaacattttttagtaattgactttctgacactcctctattttatttattatattattttggttactctttgattgccttttcatgtgacgatggttttgtactattttctacaaaaagacaggaaagataagtcctctatcatggtaggtggaaatctattttttattgttaatagttgcataaaacctgaaaattctcacgcacacaaatttgctatttgtagcactgccacaggtttgttgcatttgtaattgcatatactgcattattgaatatgtttctgacaggagagagccttcgtttagtctagccactgatggaaactgaatcctttgtttacaattttagatacctgatgattggaagaattttctacagactagcttgtggctctatacattttacatgctgtttctccttcactactcatatatttctggtgccaggcttggcaagaggtgttttcattgtgatgtgacctctgaccttgcagggtgagatggaatgaggggcagtaggaatattcctgcctttttttctagtctggaacagctatcaatacctatccctggaggtgaccccaaatccatataaaaaagccactaaaccaaaataaagtataattccaaagtcagtttgaccccccagattccaaaaatgtccatgtctccttcagtgcagtcaatttaaaggaatgtttgatgagaggaaaattgcagtggatggcaacagcagtcataacagatccagttgaaatattttatttttacaaattttacaaaagcagagccattgaacacatttcgaggatcccttttacgtcttggaagaagctttaggaaatgagggaccctgaaaattacacttaattaggcacttaatatatgtgcctctgtctatgacctggatacttctaagaatttatcataaggaaaatgtgcagtaaaaatcaataatagcaaacatttgttgaacgcttactgtacaccagacaccttgctaagaacttcattttgactttttataatgagcgttttatttttatatcttatttaaaaattccagagaacaatatccgtgtttaaatgggaattttagtttagacaatgtcaaaattatgttcatttttacttcatcttttcacttcaacttttatatggatttatgcagtttatacaacaactacatagtgaatgctaggcagtgttctagatgttgaaattcctgccttcatgaagcttatattctagttggacaagatactcaataaataagttaacaaataagataaataagtctgttatcgcatgttggatgggtataagtactaaggagaaacaagatagcaagcaaggaggtaagaaatatgtatgtgtatggagtgggggttgagattttagatggatcatttcacagagaaggtaatacttaagtaaagaccaggccaggtgcggtggctcatgcctgtaatcccagcactttgggaggctgaggtgggaggatcacctgaggtcaggagttcaagaccagcctggccaacatgagaaaccccatctctactaaaaatacaaaaattagttgggcgtgttggcaggcgcctgtaatccccacctactcaggaggctagggcaggcagaatggcttgaaccagggaggcggaggttgcagtgagccgagatcacgccattacactactccagtctgggcgacaaagtgagactctgactcaaaaaaaaaaaaaaaaaagaaaagaaaagaaaagccttctaactgtgtattctaggaaaactctagagttcaatattcaatatgctgaagggtcttcttatataattttaatgcctggattacattaggatggtagtaaagagaagctacaaccatcacatagctgatgcacttgtacctgatatgtactcttggtaaaggcaatatggtacctacaaaattactttagggtcatgttatatgtggtcttttactggatggcattggaatgaattaccatttgaggtaacagaattatctttcctagagttctttaaaaataggataaatactggcagagttgtgatgctttgatttaagccaatagaggtcagattttttgatatacataggtcttttgatttagtaagatgaatttattcagaattcaaagatcttttcaaaatacactctcctatatggaggcggtaggatctgaaccaggggaattacaaatggttttaacaggctgaaagaggggttttgaagtacattttccttcaaaaaaaaaaaaaaaaaagaatgaaaaaggaaaaaagggaaaaaataaccattttcctgtcaaaagagaaaaaagttaaagaaaaaaacctaccccaaacccctgaataacctacataatgtgggttttttttgtttgtattaaggagtgtttttaatatttaaaaaatacttttcaacaatggttctactgaaaaaataacagttttacatgacatatagatttataaaaattacatgttactgtgtttatagaaaaaaatggtggctgtgttttaaaaagacattgaagcaactcttgtgtgaaaatacacaggtggtgttgaaatagaaacaagcctaggcactagggttcctaaggtctgctttcatctcagcctctcatttgttatgttacatttcagggctatcattaatactgccattgtatcccatttttctttcatcttctcttttcaccccggaccctgtttgggggccaggagttcctttgagaatgtgaaggcggccctaaaagctctcctctaaataatgtgcaaatacacaacagatttgcatgtaagtttaggggtttcatggtttctggaaagcatctttggaccttagctgagtgtgcatgaattagaatgcattagtaagaacatggggctgcaaaatataccatatgaacaatagttagagcatttcactgtgatgagctagaaaaagaaaagcttgaggacaggtcgttaatgaactgtcacacatatctgaagagctgttatgtggaaggaagaagtttatttggggttgttttagagctaggtggtccaccactgtagccactggtcacatgtgactatttaaatgaaaattaaataaaataaaaaattcagctttccactcatagtaggcacatttcaagtgctcagtggtcacatggctgctgaattggactgttatatctttgtaagaagttctgttgggcagagctgctctgaagttttgaactttcaacagagtgaattatggcaaggcagatttcagctcatttctaacaaaactgttctattaattttaactgttcagtgccagagctgttgaactggctgcctcaaagaatagtaagctttctgtcatttgaagtactcagacagagactagattcctactttttggagtgatgtagaagagtttcctacccagaaccttagggtgtttaagtgggaagaagactcagcaattcaatgtttcttttactgcagatgaagacacagactcagagtcagacagttttgcccaaagacccacaactggttaatggcaaatgctagctgtcctcatgaatcctagcttagtacttttcccattccacccattggctaatgttttaacaacaaggtcctcgcggttcttgttgagcaacacatttccgcttctggcattcaccagcttttccacttattctctcccactcttctgcagtgaaaactacactgcagccaagctgaactggctatattgaaatacgttattctgattcctgcctctgcgtctttgctattgctttgccctttatcaaagtgacatttcttcacaaacttaattctacttattttctaacttctcctcaggtctcagaatattcaaacccataccatctcttctctttgctaaactaccttgttacaatgcactcagacatttatactctctgtgatgattatattttgtcttatccctttgatgagcttcttaaagactgtgattactattttcatgcatatatcctttttctgtctccctcactagaatataagttcctcaagggcagggactatagctgtctttttcaccataccttactatccagttgctatccagcaagtgtcttagcaccataataggtgctcaacaaatatttattgaatgagtgaatcaatttttctcttcccaagcatgctattattctccttaagtttgccatgaattctcaataaatacttttctaagcaaacatttctgtttctataaagtaagtattgaaaataggaatatgaaaaaaacaaagtaaggcactccagcatgtaaagtgcttgggagtcctcactcccttccaaacctgagcaagtaaaacttggtaagttttcctggaactgtcagcaatctcagggcaaatcacttgccaccccaaaatctgaagaaataggtacattcagacagtcacagctaagatttgcttacctacagcagaagcaactggaaccatagactagaagggccatttaaatagtaattttgatgaattgctggaggctaagtgttgactagcttgagagtggaactcctaggcgcaggagtctgagaaagggtctcacacgtacatggattttacctcccggaaacccgtcaggttttcacagcaaagagccaagatagaccctgtcctggctctggcaaagggaaggggaaagtaatgactttgaagtgcgctcagaatgttctctatgataaagacttactctccaaggaaaagggctttaccagagtcttatcccatctggggagaagatagttctctgactcgaggcacctctagattcctgtgtcaactaaggaaggaggaaaaaggttaagaaacatttgtaaaggtcacagtacagcaacataggcccaccaaaagattgagatgtaatcctaagaaaatggaatgtttcccttccccactccttaccaccacagcaacagggctccttataataacagtggattacagctgaaagagctgcaagatgcagacagacactggctggccaaggagagggggtctcaggaaagtccaaagacaacaggagagatgaaaaaaaaaaaaaaaaaagacactagaggactttgaaacctctgacaaccacatttatagcaaacattatatacaacccaatcttagacagataagcctcaagctgaagtcctttttgcctcatttcctgttatctgatacatcatgtctagctttcaacagaaaattacacagatgaggctgggcacatggctcatgcctataattctagcactttgggaagccaaggtggacagatgacttgaggctagaagttcaagagcatcctgggcaacatggtaaaaccccatctatacaaaaaataagaagattagcctggcatggtggtgcatggctgtagtcccagctacttaggaggctgaggtgggaggatcacttgagcccaggaggtcaagactgcagtaagctgtgatcacatcattgcattccagcttgggcaacagagtaagtaagaccctgtctcaacaaagcatgctaacaggcaaggaaaaacagcctgtagatacaaagcaagcgtcagaaccagactcagatgtgacgcagattttggaattatcacacagggaatttcggtagctatgattcatatgttaagggctctaatagaaaaagtagataacatgcaagaacagaggggtgatgtaagtggagcgatgaaagagctaagaaaagatcaaaaggaaaagctagacattagaaacacagtaacagaaatgaagaatgcctctgaagggtcactcagaagacttaacacgatttttaaaagtctcagtaatcttgaagataggtcaatagaaacttcccaaactgaaatgcaaaaataaaagaatgggaaaaaaaagagccaggcatggtggctcacacctgtgatcccagcactttgggaggccgaggcaggaggattgcttgagcccaagagttccagaccagcctgggcaacatagtgagaccctgtttctaaaaaaataaaaaaaattagccaggcgtggtggcatatgcccgtggtcccagctacttgagatggtaaaaggctaaggtgggaggattgggaggatcacttgaccctgggaggtggaggctgcagttagctattaactgcactctggctgcttgatagagtgagactgtgtctcaaaaaccaaccaaacaaacaacagaagatgcaagaactcagaactttggcacaatttcaaaaggtgaaacatacatatacaggtaattggaagatcagaaggagaaataagaatggaacaagagaaatatttgaagtaataatgactgataattttccaaaattaatgacagacatctaacctaaattcagatccaggaagctcagagaacacaaagtagaataaattccacaaagtctatacttagatatatgacattcaacttcggaatgtgaaaaaatcttgaaagaagccctggggttgtggggatcaccatatctatagagaaacaagaataagaattacagtggacttctcatcataaactatgcaagtgaagaaaaatacttaaagagttgaaagaaaaataaaccctcatcaactttgaattctaaatccataaaaattatccttcacatgtgaaggagaaataaagactttctcacataagcaaaaccgaggggatttattattagcacagcatacctattctttataaaatgttaaaagaagttcttcagagaaaagaataatgatagttcagcaacttagatcaacattaaggaaagaacatcagagaaggaataaatttaaggtaaagtaaaatcttttgcttttctcattaattgagctaaaagaaaactttgtttaaactaataattgtaacggtgtattagataattatagcatatggttaagtgaaatgaatgacaacaatgtcataagagattggagggaggaattggaaatactttaagttatctgaactacacatgaaatggcatagtattagttgaaactgaacttagattagtttaaaatgcatattgcaaactctagaaccaccactaaaaaagttaaaagaaatataattgagatgctcagagagtagataacatgttatataaaacgctcaattaaaacgggagaaagaagaacaagaggggagaattaaagcaagagaaggcaaaataagaaaaaaatatataaaacataggaaacctagagtcgtaggcaaatccttattgtctacaagaagcccactttaaatataaagcatcaagttaagagtaaagggatggagaattatacagtatgttaacaccaatcaaaagaaagctggagtcactatcttaattttagacaaagcagacttcagtacaagggaaattatcagggataaatagggacattaagactgataaaagtatcagttctccaggaagacataatcataaaaacatatgcaccaaacaacagagaatcagaatacatgaggcaaaaactgatgaacttgcaaagaggcacaatttcaaaataacaaattgactattgtagctgtggacttcaacacccctctttcactagttgatagatcaagccagcagaaaatcagtaaggacgtagttgacttgaatagcattatcagtcagcttgatctaattgacatgtataaaacactccatccaacaatagcagaatccacattttcaagcttgcatggaaattcaccaagatagatcacatcctgggccataaaacataccttaacaaattttaaagaatagaaattatacaaagtatgtactcagactgcagtgaaattaaactataagtcaataacagaaagatatttggaaaatgccaaaatatttacagattaaacagcacccttcacaataacacatgactgaagaggtcacaagataaatttaagagtattttgaatagcctgtagtctcagctacttgggaggctgaggcaggaggatttcttgagcccaggagtttgagtctagcctgaacaacatagtgagacccaggcacttgaaaaattttttgaataaaataaaatttaaaatataacttataaaaaattgtgagtttaactcctgtcttgccatatactagcagtagcagtacaactgtgaataacatacttaaatggctgtgcttattttcgtaaaataattttagtatttaaaacttcacctaaaataagttctaatgttctattgcatagtatggtgactagagttaacaataacatgttgcatatattttgaagtagctagaaagaaatgacacatatttgaggtgatagatatgctaattaccctggttttattgttacacaatgtatacatgtatcaaaacatcacactgtaccacataaatgtgtacagttattatttgtcaattaaaagcaaaataaaacaaaaacaaacacaaaaaattgtgggatgcaaggaaagcaatgcttagagaacaactgataccactaaatgcttacattagaaaagaagaaacaatgaaacaacaaaaatatctttcaataggtaaatgaataaacaaattgtggtgtatctatacaaaaaataaataaatggaggagaagaagcagtatctcctacagaattccaaacaattgatgcagatacttcactctcaagaaagtggtaattttccactccttaaagtgtaggttatgcatagtgactttgtttcagagtatagtgtggaaagggcaaggaagcgactttatggtagttactcacagccagatgatcaagacatcagcagtgataagcactattgctattatgtatgatgtgataaagataacacttcacctctgtggtcttccttcccaaaatacataactccagtctcataatgagaaaaacgtcagacaaattttaattgatggcattttacaaagataaatactcctcaaatctgttaaggtcattaaaaccaacggaaatctcagaaattgttagagccaagaggaccgtaaggaaacatgacagctaatgaaatatgttttcttggatggggtcctagaacagaaaataatattaggtaaaatgaagacaattgaataaagtatggactttagttaataatgatgtatcaatattggtcctttagttgtagcaaatgtgcacttagaacgtgtagtaataggggaaactctctgggttgatataagtggagcgatgaaacaaataggtgaaactgtaatatttgtaatttttgcaatttttgtaatttttctataaatctaaaactgctgaaatacattttattttagaaaaatcaatgtaagtatacctactcatgtgttcatttgtagaattattagccgaaccattttttccagtttcaataatttctgctgaataaaacttttggtattcatgctactcagtttatttctggaatacagcaattctttgatttctccttataaatatatgcaagaacaacagtgtcctttagttgttagaatcttatatagtccatatattcttcagcacccatgttattcattgtctttttacaacctgctatttaaggacaaaatacatagagtcacaaatggaaagtaaagaagaaccatctctttcatctcctcctcattttgtcatcacagtgtgaagtgtcagtatggagaaggcattactttgaaagcagactgtctggcagaaactgcaaaactgcattttgcaatagtgtcatccaaactctggggaattctgttattcagaagcctctgtggttcattcatgcattaagaggatgagtcttgctgctttctcatctgacagaggagaatgttgccatgacagctgttaggaggtgaggagatgtgtaaagggcatccataatgaaaagagaaaatagcctggcttcttaggtctcactgatgatgcatggagtggcttgtgtggattctcaaaatgaaccttgaaaatccgttagtcccattttagtaataatatctcacacacacacacacacacacacacacacacacacacacacacacacaatgtttcttttccagtagcctaagaagcatgtagaaaaattaaacctcaactaaaaccccctcatagatacctccttttccatctttggagtgtagactgaagatctaccatattgaaggtttaaaacatttgttttgttagtgattattatgagggaaaatattttccaaaaaggcagaatctttttagaaaatgtcctaaaaccagaaaaggtgttagagagtaatcagagagcttaagtagatttcatctctttagtcccagagagtaaaatatattttctttatctaaagatgttgaaggagtatttactgattgaaggatatggtatcttgcattttcttcaaaataatatgggaatggggagttttttagggccacaggcaaaaaaaagattggtaatgaatcgattatagaatattattagggactgacttgtgccccctgcccctgctcccaaaattcatgttaaactaacccccagtacctcagaatgtgactgtatttgaagacagggtctttaaagaggtgcttaagttaaaaatgaagcctttagggtattctctaatttggtctgttatcctcatgagaagaggaaatttggacacacaaagagacaccagaaacatccgtgtaaagaggaaagaccatatgaggacatattgagaaggcattcatctgcacaccaagaaaagaggcctcagaggaaaccacccctgcctgccaatcccttgatcttaggcttatagcatccagaactgtgagaaaataaatttctgtggtttaagccaccagtctgtggtaatttgttatggcaaccagagcaaactcatacaaatacctatcacataatcggagtatgtgttatctactctctggggaaggtttagttgctttgggagcctcatgatggagagcaaaataagaactggggggatcagggaaaactggccgggagagggtaggtgttagcctggtgaaaagccagtgggaagagaactttaagtagaaggaggagaatgtacacaggcctgaatataggggcatggcatgcttgggaaagtaaaagtagctcaatagggatgaattctagggtgtgggtgaatgggggactagtgagattaggcattagggcagtaagcttttattaccattcatatgcacacccacacatcacacatctatacacacacatgtgtttatactcattttgtttactgtcagtatctctcctctagaacataagtcctttgatgccctttctgtctcttttgttaactggtatatttctggctacttagaatagtacctggcacacagaaggtattcaacaaaaaaattgctgaataaataaatgagtaaactgcatgatttattctttagaaaaatcactttggcagcactgcgggaaacatttggaatgtggcctcaagcaggactgttaggagattgttgcaatagtcccgctgaagttgacggtggaggtgtagatgagaagactcagctaacgggtgagttactcaggaggtagaactaagagaacttgtaatgtgattgtctatagggcttaaaggagaatggtcactcccaggttcctggtgtaggcactgacagaaagatagggttattttctgaggtaagaaacatacaaagaaaagtagactttgggtctgggttggaggtactgagttcagtgttggtcatgtttagcttcaggtagcagaatgacatccaaatcaagatgtctacttggtggtgactgagagggggctgtctaggctggatcttcaacttagacgtgaacctaaagctgtagaaatggatggtgttgttcaagtagaaggtgtagacgcagaagatgagaacaaggagtattgagagaagaaaatagaaacaggaaatcaaaataagcagtgaaaagtttactgcacttccaaaaaactcttgaattccttattgttatgtttgtcattacattacagaactttaaaacaaatatgtagttcagattctagctctgaagctgtagtcttggtaacttaacctccttattccttctttttcttcatctctaagatgggtccaattataatccctacctttattatagatatgttgtgagggctagatgaaatacatgtaaagcctttagtattagaatgtgcattcaataattgttcactcatttttaattattaagtttaaactttcattatttttatttatttatttttttgagacagcgtctcactcttgctcaggctggagtacagtggtgcaatcatggctcactgcagccttgacttgctgggctcaggtgatcctcccatctcagcctcccaagtagctgggactacaggtgcatgccaccacacctggctaatgtttttttttgtttgtttgtggaggtggggtcccaccatgttgctcacgctgatctcaaactctgggctcaagcagctcgcccaccttggcctcccaaagtgctaggattacatgtgtgagccactgtgcctggccta

SEQ ID NO: 520 - DNA, 2615 bp, Homo sapiens
ttgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatga

SEQ ID NO: 521 - DNA, 8209 bp, Homo sapiens
tacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctccttgtgctaatatcttttgttggatattatttcaaaatatgtgaattttagacccttttgtggttgcctttgctgccgcttgttaagggcaaaataaaaacgcaagaaattcttttagcatgaagaaatacatttaatgagctccagaactcaaaataaatggcttcagctccttgaacagtcatctgtatgccattgacaatattttattagataggcgtttaattagaggaagtctgtgggccagattcttccctgcatgtgtgattcatatttggaaatttctgatttatctccccccaattgtgccatgtggcctgcacttaaaatgtaagtaattctgattttattctcaagaacttatttgaagattcaagccaagcaatgctgaaaaaagctaggcctgcaaaactaaaacatagcacgagcctctcaaaatttccaccaaatatacaaaatccagtctgctctgaatgtgcatcagaaactcaactttggttattagccctggaatttggtgccaaaaacaaaaatttggttttgttgtcaagcaatttctaaaggaagaaacaatgtaaatattaatctgtcattttaaatgttgttgaaactgccatgagtgtgcacacagctctctgtttcatacctgtaatcagtattcgcatgctttcagtccactgtttctacttaaagcattattccgtatttcagcacagaatgactttggtgaaactgtagctgttagtgagtaattgcgttacaggcagacccagtcttaaattaacaaatctgggttcccttaactatcaggtttatgttggttttatttgcttctatctggatcccttctctttgcctgggaccttattctgattagctagatttttaagagcttttaaagttacattccccagaaagactttttttctctggactttctcttttatggtctgtaaacatttctcctctgatggtcatggacttagttctaagactggccttcctctagtgtgatggtatgagtctattctattgctgctaaattttacaaattgaactgcagaagagtctttctaggtaatccctgtaacagagcaagtttctttgaaccctagccatgtatgtgtagtgttccattattggaacgctaagcatgtgggagttatttatatcttactgctcacggtcatcatcaaggtctgattacaaaaattcaaaaaattacaacctcaggcataaatttaaagaggtggccatttaaaaataatccgttgctaccatttccacttaaaatggtagctctctgatgagttttatattggctctctgttagccaagcccgtaagagcatatggagagaaaggtacgattgaatgaacttctgtgagcggcataaagacatttactctgacaacattaaagaatttactggtactgttttttttccttgttagtttaattccatctgtttctgtttaattgagtgaaacttaataaaaatggtgtctctagtgagcacatgtacacacctctcccagttgttgggatttaaaatgaagctgtgacttttaggccaaaattagcgtgacacttaatataacagttttctttctattaaaaaataatgacaaaacacacacacacacacacacacaatctgtatgatgatttggcctggagttgtagacatcacagatcaaaagtggcctggtgctagctgtttgggtatatccttgaaaagggcaactttgtcatttcctagagtaacctagagagagatttccaagcatttccccatgaacagaagtggtaaatgctgatttattgtgccatatgtgtgtttgggaggaggggagatagcgtcttgttttgaaaaaagttctcacttcataaaataaactgcacaccactccaaaaaaaaaaaaaaagatgaaacctcaagcaggaggaacttttttatttaacccctagtgaaagcaattaaacgtcttggtagatgctagggaagaattagaaaatcttcttttcctgaaagctttaaacattgaatagactctgatttattcaggatcatttcggtgtagattggccactcgacacagacatcacagcatggtagcctcgaaaccaagccttcagcatcttctcggcgcccggtgttggagtgttacttggagtggaggcagtgcatttgcatcttcatgtagtctccagatcaggttactctgatttgtcttggagtggctttctgtttgaaagtagggaagattaaaaatcaacttgccacgggatatctgatctccatgagtagttgaaagccagtctaaaaggttaactctacagggccggcgccgccagtgcggtcatggaaaatcgtgctgtgagatactggagtgtgctgctggggccaggtgcagcaattgcagaatgttgaggagtgaggagtagttagaaatcactgcaacatggaaaagcacacagaccaaggacgctaaggagggagcgaggactaccgggcaggtgtgcgtgtgtggagtaaaatgcatcggacagtgattgactccacttttgagtgagatgtggaggcggtagtggtgtgggggttgtgagggagtgagtctgctttattatgaatcaggattgatagctggccttaaagtgggaaatgatagaagggtcacttaggagcctgcagtggcatggtgaccagtctgttattactcatagatgaccttttctggctcttgaaaccaagctaacgactcctttttcttctgggcctcaaagtttctttgtaggaagtaaagcatttgtcactttccctgcagtgatttattgaaagactgaagataggtcttccttagttaaggacgcacactggctgctcgctccagaagcaccaagaatggctgatggataaatcccttacccatactcctgtttctgcctcctaaggttgctgtgaaaacctaactaaccaaacctcaccagcttggcctatattattaatcaaattcccttctgttctctctgtgtgtatatttaatactgtagataatatgttttatttaaaatttctaatacaccaaattaatttgaaatagaaaaggctggggacttcattctcatttttgtcatttgtttaatcagtttgggaaaacattttccgttgttccattgtatgcagtgtcttgtcagcatgtacctatctaggagaaaacgctttgttttcagcgttctgtctttaccctcaaagcatggtgtagcttctgttcttacactgttggagcactgtctgatgtctttttttttttttttaacactgctgaataccaatttgtacttggaatacctctttcctctagaatacagtgatcctattccccaaagtgcaagctttcatgtggaagcatcctaagtgatcgtcctgggtgatgccatatttcactaaagtgggaaaagaagaggtgaactttgctcttccaacaaggcttgcactttatactttgggcagtgcatgggagaaggggggcccttagaggtgagcaggatcactgtagctagaggagaggtctcactgaaacagaacgcatctgtgactgtagcttgcatggagagcctagacagccaaccatggatttgcctttatgttttgaatggaaacatctatttcaattgggatagaaacctttacctatgtcatatctgtaagagaatttagcttatagatatgtagatacgtgtgtgtgttgctgggtggggaagtgggtgggaatgtagaaaaggcctcacctgacttggtcccagttggcttctgatggccaaggagctgtttttcattttggtgggcacccaacatgtaggttctcacagatgctgtctggtttcttcttctctccatggcggaacaatgaagtacgtcaataaagcatggactcataccactgggaagaatgctggcttctccagtaacaatgagcttggtggttctttgagcatggaaggccaagctcatgtcacagtgtatgcacggtattaatatatctcttgttgatctaaactgaaggggcttttacttgtcctaacaggtatcatgctgtaaaaactgtccattgtaactgttctttcccactgatggctgaagctttgtcctgagtacaagatggtatttttcattggtacgaagcaccatgttcccaacccaaacactgcctccaccaccaccaccaccaccatcaccaccaccactgctactaccaacatcaccaccaccatcaccaccaccgtgttcaaacaaagcagcattctcctgtgtcttttcctcataagtaagaacaaggtagcacattcatttttccattagtgcatttcaattcttttcctgcaagttgcattgctattgcttttctgaattgcttgatgatgaactgtgaagctgatgcttagctgcttgtgaaacttttcttaaaggaactgggtctaagaagcacacatacattaccctcaacaacctcaggtatcaagaagaggaccacactgctaacatgggtaatcctataacctggcttttcttgtggaactttgtaatttctataaaataccgccagctttgcgtattccactgagccccaacttagatatcagacgctagtgagtcctgcctattcaggaagctacgtattattcagcataatactgcccttttttttgataactggctttcaaatgggataatctcaagagaggtttcattgtatcctcttagagcgtatggatttaaatagagcctttcaaaaaaatagatgaaaacctacatctctaatatatttcctacttgggccttttgagcatattctgggcacatagagagaaaatctcctatgttttagaacagaataaaagaagacaaattatggtagataagtggcacccagaagattgcaaaataaataattttatgtgggggaatattgaagaaaaagcatagaaacttttttataattgcactttaaaattttggaaaagaaaaattgagaatgcaatcagtagtctcatttttgtcagtattctgtcagatattagctattcaataagcatatcttggattactatttttttagttgtcagtttttctagtttccccctttataggaaaaaataatacctatgtggttaaaaactgagacccatttaaaaaacaggacaggtacagttaagtactagaaatgccgtttttatcacttgaaaaatagattagaaatgtttttcttttcccagaattgtgtgagtttgttttgaagccttgaataccggtacatggttaacaggcagcttgtgcccaatcccaaagcgggaagaaaggcctggctttggctcactgatgataaagtctcctcccactgcctttcagcagctctgccgaagagctgatcaagatgctgcaaacccagcttccccagaccggccaagagggaagaatgatgagcgtgttttaaattacaaagagagagcagcgcaggcagtttctggtctgggtgataaattgaaatccataaatatagcagtgctaatttgaagttccgtaattgtttgtgccatgagaatgtgtacatttgaaaggattttataaagcaattactagaaatgcctcccttgagagctgtatgactggaggtgttttcagtctgaggggggcagcataaacccaaacctcttctagatgaatggcagggtggcgggaggggtcatgaaatcatggggaagaggtgaaggatttgagagctactaacctgacatctaactgaatgcctaagaaattgcagggcaatttcaggaaataggaaaaataattttgaaaacattcaaagcctccagactttcggtgtgtgactgatcttttttctaatctctttaaacttctttccacctattgccttaatagcaggtgcttcctcttagggtccccccaaattatttacctcgagttccctaatgaaattactttgcattaatttgtcataaagggagaagtgctagaaataccgaggcattgataatttcatggagtagcaatgaatgtcagtcacagtttcctctccccgttgcccggggctgtgccttcaaagcaggtgacagactgcaaggtgtaaacaagctttataatgccatataaatcaaaccgggctcattttacctaacaacagaaccatgtttgtttgcttttttgtaaaatggactacttcagtgaaaaattgattccacgtagttctaataactctgtgaccttggacattggctttttatagacacagctcttcccacctgctggtatggacaccagtttgtacagactgttgtcacacaccctggctcaaagtcaaaagagaattttaattactcatcaagctgccaaattctactaattgcccccttgtcagcatatttcattaattgctgaaaggtaaatgagttacatattttgtttggaccacgtcacctgtacattttcaaagcctcggattgtttatcttgcaaagagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacacccattgccctttctttcttaggccctataagcaaagctggagtagcgtcttgggaaaaggccaactgaccaccctaattttgtcgttccaagtctgcagagcgcacatattaagtagttgttactgacatctttaggctccgtgagtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggcctttgagagtggaggtggctgtatcggagtgtgctccccctactttttcccttgccccgagtggcagttcttttcctctctgttgccggatgctgtctagggcctgttagttgctatttccttgcctccgctccccttcccactagccttctaactaccttttattctcggctccaactctttcaatgatgaggtgaatgctttttctgttccacgtcactgcaaagtcaaggtgtccagcatgctctcacttataactgcctcacccgatctcacgcacagtgcgagagctgaaggtaagccccggatgttgccagattacggtggacaaataaaaaacaactctccaacagcaactcacaaatgcatgaaatgttttaacctctagacagactgccagaatttctctcttctaattcctacttgtagtgataacatttttctttttgtgatttttttttttttaaataatagtgtagtaccttgaaacaactgcagttctaactcattgtcaccatttctgtttgacacgttccacttcctttgcaattattgtatttagttgtgcactagtgtcaataaaattgacatttgtgaagcaa

SEQ ID NO: 522 - DNA, 7186 bp, Homo sapiens
agtttcccaaagatctgactgagctgaaaatggaccatgctcaccaagaccactggtaaaaactttgggtatattaaccagaattatttttaaatttctggccacactgccaaaatcttgctgaactttgggttttcttgactttgtggaagtgtttctttcatggaactgctgggatcaaaactgcatctgtcttagggatgcagattgtggctgggaaatgagatgtgtcttaacttaaagaatgtctgagcttcttcagagtagctcagtttaaaatgttttcttattgactgattgagatgtgcaagcggctgccacctgacttgtaaaaatggattttcaagtgtatttgttttttagatagcttcatactgagtgaaggaatacatagcctggaatttcctctaattataagcctaatccagttagtgcacaaatctggcagatattttagtgtaatacaaattaatgttttcgtttgcttcacctgatttgtttagttgaaacttaaatgtgttttaaatgtgaatttttagtaactatgtatcaattgcaacgatcaacaattttttggagaaatctggtagctttactctcctataaccttgcatgtttttgaaatattttctactatgattgcaaaatgatactactcttcaactgacaaatcaccttcatcctttatcaaaaacatcttcctctaagaagcctagtttcagtttggcagaagagagaggctatacgtttttaaggggtgacaatatgcttttagctcagccaagcctggtttattagaccttcaattaaaataatgagttcaatggctatttagtttattagtgtttgtagtagtagtgatggtagtagtggtagtagtactactaattacatttattgggcactgggtaagactaagtaaaattagctaggtcatctcatttaatcctcatagcaattctgtgaggcaggcattattattatccccattctaagatgaggaaactgaggcacagtgaagtcagatgacttctccaggtggtaaatctagaaaacagaacagttcaggcccaaacagtgtcatttgactcaaaactcacagttgtcccaaaatactataccagcatactgtctcttacctaaatagattgtctcgctgtaataaaacatgaatggctagtggcaactctttttgagcaggcaaaatggatgcttaaaacttaatgtcagtcattctaactctggtttaagcaccattgtaggtggggtcctggaacaggttatgaagaatggttatgaagaatgatgtcaagtctgccatctctactggatcatgctctgaaagatcttttagagtttagacccattcatggcaaaatggaataccctagaagtaggggagagaggcaaaaagaaagggagagagactgagagaaagggaaaggaaaagagagagagcatgctccatctttaccactatcaaggaatcattgaccatcctacatctctccaggtccttctcagtgacccaggacatctcagtacaacgtagtatttcagtctcactgcctgaaatattaaaggtcaaaacacattttaaggtgttatctctttcctgtctcattctaatcaattttgtacatagctggtttcatttgaactcaatcattgtgatttgccccttatgggcagctacaattaatcaagtgcatgttagtcaacatagtttgtgtacaccacataatgaaaatcccatgaaatttaggcattttgaatgttttaagagcaagcctcagtgagacttcccttgcagaaccgacttcccagctggagggagatgcatggcccatgcctttcccaaacaaatgtgtttgtgacatttccctgtgtaaacgctgactttgttggggggaaatctgtggtgcctggagagatgggagaaatagatttcggaaatgctaatctaggggagcaatccgcagtattgcagcctgctggggctgtgttctgcatgctccccacagctgcctctgagcgaacttattgacaaaggcgaaggaagcttacagtgcaccaggatgactcactccacgtttactgggtggttcacacggctgcctgcttgccggaacaggaaggcccttattgtgctcaattgttttcctgaatgcctttctcaacaacagcaaaaggaaacattactttttggcttccagccatcctggccacttggtacttccagtgcttagaatgcaaaagttgggctcagccaagacatgcagaggcacaaggctgcagttatttctgtctgtgtttcagattaaccactgccttttgcagtaaacaatccagggtgatttaagacaacgggaactccctttactagcaacagccccgacccgagtttgaccgtttgttttatggacttgtttcatgtacagtaaccccatggggggccttgacaccaccacccactgagttgcctgaataaaatagaaaaggccctgcctgtcagttacctccttcttgaatctgattgttccagagatactgtgagggaggggaaagtgcagcctggagaaaaagggaaggaggaaaccagaaagttaacagcaaagggaatagagtcagagtgctgggggctccccagcctctggatgtaatcacaggcacagtaagggctaatggtggtggttttacccttccatgctcttgcatttgatgtctttcctgtgctcagtgacaagtctgaatctgtcttcccctctggacaccttggcctggtcctttactggttcttcagctgctgctgccctggaaaggctgttattttttagctcaaggggccaaagttatgctgcagtttgtggccagaaaatggggatgggagatgaagtggcaaaacagagtatcagcagagtaaacagacaacctaccaaatggaggaagatattcacaaactatgcatctgacaaaggcgaaatatgcagaatctatagggaacttgagcaaatcaacaggtaaaaaacaacctcattaaaaatgggcaaaagacatgaacagacacttctcaaaaaggacatacaagtggtcaaaaaacatgaaaaattgctcagcatcggtaatcatcacgtgtccggaattggtgggttcttggtctcactgatttcaagaatgaggccgtggaccctcgaggtattacagttcttaaaggcggcgggcgtgtccggagtttgttccttctgatgtttggatgtgttccttctgctgtttgggtgtgttcggagttttttccttctggtgggttcatggtcttgctggcttcagaagtgaagctgtaaaccttcatgatgagtgttacagctcctaaaggcagtgtggacccaaagagtgagcagcaacaagatttattgcaaagagtgaaaaaacaaagccttcacagtgtagaaggggacccaagcaggttgccactgctggcaggggcagcctgcttttattctcttatctggccccacccacatcctgctgattggtccattttacagagagccaattggtctgttttacagagagctgattggtccgttttgacagggtgctgataggtgtgtttacaatccctgagctagacacaaaagttctccccctccccactagattagccagatacagagtgctgattggtgtagttacaaaccctgagctagacacagagtgctgattggtgcatttacaaaccttgagctagatacagagtgccgattaatgtatttacaatccctcggctagacataaagattttccaagtccccaccagattagctagatacagagtgccgattggtgcatccacaaaccctgagctagacacaaggtgctgattggtgtgtttacaaaccttgagctagatagagtgtgctgattggtgtatttacaacccttagctagacataaaggttctccaagtccctactagactcaggagcccagctggcttcacccagtggatctcacacctgggcagcaggtggagttgcctgccagtctggcgccgtttgcttgcactcctcagcccttgggcggttgatgggatcagcaccgtggagcagggggcggcactcattggggaggctcaggccgtgcaggagcccatggtggggtggggaggggaggctcaggcatggcaggctgcaggtcctgagccctgcccctttgggaggcagctaaggcctggtgagaaatcgagtgcagtgccagtgggctggcactgctgggggacccggcacaccctccgcagctgctggcctgggtgctaagcccttcactgcccggggccggcagggctggccagccactcggagtgtggggcccgccaagcccatgcccacccagaactctagctggccggcaagtgccatgcgcagccccagttcccgcccgtgccactccctccacaactccctgcaagcggagagagccggctctggcctcggccagcccagagaagggcccccacagtgcagcagcaggctgaagggctcctcaagcgtggccagaatgggtgccgaggctgaggaggcaccgagagcgagcaagggctgcgagggctgccagcacgctgtcacctctcaatcagagaaatacaaagcaaaaccacagtgaaataccacctcacacgagtcagcatggctatcacttgaaagtccaaaaacaacagatgccaatgagactgcaaaaagaagggaacacttatacgctgctggtgggaatgtaagttagttcagccactgtggaaaacagtctgaagatttctcaaagaacttaaaacagagctaccatttgacccagcaatctcattattgggcatatactcaaaggaaactaaatcattctacctaaaagacacatacacttatatgttcatcgctccactattcacaatagtaaagacatggaatcaacccacgtgcccatcagcggtagattgtataaagaaaatgtggcacatatacatgacggaatactaaacaaccataaaaaggaaagaaatcatgtcctttatagcaacatggatacagctggaggccataatcttaagtgaattaacacaggaacagaaaaccaaataccctatgttctcacttgtaagtgggagctaaatatttagcacacatggacataaatataggaagaatagacacgtggactactggagggaggaggaaaaaaggggggtgtgggtgggtaactccctactgggtactatgctcactacttgggtggtgggatccatacccaaacctcagcatcacataatattcccatgtaacaaacctgcacatgtaccccctgtatctaaaataaaagttgaaatttaaaaaaaaatgtttcggcccagcatggtggctcatgcctgtaatcccagcatgatttgggaggccgaggcaggtggatcacaaggtcagaagattgagaccatacactgtgttaaccataacagggttaacagagtaaaaccctgtctctactaaaaatacaaaaattagccaggcgtggtgggcacttatagtcccagctcctctggaggctgaggcaggagaatggcgtgaacccgggaggcggagcttgcaatgaactgagatcgtgccactgcactccagcctgggcaacagaatgtttctcttttcaactcagtattgctctgggcctcaagtggcccccactgtgttcacagtcttatgcacctaccgtgtcatggttttcagagctactctgagctttctctgtccaggtgttcaagctggaggccacggaaggtgcgtaggaagggtaggggtggcaggaggaggcagattccacactgttccttctggcctctctgctcccttttcccttcctcctttcaggttctcctgcaccaactccacctacgttaccagcacaggatctggagctcacatgcagattatttcatgccaaggtacacaagtaacccttcctaggccacctgttctgacccacctgaaagcttaaatcagtctgggctcacccagagcatcctgctgcatgagctccttccaaagcccccaggacttttgccagtctttagcaacatggatccctaaaaatcaggttgttcaaaagtgttccatgttcaaaatagtttgagaaactagattaaaggaaagcaagcaggttcttggcagcaggactcctcagatacatggctgtgttgctgcatgctgtggctctgcaatgaggctcaagtatgtagggttctcttgtgctttagactggttaagcgccaatgccaaagagggaacaaaggattggtacttttccttcaactgattgggcctctctcagagaatacaaactcacaaaatgagaggaaaagtacagcaaactttgtggctgcctttagcacccctacgcctactggtggtaaagggaaagtccactctggagaggggaagggtcactgctttcagaccctgggcagggtgacatgcatggtgctggtgggtggagccagccacatctgcatttaatgtataatacttcaccgggtgtagggtggggatagccagtatggtggcaggtcccattggagcagcagcaataggttggttgtgggtcctgctacatcaggctgtttttgggaaaggacctgaggcctcgtcctttggcaggacaaactggtagagtcagggctgccaatgaaaatagccaagctcatacaagctagggtgcatagactcatctagctcatgattcgctccggtacatcaaaaagccagcaagcccgacagcagcaaaaaacaagtcaccgtcttaaattcaaacatcatatttgtacacaaattatactgtcagtgtgttctaagcagatggaatcatcttgttcatttcttggggccagagtgataatcccatttggtggccgggcatggtggctcatgcctgtaaaccccagcactttgggaggccaaggcaggtagattgcttgagcccaggaatttaagaccagcctgggaagcatggcaaaactctgtctctgcaaaaacaacaaaaattagccaggcgtggtggctcactcctgcagttccagctactcaggaggctgaggtgggaggatcgctggagcccaggaggtcaaggctgcagtgagttgtgatcgtgctac

SEQ ID NO: 523 - DNA, 976 bp, Homo sapiens
gggcccaggctgtacagctggcagtgcctgacagcctacctgacgctgaattggatgggatacagcatagggagcagtagctgggtgaggtaggagaagggagtcggggttatcacttacaaatggtactgaagcctaaactctgaagtgagtaggtgctgtgcttttatgggcctctttatgaagcaaattatgtaaaagttgccatcgaggacaaacaagtgaaatactttacacattacggtggattggatgaaaattggaatgaatgggctccaaaaagtagagtactcaggtacatgaacaccaatctgtagaaaccgggagaacttcgagaagcaaatcaggaacaaaattcatgggggaagaggagagaggctgccccagcaaagaagacatctggtctgcaagggaaaaatgttgaaatcatgtggaaatggaaatggagcagtaccaatgagatacctcagcctcctcagaagagccccagtagatgccgctgttgaaaacattcatgaagagagttgaagttaaagatttctgaagaattaaaaccatgttttgttgatgagtgagacataatgaccaaacaaaaacagctttatcttcgtgccaggaaaaatgtggattctattgtagagaattatgtaaattacaagaaaacttgagggaccacagataataaggagtatgtttttaatatggttgtggcaaaaatggaaaatatttgaatataatgttaggcactcagatactttacaaatctgaaagactccagcatgctgaaatccttgaagattacccagaggcactcaagttccaggggtatggaagaccacatctgttgatataatttgtatgaattggaccaatgttgacccaaacacctctagaggagaagaaccttgctttatgactgaactatcttcataatgacttcctggtaaagaattctgcaattttatttaaagccaac

SEQ ID NO: 524 - DNA, 2653 bp, Homo sapiens
ctctattggtccctcttttctattggcacccctcttcctgtttgtctctcattcttacatctcattaccatcgtccctgcctcctaattggtccctctttctatcattcttcccccccattggctgtcttcctcattaatagtctcttctccaggagtcctcatttcctattggttttccttttctcttaggtccctcctccacttttctctcttccactggtcccaccttcttcagtagtttcagttgacctggaggactcttcctctgttacgccctcctctactgtacccctcctgatcagtagtccattcttcattggacacttcctgcccattgattcatcttgattggtcactctgtgaccattggtcttttcctaactggccatgccctctcccattggttcttcctttctattggttcttcatccaatggtccacctccatcattggtccttttctaactgtccccaccctccctcatggatcctccctttctattggcccttcctccaatggtctaccttcctcattggtcctttcctaactggccctgccctccctcattggctctctcttcctattggtctgcttccctccttggtccttttctaactggcctcaccatcccccactggctctcccttcctattagcccttcatccaatggtccacctccctcattggtccttttctaacttgccgcatcctcccccattgtctctgccttcccactggcccttcatccaatggttcacctttcttattggcccttcacacacaggcccaccttcatggatcctgctgatctattggacctgttttttcctctagtgactcctctggaccattgatcctttccccttagtccctcttccatcagctatacccccattcactgtctcaattcacatccttcagttggcttttgtgctttattggtttctcttcttccatcagttccttctccattattccttcctgctgttcaatgaatcctgatcagtcccctttgacctttgacatccttcctgattagcatctccccactgaccttccctctttattgaaccttcatcttatgttccatctctcccatgctattcacccattggtctacattttccattggctgttcactcactggcccagctcccaaattcactctccctcccccttgacctttctcccattgaaaccctgtcccattggtcctcaccattagcccatcttcccatggcccctcaccaattttcccactccccatcctttggcacacttccccaagtagccagtagcctgctccccaccagcctcccactactgaccatctgctgtcttgccccagcccaggatgtggcagctggtggtgttggctgagcagtccctctccaggggaaggggctggatgagttcagagagtttggctgggcgtgccaggcgcaacagcatgatgtcctggtcatggctggcggcatcatagtcagggtggatcacagcccggacaacagaactctgctcctgggaactctccctttgccgaaggttatgcttccccaggaagacctgaagattcctgggaaggaagagggctgggtctcacctggagcccttgggctgcagttgaggcttcagagagggctgggaagtcatgaatcgctggcctgctcctcccacagtcttccccagctgggtaaatggcaattccatcctttcagaataatcttgggggctattcttcactctctttatttcatgccctacatccaagctgtccagaattccttttgcctctctgaagcatatccagaatctggccacatctcacctttcccacggctaccatcttggtttgagctgccttttcacttcctacctgaactagagcagtagcctcctcactgggctccctgctctgtctctggtcccccacagtccatcctccacaaagcaaccagagatattttaacaatgtaagttggtcctgtgcctcctctgctcagcccctcctatgactcccatctcactcagaatcaaagccaaagttctcaacgtggcacaccaggccttgcaagcactgccccatcatctcacagacatcttctcctcccactctccccttctctccctctgctccagccaaacgctggcttccctgtcttgccttgaacacaatagtgatcttcccacctcagggcctttgcactgctgttccctctgccagcaagtctgtcctccaagtatctgcatagctcactccctcacttcctttaaatgtcgcctctcagggaagccttccttagttgcccaattaaaatacaaatacctgttagtaggcaattcctatctccctcccctgctttctgttccaccagagaacctatcacaatcatccgacctgctatatatttattgttaaatatttactcattgtgttatttctcctccttgcagagcaatgctgtccactaaatgctacgatgccatgatctcgatctgcactgtccagaggtggctgggggaaccacaagctacaggctgagggagagaagatctgagtcagagaggagttctggagaaaccaagcgcatccccctcaacatgaactccagtcaagattggtcaggtgcagtggcttatgcctgtaatcc

SEQ ID NO: 525 - DNA, 1669 bp, Homo sapiens
gaagaccccaaatgacatagaaggtcttggagaagagtccaacagagacatatattcacagacacgtgtacatctttatgcccacacagaagggtaacagcagccttgcttcagaggccacaccttccaggaaacccttcagcctgccgtgtcttagctgatccctctgccatccccttgcagaaggagcttggagtctctcagctcagctggactagatgaatcttctcagggtcgtcttctcccacctctggctcccagttccttcccccagtctctccctccctgctctgtgtgatcagggaagctgcaaacccaacccttacatcaaaagggaacttgaaaaatacttggagcaaaaactgctaactgtgcatccttgctgtatgctggcgctgatattaaatcaggaaatggcactgaacagccgctccgaacacagaaacaggggttgtcaacacagcaaccaaaagcaatctctaacgggcagaggtgaaagggacctggcacagggccaggaggggggctgcaacccaggaaagaattcctgagctgagtgtgtctgtgccacctctccagtgtccagaatgaagcctggatctcagtccctggcatggaatgcaccttgtctctctccatgagggatgaaagataattagataattaagcatgttgcttaaatacctttgaaattctcctttttatttccatacatgtttaccgagcacccactatgtgcctgacagtccaataaaaaagatgccttcccatgtggagatgaccttctagccctcaggacagaactctgaccctttgacatggcattcaaggtccttcgagtgttggctcctgcagaagctttcatctctgtttccagcctccctgaaatagctccccaagggcacgaggcagtacctttgctccatgcctttgcttggactagtcctaccaccagcaattcctgcatttctgtgtttggcaagtttctgctcagcctccaaagccttaaccaagtgtcaccttttctctgcagcattttctgccaccctccccatttcttccaatagaaccagggatcttttacttgggatccagaagcactgtggacatattgccatcacaacacctttcatgtcacaatggcaaggtttgcactgtcttggaggagaggaaggaagccatattcatccctgaaccctcatctcccagcactggttgtaaaactgaaacaaaaatggaaaaccttgatgaaattcattgttggtgtggctatggggaaacagattttccatttctgatagtaaatgaaataggcaccatcttgttagaggctaatttgacattattaacactgaaaatgcacacatctttcaacccagcaattttatttcttgctttctagaggaatgtttgcccatgtgcagaaaggcgcatgtaaaaagctgagttgcagcattgtttgcaatagtaaaagatttgaaattgcttaaatgtcggtcaatatggcctggataaaaaactatagggcatccattggatagaatgctatgcattagttaaaaagaagtagatttccatgtattgaccaagcatttgctgagtaaaaatcaaaagcaagctgtagctctagacatagatgttaaaattacattgctgcattttttcacaa

SEQ ID NO: 526 - DNA, 2707 bp, Homo sapiens
agtcacacaagtgcttttccttgaaacaacatttatacttttgaatatactacaaatatttaataagcacagcctgccctccatattcgtgggttgcacatccatggattcaaccaaccacagatcaaaaatattcaagaggccaggtgcagtgtctcatacttgtaaccccaacactttgtgaggccaaggcggaaggatcacttgagtccaggagtttgagaccagcctgggcaacatggcaagacctcatctctttaggcagggcagggaggagggaagaaagaaaaatattcagggggacaaaaatggatggttatgtctgtatggaacacatacagacttttttcttgtcattattccttaagcaatacaatataacaactatttacatagcatttatgttgtattaggtattataactaatctagagataatataaaatatatgggaggatgttcataggccatatgcaaatactacatcattttatataagggacttaagcatctgtggattttggaatccttagggagtcctgcaaccaatgtctgatggatactgggggacaactatattatgtacttcctatgtcatgacattgaatattaaaaatatatatacttaagattttgaggtttaataaaatttatgaattttactgcttcatcaaggatattcttaagggaatttggcatttttaaaaatttcaattgcatggcagtgaagaatctaagaactagtatactttggtgcactagttttggtacactaccttgatttattctaaagcactagcatttttactttccattgcttttacaccgtcagtgcaaatgacagcatggtgagaaaggcaaatgatgtcctgttaccaccatgaaaatagtttttaactcacagactcctgaaatagtttcaggtatccccaggagtctgtagaccggactttgagaaccactgccctacatgattatccaaaacaatatgtcccttgagttctgaatggtaggagaggagaggggaaggcagaaaaattgtcaaactaggctgttttttctctagttctgaaagagagtaatagggaaggaggaggttatattgagtttcacagaatagattgggcacctgagggtttatctcactcatttagttgcagtcttccttgtgacaattagaattatgtctgcttggccttaatgggtcatatattccacagaattctgtacaaaatgtaaatataatattgtcaaatgtcttttttttttttttttgagacggggtcttgctctgttacccaggctggagtgcagtggcatgctcacagctcactacagctttgaactcttgggctcaagcaatcctcacgcctcagcctcctgagtggctgggaccacaggtgtgcaccactatgcccagcttttttgtagagatggggtcttgctatgttgctggggctggtctcgaacaccagacctcaatcagtcctcccgcctcagcctcccaaagtgctaggattacaggcatgagccaccacacccagccaaaagtcttttctaaacagaaaactgctgatttattgtgaaaacccagtcacccattctcagaacgattgtaacttttattttgaatttagatcttttgtagaaaccagaatatataaggtgggataaaagctattagggtttcaagtctggggaaaaggcacacggtttccagtttcaaggttttttccatatcctaccataacacagcccacagctttttgttgttgttgttgttctgacttctcgtctatagactaaagatagatattagtgacataatctttaataataagtaacagctcattgtcttgaataaggtatgtttaccttgacttaatatcgtttgtatttctaaacacatttataaattgaatcatatttgaaatgtattaggaagatttgttctttgttgtttatgtttttttaaagcaaacaattgcccattaacttctatttttaaaattggtaatgtgccttggttgtttaaagcaagatatatctatttagtctagcttcctagaatttgtttcaactttaaacctttctttaaacttttaaccctttccttcattcctattcaatcttctgcaaaacgctcaacctttattgcgcaattgctgtattgaacccattgtctaaaactaaactttctcctcgtaaagtaatgttgatttttcacagtgagatgacttttcatacgtgttactagcctactatctcctacttctgttcactttggactactgcagtggtgacctagttagtggtctctgcctgactagtcacttctgtatttaattcatccaaaagactgttgcaaaatttattttctttgcatgttcctaccccattcaagaatattcattatgaggccaggtgcggtggctcacgcctgtaatcccagcactttgggaggccgaggtgcgtggatcacttgaggtcaggagtttgagaccagcctggccaacatgatgaaaccctgtctctactaaaaatacaaaaattatccgggcatggcggtgggcgcctgtaatcccagcttctcgggaggctgaggcaggagaattgcttgagctgggaagtggaagttgcagtgagctgagattgtgctgctgcactccagcctaggcaaaagaataagactcctatctcaaacaaac

SEQ ID NO: 527 - DNA, 7209 bp, Homo sapiens
gagtgcaacagctgatccctttcggagtggagtttcctagctggtgcctgtcctctcttgagcctttgtttcttgagtgagcactcactggggctgtggctccatgaactggatttcaggaaaccagccaaggcattctctctctctctccattcctagaaaggcagaaagcctgggaatgggttcggcaggaagatctctgtacctcaatctccattgctttcagcaccactggctttctccccagctcaagtgcaaaacctgccatcgttgctacctggggtgcctcagactcacccaagtcccccaggccagaggacatgctctcaagccttgtttcagaaagagggacccaaaggctgttagggaagagaaccagggtcctcaaacccagggttttctcacccactgcctctgctctggctgtggcctgccagacctctcctctgattttcgctttccttcctgccagtgcctttgtttatccgaggcgccaagatcccactgtgaagtctgaaaggaagaccagtggttctcgcttttcctctagatgctgtgtctcccaatgtcatcttctttcctctcaaagacaattggacgttgttacagattttcttggaatgagtaaatacctagcagtgggattgctggatcatatgaaaatgccagactatatttcatcagcaacatcggagagttccagttgctctacaccctcactagcacttaatattgttgatcgctgcctggattcacagaaggacaaattacaatgcattttgaaagactcgtctacagtcaactaaaataccagttatcacagacttcactggccttaatgaggaggctgagagggatttaattactgggacatgcaacgcttacaccaaactctgttcgattcacgacttggaaaagcaaatgtggatacagatgagtgtggacatggcttcagtaggaaatgtcgagtttgttcatcactctgaagtttcttcagctgcaacggaaactgcaccctccctcccgacttgttggttatcttgctgtgctcccaagaaggtattttctgctgacctgatagatcaggtaagagaatagcaatgtgtcttttgtcatctgcctccagttccctggctgcctgcattgctgtgtttgttatctgtggattgaaggtgacaccactctcaaggagggtgaaggcagaggtgtatgcacagctagtaccagtaacacccctagagtgagccaagagaagatgaggtaaggaggaaagggagacttagtcatgggcctaggaaaaagcgtggggggttacctatgtagaaggtatggatggtgaagctggatctctttttacctgtggtgagcacaccataccggacaacccagggcctacattatagagggtgcactctgcacatgcaatgcattttgtcaacagaaagctctgtgtaaaagtcttaaagcaactctttagaaatcctgtttcattattaatttagaaggattcaaataggaaatgtggcaacagctgtaatgggtattaaaagcccccactggcagtgctgggtcttagctgcctccagtggtgatcctcttcaaataaggaatcttgagccaaaaatccacccttcctgttaaataagtgttcatactcattattttattataaaagtcataatagcttgacagtacggcaaaggacagtgaaagataaatgcacataagtagtataatgcagtaattaagagcctggtaaaaatctcaactctgtcacttaataacctaaatcacttaatagctttgtgcctcaatctaaaatactgataataataacagtaataatgtttgccttcgtgatgttgttgtggagaagaaacaagttaatatagataaagtacttaacatagtatcaggccaacataggatcatagcaagaggaagcattcaataattagttgtggttgggttatcattattgttgttgctattgttgttattatgacactaacatctacaactttctgtatttcatctgtcaacaaatatttcaatatcaaatctgatcctgctccttgactcagacctttgtcattttgattgaaaagatgtttacctgttggtccccagcctcactcttctgaacctcagatccactgagtgtgtatccagaggtaagtatgtggtaagtatgcttgtcatttacattatctgtcagcatgagtattggtttcctagaaacctaatattgaaaacacttagcattgctaaaagcattaaatgaaataaagactcaatatagctgcactaatctgtgctttctaaatttactgatggacgtgaagaaagtaggttggcatggagtttatacaatttatggatcacactgatctgaattcagacagtgtgtgctcagataaaaatattgtttcctcccatgaggtttccaattttgcagagaagaatacctctgtttagctcattacttaacacaatgggtagctgggtggccttgcattctggaagtgaaatgacacaagaatgtctccactgcattctccagaggtaaagattctctggcacaaaatcacaaccaaggtggggttccaaaactatagaacaaatggcagcagccatgcagccagccttggttcgggtgggctgtaaaagcagaggttgtcctcgtgttatcagcactgacttcctgttgtggccacactgacagagatgagatggcagaaagcaggaaagagaccagagctgcaattgacagatggctggccaaagttgaagggtcagagactacaccaaagacttctcagaaaatacttgcctaggaggctctcacttggaaagatattcagggttgttaaacatatcctgttattaggaaaacgagagttttatctttctcttactcagaaagaaaaaacaaaaagaaaattagtgctcttaagaaaagctattttaatgttatccattataaaattagaaaaccttgaaaggcaaatgtttcttctgaccatttacactgagcttctttcattatctcatatgcaaccttgtggattgaaggtggagagtccttaggattacccaggaacatccctgtctgctccccctgctaggcaggaggagatttgaaaccacatgtgtctacttcatttctgtcacgggtaggacagtgtcatatactttgtaggtaactcaaagatattataggtaactcatagatattgattgaattaatgtttaataaaatgagaacaccagctctgctgttatcatcatcctcatttcgattcgctgaactctgcaccaaggccaaatacattatactttaggctttgttaaagccatctatgtaaagctggctgaagtcgaactgtacagtaaacaagagatggtaatagtctctgcatgtgttatttctttcaactccaaacctcaaagcattttaggaagaaatactatttcatctttaaaaaaaaatagaaaaaagaaacttctgaaaaattaatgcaatctaaataatagtcattaaaaagtaaattatggtaaaatggcatactatgcagtcattaaagagacgatgttgctctatacttatttacatagaacattatccttgggaaaaaaacttatttaaaaaatagaaacagtttaaaatatgtttaatataatgcctttcgtaaaaaaaaatgtatgggtatatgtgtaaaaatgtgtatgggtgtgtgtgtgtttgtaaataggaaataattggaagatattcaacacaagtttccatggatgagatgggaggcagatgataagtgatatttgtttctatattgtatgtattactacattttctgtttttatagtaatgaaaaagtattagtttacattctgaaataaatgtaactagcttaaaataatatgtagcagcaatcttaaaaaatttttatttactaaaaatctcatcatccaataattatttaaataccttttcatactatctgtataagttagctaatgttttataacaaagccttgaagtagtaatttattattatggcccatgaatctgtgggacacctgaggactaagtattgactgacttaggttgagcttcactgacattatagactgaattatggccttcaaaattcatatgttgaaatccaaatccccagtacctcagaatgtgattgtattcagagatggggtctttaaagaggtaattaaggtaaagtgaggtcataagggtgggttctaatccaataagattggtatccttataaaaagaggagatttggacacaaacctgagcatagagaaaacaccatgtgaacataaagacagccatctacaaggcacagagagaggcctcagaagaaatcagacctgctgacaccttgatcttagatctccagcctgcagaactgttaggaaataaatgtctgttgttttaatttacatagtctctgatactttgttatggcagccctagcaaactcacaagctgctatcaactggggtcacattataggttgactaggagacctgctctaagctagatctgtgtagggtactttagctgggggaactcatctccaaatgtctaaatttcttcttcaagcacctgtgaacttcaagctctggcatatccttctcatggatggcaagaacacaagagagaaagtggaaacatgcaaaatttcttgagacctaatcttggagctagcacactgtcacttctgtctcattctgttggtttaagcaattcacatgactaagcctaagatagagaattatgctgtgtctactatgggaaagcattgcaaagtggcatggtaaagagtgtagatgccggggagggagagtagggcagagcaatcagggccaatgatataatctaccatgataccttagtgttcacatatctgtttatattgcagcattcttagtccacatactgtaactatatatttccaatttcactcaatatttaatcttatatcacatttttaacataattcattttttattttatcgaatgcataatatatatattaattgagacttcagaggtacatggtcaattgcacagtaggatagtgaggaactagaataaggaaaatcacattgaaaatttgttccaaaaaattagtcagtaaaattagcacataaataaaccaatataaaagtttaattcaaatggaaaatttcataacagcacagtatagtgttttgcacatagcaagcactcaatcatgtttgttgactagactctatgtgaatttgttttgaatgtgggaactgttgctaaaacaacacattcaaaatgtggaaaacctcattttttgaaataaagaacaacagcaacaataaaaaatacatacaaaatactgatgacagtataaactgtaaaatgtcacaatttagtatccatcctcagctttctgcttagaaacatgtggaagcattttacaggcctgttaaaactttttgatctacttggatgaaagattagctaaaatttagccattctgttaccactttaaaactatgattttatttttgcactccaaacacttttaagttactgaaaaatgaataatcaaagaattttgttttctgaagagagatagcctcatttttctaagaggatcaaaggatgagaaagctttgttgaaggtttccttctaagagaaagtaaatcttggctccaaattcattttccaaatcaggaagtagaaaattttttcaggaaaggattgaactagggaagcagaaaaaaaaaattttccactggttaattattttgataatttggttctaaaaacattaccagtatatatattgctaaaaaaatattttagtgtcttatatggtaagtaattccatcatttaaaaagcatgtggaaattgcaaagctaaatagcagacatatatttattatatttggttcatgcacatactctagggatagctaaatgtgtgtatagtactcttttgtatcctctatgaaacctctccaaagctattatgaattatattgtttaaatatgtcctcactcagcttcatgagagttattcccaactcagtttcaaactgaacacatgttgcatctgttttctgtttgtgaatattgaatgtttggcactttcattgggatatttttctttggaatgaaataatttcaaatattcacttaatcaaaacatcagtttccttttccagtttccattgtggattgttggtaggtttcccagaccagctctcttgtgctgtgcagagggaccctcctcctcttggtgcataggaaggaacagaggggaaaggaaacaacatctggaccatgggcttgtcccttctccacatcttgttcctctctagatttcacctgacttgaggtctcattcaagtactcttgaagattttaactgttttgtcctcttctgattatttataacttcctttttttctttttgaaaatgttactgggagcagaataattgaagttctgtgaagccactggaaactcactgctccctctcctgccagtttcaataaaaagctttttttttttttttgaggacctatatctttgggatatacatgtttaagcaaaattaacctggcaggggagatacattgagaagggttgattgaagcagtaagagattggaagggggaaagacaaactcagaggctctggccaccatgcatggaggaaatgaggaagattactgctgtaaaattcagtgaaaaaaatccatgtgctactaggaaaagcatggacttcaaaatcagaaaaattggagttgaatcccagcccaacaactcataaactctgtgacttcaagcaagcttttcttgagtgaaattcagtttgaccagctaatacgtgcagttcctagactcccttggaatctctccaagagacagatggagtttcactcttgttgcccaggctagagtgcaacggcatgatctcaactctctgcaaactctgcctcttgggttcaaatgattctcctgcctcagcctccctagtagctgggatgcttgactggcctagcctcccagcctacatcattctcctgtgcgggatgcttcctgcttcaagcatcggactccaagttcttcagttttgagactcagactggctcttcttgctcctcaagtttgcagacagtctgttgtgggaccttgtgatc

SEQ ID NO: 528 - DNA, 4523 bp, Homo sapiens
gttatgttagttctagtttggcagggggaagatagcaaagaagtttgagccaaagactcagtgatatttgtgaacttgattcgtgtcctctaaaatgtgtaagtgcatactttctctgtcatttagagacttatagctggagaaatgggctaagatttcagatttccaaatgttggatttctttatacttaaataattattatcaataagtttttatttggactagttttgtttggagtagtaatttaaaataaaataaatatattttcaaagaatgaaatctgaagttataaacaggagtgttatttacatttttgtacattaagttagcatttaagaacgtttagccatttgcataagaattcagtatttgaaagcattaaataatacaaaattttcaaaccctccatgctaatttttcatatttgaactttctggaatgccttttctgcccacttgttgtccatgtccaagtagaatcttttaaaattctgaactatggtgataggttttgtgtagaagagatccacagataggtttatttatcttaaaatgtaactcaatattctgaagtcatactgaaaaattctgtggacagtaagtagtttcagatgctaacgattttcagggatgaatcacatgacagctgaaaaaataccatggaaacatcatagactagaagtaggcatgtgagttccatattactgcatgagaaagcatatatagatatagatatagatatagatatagatatagatatagatatagatatacacatatatatggatatatatatagatacacatatatatatgggggattcattttataactttttcaaaatccacacacatatatatatatgtatgtattttagaagttaagaggaaaagaaaggtgtaataaaagtactttatatgttttggtatacttaaatccatatacattatgtttataattataaatatgttctctaacattttcttaatatttggccagacaattgctgtgatgatggcacatacccgatcacagaattaaactgcattgtgagtttgtgccacagcccatggtgatggaaaaggagattgaacctaaagattctccaggactggagctctgtctactatttgctaatgaactttagaggctgcctgtgggagtgaaattgttatagtgtatcatattggtggttaatcagaatttataaccacaggaaatagttttataattctggacttcttgtataaaattctgttggggtagagtgtgtttttcgtacttctctgacaaagatgcatctggtacttcccaggccatttatctgacctgagttttccagtttaatcggattgagggagaagggagggattcccatgatccgtcaaggaaagagtattttagcaataattttgcctttaaaaacgctaaaatctaaagagagtaaagatcaaatctggaataaatatttgaaataaagaagtgccgaagaacactgtgtgcttaggaggttttgaaaagacacttaagaatgcgaggaggatatctgcgttggcctggttctagtacagatttccagccccagctttttccagcaatgcttggtggttattttactcaaccttccttacatttcctataattgctattaaaaatctcacccatttccaacttgagcccttttattaccacaaacctaagtaaaatctccttgcctctgaagccattaagaaaacaatttccactgggtgtgaagtcattctacacattttttttttttttgtcttctttcttccctgctgcagagaaatttccattctccttcactagggagaattagcagtgtttgaagccacgtcctcaggacattttttcaatacgtgtccccaccccaccccctcgcctctgccacattgcatgtatttttgaacccttatcttttttgctagctcgtttttcgtcaaaacttcctcaccctaaacagatactttctcatatgactgcttttctttactagctacactgtgtttctttctcttgttacctagattcttttaaaaagcaatggtcctactgtctcttttttcttatcgcttactgatttacttttttatttgtttgttttaaagtttatagacttatttgtccctcttccaactagccatcttccagtcactcatctgaatcttcagcctgcttgtcatatttgcacattcccactcttaacacttcttgcaattcttgttttctggcttccagatagcattctctcctgggcttcttattatttttatacttgtttttcctaagacttctttgctggcttttcttctgttaaatgatacttttcaaaaggtaaaaacataactctgacgtaagtataaaatggacacataaagaattttattcaactcattaatgaaggagagagatgctaaatcttgttcaaaaagctttgtaaagggtagggtgtgtgagtatgtgtgtgatgtcaatttaataaacattaggacaaaactgctgagttagatgattaatcaagtctcaaatatctcataggacaataagtcatatttttgtcgttaattttttatcttacagcccaattgagttttcacacatccactttcttcctcaacatttcattcttgtttatggtgcttgagcattgtgttagcttcctattgctgccattaaaaattaccacaaacttgtggctgaaagcatcacaaatttattatcttacagacctggaggtcagaagttcaaaatgggtttcactggactaaaatcaaggtgtcagcatgactgtgttgcttctggaggctctaggagacaatccatttccttgctctttgccgttacaggaggttgcccatattccttgattcatgcttcctttctttcctctcgaaagccagcaactgcaggttgaatgtcaaatcgttggaatatctttaaggggccattattctgcctaacacagccacgttagatttttcatgaaggaatttttattaggtgttccactgaccatacaatttactatattattattatacattctatgcttagccttatttttggtaacaaaacactgaaagtgatattggattattggatcatttgcttggttctttgctatcaacactgaaatgtttgtgattcatttgagaaaaagatgaaaaactaaaagaaaagaaagcttctatagccatttcttcctgatagtctttgcaagatctcactcatttgatcctcactaccagatattgagtgtccttcactctactaaaaccttctgggtagtcaagaaattgtttatttgaaattagttttaattgtacccataagccatgcagtttttgtttttattttcctagagacagagtctcactctgttgcccaggctggagtgtagtgggtcattcatagctcactgtagccttgaacttctgtactcatggggtcctatagcctcagcatccaagtagctaggactacaggattgtaccaccatatacagctaatattttttatttttttgtagaaataggggtctcacttgttgcccatgctggttttgaaatcctgacctcaagcgattgtcctgcctcagcctccaaaactactggcattacaggcgtgagccactgcacctggctgccatgcagttttgatgctcacttaggagaagtaatcagttggactacaaattttagaaaaataaagagaaaagagctctctggttagcatatgtctcttgcttacagacctgattcttcagaagaagtcagcaacacctcattttattgcttcagagataattaattctgatggacaagtgacatggtgtgataacaatatgtattatgtattcttaaaattgaagcttttttcagtgcttttaatttgactttggattttctaaatgctacaaagctaaacttggaggagaatgtataaacatgactaatgggaatgtgcaaaggagaatgaaataacattttaattaaaaagaaagtggacttgaaatttgctaataaaatagattttaagtattcttaccactcatatatacacacgtcaaaaaccacgtgaaatgatgtagatgttatttagcatgattttggtaatcatttcacaatgtatatgtatagtaaaacatcacactgtataccgtataccttaaatatatacaattttatttgtcagttgtaccttaataaagctgaaaggaaagcaaaagtgaattataggcatattctagagcactatagaaaaataacatttggccattatattgaaggcatatttataatctctacaataattaagatattttattcttcttttctctcgtggacagtgtaaaccaatacaaaaaataatttcattttaaggttctagaattttaggtgtttgaaatcaagcagttattaatagatgcttatgttacaaatcaacattaaacatgtatgtattggtttgaattaattcatgtattagaaagtaggaattta

SEQ ID NO: 529 - DNA, 2298 bp, Homo sapiens
aagacccagccccagaccaggccctagcagttcatagtctgatacggtggttctcagccaggggtgattttgatccccaggtaatatttaacaatgtctggagatgcttctggctgtcgcacttgtgggggctgggaggtatgctattatcatctagcgggtagtggccacggatgctgctaaacatcctactctgctgaggacagtccttcaacaaggagttccccatcccaattgtcaaaagtgccacggttgagaaactgtggtctaatgaaagtgtcagaaacatatacagacaccaacagcacagcaggtcagcatgcgggcttcagcgtccagaggaggtacatagaccagcaggcggtgaggtgtcagataaggcttctgagggaagaaactcccctgcagggggtttggaaagaacatgtatggaagggagcaggacacatggaaccaaggaacaactgcagtccttcagtgcacacagcccagagagagaggggagaggagttccaggctagagccacggaagccttggaggctgtgttaaggagggagacttcatccagataggagtggtaaggcattgtgggatgctaagcaggggagggatgtagacagatgcctgctttagaaggcacctcctcctggggatacaggaaccctcaggcactgctggtaagatggtaaattggtgccgctcttctggaatctgtagaaatctgtcattattcggtcacttcagtcttattaagttcatgcatacccacgactgagcagttccactcatggatacatagctcgggggaatattccacaggtccataaagagagatgcatgaggaagttgatcagtgttctttgtggtggtggggagaggaggcagcctgggtatccaccccttgggagagtatgtgtgccgtggagccctgcacagcagttcggggctgccagatgggacctaaaacccagtgctgaggggaaaaagtgtatcaagaatgtatacacaaaagttggccaggcgcggtggcttacttctgtaatgccagcactttgggagcctgaagcgggtggatcacctgagtcaggagttcgagaccagcctgacaaacatggttaaaccccgtctctactagaaatacaaaattagccaggcgtggtggcgcatacctgtaatcccagctactcaggaggctgaggcaggagaatcgcttgaacctgggaggcggaggttgcagtgagccaaggtcgcgccattgcactcctgcctaggcaataagagtgaaactccatctcaaaaaaaaaaaaaaaaaaaaaaaagaatgtacacacaaaagaattcacattttggaagaacacttagaaactgagaagacacagtaaacacactagaggccaggtgtggtggctcatgcctgtaatcccaacactttaagaggccaaggtgggaggatcacttgaggccaggagttcaagaccagcctgggcaacatagtgagacctccatctctataaaacaaaacaaaaaaatgctaataaaacatgctagaatgattgattagggtaaggaggagggctttggggtataaaagggagtaaataaaaaaggaagcagaagaagctcactatgtcatggagtgaaagggctggatggcagggtggacaagagcaccatcagggagacttagccagaaactgctgagagaacagtgaccagaccttgcagcacaaaatggagaggatggccaggcctgcaggagactgaggaaggggattttcagagcctagtggttgacagaatggaggagggaggagggagagggaggagctgagtttggcacccagatttctgggtggatgactaagccaatggagcccacactaagtggtgaacccaggaccaggagcaggttgtggggcaggggatgagttcaatatgggcatggtaagcttgagggactgtgcagcaagctagtggagatatccacagggcagttggctgccgctgtggtctgaatgctgtgtccctgcaaattcatatgaaatccgaacccccaaggtcattatattaggaggtgggggcctttgagaggtgattagggattagtgaatgggattagtgcccttataaaaaagagccttcagagagctccctcactactcacaccatgggaggacactgagaagatggcatctgtgaaccagaaagcaggccctcaccagacaccgaatctgccaggccttgatctcggacttcccagcctccacaactgtgagaaataaatgtttgctgtttac

SEQ ID NO: 530 - DNA, 949 bp, Homo sapiens
gtccataactaaccttctacttcttattgtacctatcctaatcgccatggcattcttcatgctaactgaatgaaaaatcctaggctacatgcaactacgcaaagggcccaatattgtaggcccctatggactattacaaccttttgccgatgccataaaactctttaccaaagaatccttaaaaccctcaacgtcaactgttaccctctacatcactgccccaaccttagccctctctattgcccttctactatgaactcccctccctatacctaaccccctagttaatcttaacttaggccttctattcattctggctacatccagcctagctgtctactctatcctatgatcaggatgagcatcaaactcaaactatgccctgatcggcgcattatgagcagttgcccaaacaatttcatacgaagttaccctagctatcatcctattatcgatcctactaataagtggccaattcaatctctgcaccctcattagaacacaagaacacctctgactactcctaacatcatgacccctagctataatatgatttatttccacactagcagaaaccaatcgagctgcttttgaccttactgaaggagaatcagaactagtctcaggcttcaacattgaatatgctgcaggcccattcgccctattctttatagccgaatacataaatatcattaaaataaatgccctaactgccataatcttcctaggtacaatatataatattcacctaccagaactctacacaatatgcttcaccattaaaaccctattcctaacctctctatttttatgaatccgaacagcatacccccgattccactacgatcaactcatgtatctcttatgaaaaaatttcttaccatttacactagcactacttatatgatacatctcaatatccgctacaatttccaacattcccccctaa

SEQ ID NO: 531 - DNA, 2627 bp, Homo sapiens
ttgatccaggatttctaggaggattctaggtgacagaaaaaggggtaccacgtcatctcagtttgctatttgctatattgacctcctaatttctttttttaaatttatcaaaatagataaattgtggtatattcacacatttaaatattatacaaaaatgcaaataagcaaattacaaaagggtctgatatcgtagaaccttggagagacttggcctcaaagacgccatgtgtaagggaaagtggaagtggcacatggggcttaaaacaagggggttgactgaaggctggtggataatgctatctactcctagacctcctaaccctactcctacacacagaacacccagaactctagtgtctagccacaaggcaagaggtcagagggttcctcattggagaaagccccagcaaaaaagactacctcattctagccctacctcatttggggtctttggctcaactactcatgtatgcaaggctcccagtcagcttttcattgcctgcctcttaaatataaacagataaccaagataaaatagagaaatcaagtgtataaacagaaaacgtgaacccagaggaaatcaagataacatgcaaagtagaagagtatttcaaaagaatcaaattagtgtgctcagaaaaagatgaaaaacttgtaactagacggtactatactgtctatgagaaaggaactatcaataagaaaggactctgagaaattaaaaattgaaatgctgaagtgaacaattcaatagaattaaaagataaatttaagggattttcccaggaggtaagataaagataaaggaggcagaaaacacaagaagaaaataagaaacaaaatatttatttaagggtttcaatagttgactaatggtagatccagaaaaattaattttaaaagggggcgtggaggaagaattaacaaagatataatacaagaaattttctcacagctgaagaatacaagtctacagaatagacagaaccactgaatgctcaacaaagataaatgcaaagtaatcaacatatagatacactgccatgaaatgtcagaacactaaaaataggcaatataaaaagcttcaagaaagaaaaatatgtcatacataaaggattaagtaccaaaatgccatcacatttttcaatagtagcattggatgcaatattttcaatatcatcaaaattctgagagaaatcattttcaactgaatttatatgcccagccaaactgttgatcaatgtgagattaaaagaaatagtctcacaaagtttacctccagtgcactctttttaaaggaaattatttgagaatgtgctccagcaaaatgagggagtaaaccaaggaaaaggatacatggtatccaagaaacaatgggccaacccagaaaaacagcaaagagaaatctcagaagagaagcaatgcacagagccaaggaggagccagaccacattggagatggagtctctggaaagggagagtataataaaatatggaattggatgggaaggctggaaaccaatgaaaatgtgataatggtaaatagcacaaggggaaaagggcaggtagaaattccaggttggggttgggggtgcggaatgatattaaaaaaataaaatacaatcataatacactacttggctctccaaaggaacagtatttaaatagtgtttttggcgtggaggggtataagctaaaacctcacctatcacagcaggaatacaatgactaatgaaagatacataataaatcaagaaacagaaattgaagcatattattgcaagtgatcagacatactgtaactaggagctgtaaaggagctgaaattctgggatgagaactagggattcggggtggatgtgggcagagatctatttttttaaccaacgtatgtaatacactgatgtcttttttaaatggcctttaactctggtagcagggtagaactctgattacaggtggttaagaatggattcagggaaactggttaggagagtattgcagcagtaccggcaggaaacaaaggtttattggactacatttgtggttggtggagatggggacaagacgatggaaaaaatgccattaggagatcaaattgacaggcctagctggtgggttgggtgaagggatagtgagaaagctggggatccagggaggatgcctagtttcctgcttgtgcatgtgggtggacagtgaggcccctcaatgagaatcctagtcaagaatcaagttgttaggaggaagtagtgggctcagatggagacaggtagagtttaaggtgcttgggaggcatggaggacaagacactaggcaggaggttataaacacagctctgagctcccatcacatatccagggctaggcaacaagcctgttaatgcaggtgagctctcctagggagggactgaggacaccagagagaagtagttgatggtgtaagggtgacactggtctcacatcagatatatccagcacagagacccggactggtacagatctcaacatagtcacacagtcacagcatccttacaggcacacttataactcagaccccccaaggattagccattactttaatttttttttttcaagacagggtctcactctgtcacccaggttgga

SEQ ID NO: 532 - DNA, 2846 bp, Homo sapiens
gaaacacccatcagctagatttcacagttaacattttgctatatatatttcatctacttgttttttgccaaaatatctttaagtaaattaaaaactcatgaaatcctcaagcctaaatactttataacatatctttaaaagtaataataatgacatttttctgcataaccacaacactattattacacctaataaaatctttgtcatatcttagaaaataatttttactatctgtttttttttttttttttttggagaatagtgaatatatttacataaatcaaaatccaaaaggaacgaaagtgcacccggttaaggggaagtcttcctgccattcctgagcctggtcccaggccctgccctagtttcccgtgtagctttctagaatagtccatgcacagaatcatttatatataaagaaaatataagcacagtgaagtcagagacttgttcaccactgaatccttagacctaaaataatgcccagcactcacatatttttttgaataaataatttttttttttttttttgagacagagtctcacactgtcgcccaggctggagtgcagtggcgccatcttggctcactgcaacctccacctcctgggttcaagcgattctcctgcctcagccttccgagtagctgggattacaggtgtgcaccaccatgcctggctaatttttgtatttctagtagagacagtgtttcaacatgttggccaggctggtctcgaactcctgacctccagtcatccacccgcgtcaacctcccaaagtgctggaattacaggcatgagccactgggcctggccagaataaatgaatttttaatcagtggttatatgctataatactgtttgtacttcactattttttttacttgtttccaaatcagttcttgtgagctgcctcattctttttagtagctgcaaaatactcttatgtgagactgaactatgatttatgtaacaagtctcctacggatacacatttgtgtttttccaacattctgctattaacaacgctgtaataaatatccttgtacaaggccaggcatggtggctcacacctgtaatcccagcactctgggaggcagacacgagttcaagaccagactgggcaacatggtgaaaccccgtctctacaaaaaatataaaaaattagccaggaatagtggagtgtgcctgtaggcccagctactcaggaggcttgggtgggaggatcaccagagcccaggaagtcaaggctgcagtgagtcgtgattgcgccactgcattccagtctgggcgacagagtgagatcctgtctcaaaaaaaaaaaaaagaaaaaaaagaaagaaaagaaagaagaaaaggaaggaaggaaggaagggagggagggaaggaaggaaaggaaggtacatttcggggcacggtggctcacacctgtaatcccaacaacttgtaagactgagatgggaattcaagaccaagaccagcctgggcaacacagcaagaccccatctctaaaaataaacacataaatgctgctgctgctttttttttttttttaaggtgcatttggctcataaacgtcacaggctttgtccgtaaaaaaggagaaatgtttgttccctgtctgctttctcttttcacttaggggttctcaagtgtgggtgtggaccctccaccaaaatacctaacactgggtgcactataaatgcttgtttgatgaatgatgttgttggcagtgcaccccagaggtcccatttttcacatatgaggaaccactcctaattatttagcccaggatatgattcatctaggtgaaaaccctttccaaacagattgccacacctgtgattcttcgctcttgggaaaagacagagtaaaagagcaaagttttgtgagaggttgggaggtggcggtggtagcagggacggagccgtggaggagcaggtgcagaggtgcagagagaagccccgttcacccaacctgggtgagttccctgcacagaagaggcctcgtgggcagcttagcttttgacagtaaagatgcctacagcaggaaaaaaacggggatgagctgtgggcagagaggcgtgaagtcaggaaacacaggatctagcccagctctgacggtgacgagccagtgagcccttgatctccctagcctcaggctcctcatctgatctgtggaggtcgaacctggatgttttccaaagttggttttaggtaaaacagtttgaaattgtatggccagcttcaattatataaatattttaaatttctatatgaagatagcaccaacaaagttacagggcaagcaaagatccaaagattggaaacagtgtctccctcaaatggggaacagttaaataaatgatggtgtccctgtagctacccactggaatatcatgcagtggtaaaaagaaagcagaggctctttacatactgataaggaacaatcttcaactcacaggtaaataagatagtaaggtgcaggctgggggcagtggctcatgcctgtaatcccagcactttgagaggctgaggctggcagatcacctgaggtcaggagtttgagaccagcctggccaacatggcaaaaccccgtctctactaaaaatacaaaaatcagccgggcgtggtggcgggcacctgtagtcccagctactcaggaggctgaggcaggagaatctcttgaacccaggaggtggaggttgcagtgagctgagattgcgccactgcactccagcctgggtgacagtaatatcggctgctttcagagaggaaagctggtgactagagaacagaaggtgggcgaggggaaacttcttattggatactcctttgtacctttcacac

SEQ ID NO: 533 - DNA, 1595 bp, Homo sapiens
gcaggcgtgagccaccgtgcccggccgagttgaagtactttttctggaacaaagaaacttagcataaatagttaaaatagtaagaattgtaattaagggaaatttcagctcaatatgacttcaacagttttaaaaatgtattatttcacataagaccatggagagaggaattggaagccccagaattgattgggtcagaaattgaaaatgatattatcagtgacccaggtttgaatgtctctccccacagcattgacttcactaatggatgtgacctggttggcagcagcagcttgcacaacatgcttgtttgcagtgagtagtagagagaaggttttgctttcccagaaactctgaaaaaggtcatcaaacctaaatttccttagcctttttcttccatgagcaaatcactagcagatgactgctagcaaggtgttactattacaatgaacccctaagtgtcagagaaagagttagtttggggaaatatcctctccaccacaatcttagtcattgaagtcaatttaacaatatattgaaatatttttcttagaagtttaaagttccattaaagagtagcaattacagaaattataggtagcctttagttctacaagtgacatttcaaaagggagatgattcatcaatttcaaactttgcctgcaaataatactggatgaaaattaacttggcaaacataattaataatcatgggttattaattacttctgcaaggtgggtgtgctgattttaaaaggcttgaataaaacataaatttccttaatttatactgtaaatggagtaatttggtgatgtaaatggtaatatgtaagtgacttctgcttcagatcttacaacttaaaatatttttctaaaattagtttttgtaccatctctccagcatgttccagcctttatcagtcagtccaggcttctataacaaaatatcatggactgaattgcttacacaacagacatttctcacaattgtagaagctggaaagtgcaagattaaggtgctagcaaatttgtttcctggtgagggtcctcttcccggcttgctgtatcctcacatagcagatagagagagaaagagagagagagagagcactctatagactctcttcctgttcttctaaggacactaattccattgatgagggccctacgctcatgacttagtctaaacctaattaattctcaaaggcctcacttcccaacactgtcacattgtggggtagggctttaacatatgaaatttgagggaaaaggaatgttcagtctagaacaaagccccatacatttcaaaaagctgtgggacaggagggaatggggatggtattcaatggtaccacatccaagcaagtcttgtatggttaaaacaaatcaatataataacatgaaattttacacagaaacctatctgattataaactgtatgcttaccataatcaacactgatgtacattgttttaaaaatacttaatagtgttctttgtttaaccaaataatagaggtattaactagtttcctagtgctgccaaaagaaattgctacaaaatttgtggcttaaaatagtaaaaaaaaaaaaaaaa

SEQ ID NO: 534 - DNA, 8243 bp, Homo sapiens
atagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggaaactactggaggatgtggtgcaccagaataagagaataaaccaagaaacaggaagacgtgatccaggcaacaggatattccagtatagatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 535 - DNA, 8324 bp, Homo sapiens
atagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 536 - DNA, 8157 bp, Homo sapiens
atagaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttatgtgaaggagcaaagagaaggagccagaagctagagggggctgcttggtaagagctgtggtctttgctaaagggacacagacaacccatgtgacctggcaatgagaaagccagagtactctgaccatctcttccttatatcttctcatcttctttggatattaataattggataaacagaagctgaagtcagagggcaagggagccattcatgctgcagtccatgtgggtcagcacccgctggggtccagagtgggatgaagaggggttctgaaaggcaaatggaagacatctagtataacctctccctgaacgtaattcaaactacttaactattattacagacaaaaatcacatgtatgctgaaagtaaaataacctgtttccagaatttctgattgcaaaattctgagttcttcaattaaacctgcatttttctcagtctttttggtgcccctgcttcactggtgccttaagaacatttgagagcctaagggcagccctgagcatggtgcctgaactagggtgcctcaaaactagggactgaggaagtctcaagttcattcctgaatgctgactataagagtctctgagagagttttgagaatgtagaactgatttagaatgaatctcaggatttttctgttaagatctataaattaggaattaaggaactggattttttttgaatttgaaaaatcctatgatagtataactttgcataagcctactgaatgataggaaagtttttagtttcttatcaaagaaagagaataaagtgaatcaggacatcagtttcacattgacatttttattaacgccaactgttttttaattatttttttaaaacaatagcacaaaaatgtttcaaggaagcagtctcacaatctgatgaccttctgaaataccgttaagccacaccaaatatgaatttctgttaataacacaaaatatttttttaagaaaaaaagaaaaaaaaggtagggaaagaagaagggaatgagatttagatttaaaactcattggattaaataggtgaggcttattaggatatactgttgaagcaaacagtggcacacacaggcttacagtctttgttttttaaaccagttaccactaatgtattaagccctgcagcagttaccactgacttctcgcacgcataaaatgaaccgggagaagccagtgttgatactgttgtgaagaggttcaagagctggcttttcagacaactaagaccatttttagcagaataactccttcagaaaggcctggctgaagatctttttatttctattgtctcacctatataaatttcagggttcttataagtcatctttaaaaagaaaaaaataatgtatatcagtttctcttatttaatgtggctatgaaagatgtttccttattatttcttcatctctaagaaggacaccagggaatgggggttgggggtggaactaaagggaggaaaaaaaccagaacagggtaggtttttgttttttgctttttgtttttttttggccaaggggtcggtcacacagaagggaaggcaaggaggaaaactaaactacaatccttggttcagattgagttatgcaggaatatatcttcctgatcagtccccgtgccaaaaaaaaaaaaagccacttggaattatgcactgactccaactatgtgataccagctatcagccttttgtgtttaaccattcccagaaatggacaccacccttggctttataggctccttgcagaacccacttcacaaaaatgctcttcaccaagaagcctctagtttccttttggtaggttataaaaacagaacatctgtcattaacagtagagtgttaaatacttttaaccactgacaaggcttcagaaagtttcacagtttcgttatgctctattttattactatcatatttacatttttattttttatttattttttgctgaattgctgattttcctttttcaatagaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 537 - DNA, 2813 bp, Homo sapiens
ctcaggtctaggacagcatctgggagaggatagggggaaggactctggcatagctggtcacaaaccagccccagggcaactgagcattgatttgatcaatggctttttcctcttcccttgaattcccctatgatggccttttaattgggtccatttgttccaaggccgtgggctgagctgagcagacgccaaatgatatgcctattattaaatagattaggaaatggccctacatcttgggcggccagaaaaaccagagtgactgaacagtgtccctgaggagtaacacgtgtattgtggaatactggatgtattgcagaatcccttccaggcaccttgcctttcctatgctgtccctgcgtctacagaatccttctgacttccttgctcacctgaaatgtgtctcctcctccaagattcacttcaaatcccctcctcggtgaaggagctgaaggagcgcgctaatcgccacccctccctcagcctgcctgagctactgccacagagaactcacacatctgcctggcaagagatccaacctgaattggagggtctgccctaggggacactgtccaagtcagggttgtccagggaacaggattacccaaagaacatttaaataacaatcccacttcagtaaaaaaaaaaaaaaagatgtctccatttcctgagctggagtcaaaaagggtggctgggaggcagcagagaagaggagtgagtgtaaattccgtgtgatggaaatgagtggcaatttaaattcgactggagaaaaagaaaactttcatgtcagtatcaaactcagaccatttttaaaaatcggtttcttccattttagacattatatactggtttccttttgtgaaatgaggctttagttctcttccttctctcattctcccattgcaatttttgattaaatattcagtgcttccatttttatgatgtcaaaaatgttgctcacagtgacatcttagggcattctatgtttatattttctttcttgcataactttttgtttttcctggaattaataactgcctcactgtacattcctaagaaggacatattctaaggacaaagagaactaactctaaagaaatctgaagcagtctttgtaatcatattacaagtacggttacccctgaacatcatgggcttgaactgcatgggtccacatatatgcagattttcttctgcctctgccactccggagatagcaagaccaatccccaccttccaccttttcctcagcctactcaatatgaagatgagagggatgaagaactttatgatgatccacctccacttaatgagcagtaaatatattttctcttccttatgttttcttaataacattttcttttctctagcttaatttattataagaatacagtatatgatatatgcaacatacaaaatatgtgttaatcaactatttatattttcggtaaggctttggtcaacagtagaatattggtagttaagttttgggggagtcaaaagttatatgtggattttcaactgcgtgaggggttgacatccctaacccctgcactgttcaagggtcaactttaatactattgatggtgttagtttgaaactattacatgtagtaggatataatgaaaatctaattatgttaatgtcactggaaaccaacattttcaacataagagaaaagagatacgaatataaaatcaaagaagaaaaaactactatcagtatagtcttggatttggaaacatctgtataaactcatgatgcttttttctctttaaaaagtattctctatttctaacttctaaaaaggcctgggaacaataactagccctgtgatgctgagcacctctagtacccgcttcaaaggttctaaatgtatttcctattaaaaggaacaagggcttcttggagaaatggctgattctgggttcgtggcaggaaatgcataagatgggttcagaatattttgtcatacaaaaagcaagttgtcagcactactaacgttgtgtttaaaggacataaaaaccaacttgaggactgtgctgcacaaagatggggtattttaagtatcaaaaagaataatgcctacgatggattgaaacatacaaatctgaaacttgtgtttcaatctatgagtttataatgatactaagagcaaacaaacaagcaaacgtgtaggtctgttctgtaggttggtagcttatcaatgtattattctgaaaggcaggttaaaaggaaaagaatctgtctttcctatacaaactgtatttcagagtaactaaatagacaccgaggaaaattcttctttactgaactccagccaataaatgaagaaggtatcacagaattaaatatcatcattttgcatgccctaatcaattaatgcctgtaggcctggggtgtccaatgtggcagccactacccacaagtgcctactgaacatttgaaatgtggcttatcggaattgatatgtggtataagtgtaaaatacacactagatttttgaagacttaatacagaaaagaaagattgtaaaatatcttggtttttatataatatttttgatataacagattaaataaaatatattatttaaattaatctcagtatttctgattacttttttaatgtgcttactttaacattaaaaaatatacctatatgctttgctttctatttctacaggcaagtctgagcagtaatcatcccaatggttgctagtctgataacaccagaacccaatggccaatattaacatcacaaaaaagagagagaactagacattatgtcctgctttatggggtacaaagaag

SEQ ID NO: 538 - DNA, 1753 bp, Homo sapiens
aggttggtcttgaactcttgacctcaagtgatctacacgcctcggcctcccaaagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatggtttaaaaaaaataagtgccaggatacattgtagtataaaggttcaactagtataatttaaaatgagtctttatattcaggccaggtgcggtggctcacacctgtaatcccagcactttgggagtccgaggcgggtggatcacctgagattaggagttcaaaaccagtgtgaccaacatggagaaaccccttctctactaaaaatacaaaaaattagccaggcatggtggtgcacgcctgtagtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaaacctcaaatctgtccttatacaaata

SEQ ID NO: 539 - DNA, 1913 bp, Homo sapiens
tatcatttttagttagttaaattcaatgtttatggctctttttataaaatgttgcttaggaaaatgactccattttaaactagagctataatttgtagcagacaatattagacacttacctgtactcaaatacagtcagaagtgcctgcaaatttactttcctctgaagcagcccttgaccaattagtgacaaatgtagagtatgaagttccagctcccttgtctgggagtaagagtaagagctagtgacagtcacatcaccagaattaacttaacttctatggttcccaacaagatcaagtcgaagcttccccctgtgggactttgcatgaaatcatatccttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatgctctcgatctcctgacctcatgatccacccgcctcggcctcccaaagtgctgggattacaggcgtgagccaccgtgcccggccgaaatcatatccttaattggttcccatccttccctgtccttctttccccacttccctgccagtgtcccctgggagaacttgtacaataaattacttgcacacaaaccctgcccctgagtcagctcctagagaaccctatctaagaccattgtatcccaaatgtcctgggcctcactagcttatagatcataaaataaaattacattctttttataccacaaaaattatagcatatgcctccttttattctgttattcattcaaaagataaactgtgctaagagctggggatagaaaggtaaacataatttctatctttgcagagattaaactccaggtctgagagccagataacagccctcctcaagataaccagctgaatatggattggatattaaatattatagaactattgtcattttagataacaatattgtgtatgtacagaacattcttatttttaaagtgatcatgctggtacacataggagtgatttatgatagccgcaacctactttcaaatggttccaccaaatattagatgtagaaagggataaagcaaatatggcaaaatgttaacaactgttcaatataggtggacggtatacaaatattcactgcacaatttttttcatttttctggtgcctaaaatttttcaaactaaagagatcggaatgaacaagatcatgggaccccatgatgggtataggccctcaccaaggagtaatatcaacaattcccagatgcccatttatcatccctttgtagttattataaatacaagatacaccactgatgactaaaagaacttacatttagatggatgtatgcttcagaccttaattatgaagattttagaaaaacatatcacttttctcaagtagctcctaaagttatgtcactcaagaaatatatggctttctttaaacttgagccacttccagatattcctttgttcataaaattggcttaagcatttgtgaaggcttgaggcgtcatttgcctcttgccagtatcaaatgaggtattgcagctgtgatgaacacttctgtgagagttcactctgtggaagttcacttctgtgggagttcaaggtcaccttatgctaacagctctccacctcaagcattcactgcctgtcccttccatccattccccctccctcttcatcttcttcatctgaagggaaaaggaggggctctcagaagtcaagcaagagctggtcacttacctccttgaggtttattataaaat

SEQ ID NO: 540 - DNA, 3109 bp, Homo sapiens
agagctggatgcctcccacggagagcgtcccttccaagcggccccggagtggagtggagtggagtggataggggtagacttttcacacggggacaaattattacaggatatctgcgccccctgttccgagtcactcggggccatcggttacttcagcaggttctctgcatcacggacccttttgaggctcaggtaaaagtttggatcctctccccacaaacgagcaaaattatctgtacattgaaaattatgcattgagaaaattcacattactctagaaacccttagactgcagttcctaacccaagttaagaacccgcggtccaggaactaggggtaacgatagaagagagacttgtttttctttgtataaccatttgcaccgttgtaactttttgaccatgtttctttatccaaatgaaatttccgaaaaaagaaaactcctgccccagaacttcgtaggaaaactagcttgattatggaattacaaataatagtaagagaaaaaaggctaagtggtggccgtgataggacttaatggtatttcaattcccagagttacagtggcggcttcaagggattgttgaataattgggagtacttgtttcagcttctttccttcctcagcctgaacatctgctgtttatgtaacttaatttcctaagtctgcgatttcaagaatttgatgcaacatctttctgttctaggaatttaccatggaaattattggccataattgttggtgacactatcaaactcatagtcactctataacgatatggagccttgctctgtcacccaggctggtgtgcaatggcacaatctcgactcactgcaacctccatctccaaggttcaagttattctcctgcctcaacctcctgagtagctggagttcaatggcacaatctcgactcactgcaacctccatctccaaggttcaagttattctcctgcctcaacctcctgagtagctgggattacagacgtgcacaaccatgcccacctaatttttatttttagtagagaccatgttggccaggcttgtctcgaactcctgacttcaggtgatcctcctgcctcggcctcccaaagtgctatgattacaggcgtgagccaccaccactgtgcccagtgttagcaattatttacaacaactgatactcttacctttcttcctatagatctaattatatggaaagatacaatcatttttgaccaaatttttatcttactatgttgtactctactcatctacatttcttccagtagtggcagtaattttcctatatacaaatacatccatatataagcacacagtatatatacaatatatataaaacatatagacaagttaaaaatatggaaggaaagattataaaagcaataaaaacataaaatatggaagaataaagtaaaaaaaaatgcgatggacctgtgtggaaaagctacaggacaatagggggaggtgaaagaggattttaatgaaaggagggacatgctttgttcccggaaagacaatattgtgaaattttgacttctattgagaatagaattgtttctactctcaacaattccactcatttttgtggtcaaaacagcatatagttgtatctttttttggtaaatgctaaatctgacagttgttgccctttaataaaagaaactctttcatatattaataattggtatacccgattttgcttcagccatcatgtttacactttcagccatcatggtttatactttccactcattgtatattcttgctttctttcttttccttggaaagaaaagtcttcggctaaatggatttttttttctttttttaaagagaaagggtcttgctcttgtcgcccatgctagattgctatgccactatcaaagctcacttcaaggccaggcatgatggctcacgcctgtaatcccagcactttgagaggccaaggcaggcggatcgcttgagctcaggagttcaagaccagcctgggcaacatggcaaaaccccatctctacaaaaaaataccaaaaaatttagccaggtgtggtggcatatgcctctagtcccagctactcgggaggcagagatgggaggaacacttgagcccagaaggcaaaggttgcagtgaaccaagattgtgcctttgccctccagccttggtgacagagggagactctgtctcaaggaaaaaaaaaaaaaaagctcactgcagcctggaactcctgacctcaagtgatcctcttgcctcagcctcccaaaatgctgggattagaagtactgtatccccccttttttttttttttttgtcagagtctcgcactgtcgcccaggctggagtgcagtggcgcaatcttggctcactgcaacctccgcctcccaggttcaagtgattctccttgcttcagcctcctgagtagctgggattacaggtgcacgctaccatgcccagccaatttttgtttttgctttgttttgtttttttaagacagagtcttgctctgttgcccaggctggagagcagtggcgtgatctctgctcactgcaacctctgcttcctggattcaagtgattctcctgcctcagcctcttgagtagctgggactacaggcacgtgccaccatgcctggctaatgttttgtatttttagtagagacgtggtttcaccatgttagccaggatggtcttgatctcctgacctcatgatctgcccgccttggcctctcaaagtgctgggattacaggcatgagccactgcgcccggcctaatttttgtatttttagtagagaaagtgtttcatcatgttggccagggtggtctcgaacttctgacctcaggtgatctgcctgccttggcctcccaaagtattgggattacagacatgagccaccacacctggccagaagtactgtatcctgtttccactttcatggtggtgaattttaccttttagaaaacaatagttatttttattttctgattataaaagtaatacatactcatgaacagaaatttggaataaatagcaaactagaaggaaagtgccatgcagagataatcactattaatatctttaatttttcgtattattaaattttttcgaccgcagcc

SEQ ID NO: 541 - DNA, 2964 bp, Homo sapiens
aaacctgatacccttccttcctccatctctaaaaaatgggggaagacagagaaatggaatgaaaaatcttcaaagctggaaggacaaagggagtttcctgttctaggatgtgatgtgaagggaaattagaagatggactgtcctgaagcatagacatgaccctctccaactcatcatctgagatcagctgtcctgcttataaatggggaaataaagactggaaaatgtatgtgatttgctcaacatcaaacagtcatcaagagcctgtgttaacatctggcgtggatccaaaacccatgttctttaccgtggtaagttgttgcaaagcattctttgaaaaagatggaagccttcttcactcaaaattgattaatttcttcaaacacttgacctcccatgaataccaagtccatgttatactcatggtatattttagtgtacttaaggtacacacagtaaaagaaatttaaatttcacaatttagcacagatagttggttgctgtgaatgaaaatgtttctttttgtgcgaatgagtttatatgtgttatcctaggttccttaaaaaaaggtaggtcagattccaaagaaactgtgttctagaaaataatagtttaatgaaaatctaggttgtggcccacagaattgtgactctatacttatcagaccagagaatgatgattcaggcttataactaaagatccttgagtgtttttgagggatttacacctgggttcttatatcgtgtctcctctgtaaatctagcaggaagacaaggaaattgttctgtaccatttcaccactgaggaaactgagtctagaggagttacattttctgctgaagatcacataactaggggaacttgtttctacctccagacaattttctgctgtgaccctaaggtagtaggcataaagggctgggggctattcctcaagctaatttgtggataaagatttatttttcttctaggccttaggattataatgggaaagctttctcctcctgtattcatctttaatgtaattagtataaactgtgagtcagaaggctgggtttcagtcctgctctgtcacataccaactgataaactaggtcacttaacctatctggggctgtgtttcctcttgtgaaaaatgaagataatagtgcttatcattcttgtcctatggggctgtggagagcatctaaccagagactgtaggtggtaagaaagtggtctcagcattcaagtcctggacaagctctagccacccagcataacctcttctttcttaatcataccataattttcttttgaagaattgcttatcttctgttatgtgtgatcttggaggggctgtgaatcagggtctttctgccttcctactacagtcgtcaaaaatgttctggaggccattgcaagcttctccctccacacccctcctcaccctctggcatagtcacagggcaaacactggatctaagccaatcagatgggctctttcttctggaactgaatcctcagcagaatgacaaagaaagactaaacaatgatgactcaaatgaattgatcctttgattccacatcagctccttcatgagactgggaagcagttcctttaccttctttgttgtcccattgtggagctggctcctccagctctcccagcaattctatgggaatcattctccagtgatttctctttttggatggcctaagttggattatgttgattgcaatcacagaattgtattacatatgtcagtttttaacgtatttccttaaccttaaaatgccacaaatttaatatgcatcattaagtttttcagggaaaaaggaagaagcagtcacactatattcaatatatacaccgataggcaagaggcatactggtttgagaaatgtgaaacatgagaagtagaatgtaaaaaaaaaaatgtgtgtgttagaattgaggaattatggtacccatattatcattattaataaattatattagaatagtagttatgacaactgagtattttatgtacctagaacccacaaggagtcagggaagtaggccaaaggacaaaggagttgattctaaaattctcttgattgcttctctgagaacttctcaatttattccccttttggtataagaaatatctggttttgactgccagctaatttccagaagttgaaggcagttatggtttattgtgagtgggaggtttgtaagaaaatagcagtgcagcagtaaggagaagctctctgaagttgttctgaatgtacagctaatgggcagttatctatgagagagatttttatagcttcctccatatagctggtgaaaagttagcctggatgttgggggaggagcctgtcaatttggcttcttatcaaactcaactttgttaagcagttaattctaaggtgttttatccacttattactaaggcatgtaagtctgagctggcagccttgattaatagattaatgatcactgctccctacaatgtaattgtcattgtgtccctagaagaactacaaatatacctccggggttaggattaggtgagggtgactgtcaagcagccatagaaggtgtgaggatttgggactgtttaaatgaagacaaagacatgccctcaagaagcaattttccaagctgctgttttgacttgacagtggcagatacttcattggaagatgttgtgaaaatgaaatgcagcaggatcaagaggagagggtctattagtcactcaaaactgacttgtgcagatcttgcaattccatttgtatttctgtctccctatctgtaaagcaagagaaattattcataatttgactgtcattcatatcatgctaagtgatttagggctgcatcttcacatgacccagcttataacagatgggctgtagatttaatgaggtggtgtatccctgctctatcatttcccagctccataagcaagggcagttatgcaactctttatg

SEQ ID NO: 542 - DNA, 2979 bp, Homo sapiens
attcacctcctgctgactcgggaagctgttccaccatccatcacgcaaggtaagaaaggcgaatggcagcacctggctggaaaaggagtgaggggaagtatgggtggctgattgtgacggaaacacaaggctgtacagcactggccatgttccttgagtcaaaatgatccaggtggctttcaaaaatcttagtacatgagaaataccccatggcccactctcttatttcccctttcaccatggaaactcgccaagctgagtttcttgactgggctacctgcacgaccaaaccaaacaggcacctaatctctaatcttactgctgggctctgtctcagaccagatgagcagagttcaggctggatatcccacaggaggaaggctgaatacccctctcctcaccaaagttggttaaggtctgggtgagttatgtctcatgttcctgttgtgaaatggaatgaacaaacaggggatgtgattcatgtctgtagacacgtagtattcctgagagctaatcaggaaatgccatttcatgtctggtcttataaagcctcttcaaaaatttgatagaggctaaaggggagcaatcattttaaagtgagctcttgttatctcttcaaccacctacgccacacgcccaccactaagttctgagaaaactttacacccccctcttcttcctctgccctagtccctctccccaacccgtaccgccaacacacacacctgcatacacatgcacatgcaaattgtttgaaagaaacatcatatggccaggtacggcggctcacgcctgcaatctcaggactttggatggctgaggcggaaggatctcttgaaccggccatagtggctcatacctgtggtcccagccactcaggaggctgaagtgggaggatagcttgagcctgggaattccaggctgggtgagccgagatcgcgccattggcctccagatcaagtgacagagccagaccccgtctcaaaaaaaaaaaaaagaaaggaaacatcatacaacatgaggcatactttacactgaagtaagttgttgttttcaaggcaaaatgagtttcccttaatttataggaaataaaaagaaatatttaaaagactagtaagaacaaataaatccagttctcagctggtgatcgataaataagaaaaagaaagacagataaggagaagattcacctataaattaagtgcatttaacaacttaaattattacttcccccaaaggaaatgaaaatggaccctctgatcagagagataaagtatgttttattttagttttttaattaattttgcagggagacacctaaatttaccaaaaaagggagctaatatcagggaaatacaagatcttaatggaaagattatggaattcacaagttactggtggcaacagtttggacacaattagacatcttaacgataatgaaagtatatagtttaatgaatctatgtcaagggaagccttgagtataaaacctttacagggtccgacgagatgaggacttttgctcaatgagtaaatagtgtttgaccagttgattagtaaggatgtgtttttgaattcctcgagatttaacaagatgacaaatcggacttgtttagatttctttttcgggctagcaagaacactttgacacactaagtaggaggagtcccctcaaccctctgtgagactcctaagcccactaaccctgaagtcacacacagctcaagacacacagagggggcctctaagctgagagacgtttattcaaagacttctctgatctatcagaactggtgatctaggagctttttgtaaagctaggtattcttcctctccagaaaacaaaagcaaaaacaaaacactttgcttctctatcagagggatccttttcatttcttttcggggaagtcttctttcacgtttaaatgagctcaatttatagatgactcttctccctgtctgttctccttgtcccctttatcaagcatggtgaaaactgtggagtcatccttgtctcatctgctctgactaatttgtttaccatatctggccagttcttcttttgaagggtggctgcaattttctctttcttatctcagttgttgttgctttgcattagcatgttttcatagcctctcctcctctcagtcccttcccttcctcctgaaatctaaacctttctgacactctttcatctggcactgccccctcacaactgttatgagttcctttttctcccacattgagtctgaattcctctctatggctttcaaagactttcttattcttcctcaaccctcttcattatctgctactccctagtgctcccttctctagtgaggtcaatattctcttccacttactgggcttgtttctcttcttccttctctttacccatcaattgccctgtccattggcttatttttttttttttttttgagaaagggtcttgctctgtcacccagggcagagtgcagtggtgtgatcttgaactcctgggatcaagcaattctcctgcctcagcctcagccttccaagtagctagagttatagacgcatggcaccatgcccagctaattgtttttatttatttatttatttatttatttttgagataggatctcactttgttgcccaggctgggttgaactcctgggctcaagtggtcctccctccttcacttcccaaagcgttgggattatagccttgagccaccgcgctggggccggcatttctcacttctgtctgcagagcatgtctcctcatcagagaccaacttcttacaaagtcccactcaatgactgagattcttccctttctctaagctcccacagcatgtaaagtttgtggcacctggcttgatacaggtctggatcattttcaaaccgctctatttgtgtgaatcttgtctcccacaaaaatgatacacttttcaaacaaaaagtccattttctctgcttacatgcattttgtgtctat

SEQ ID NO: 543 - DNA, 3983 bp, Homo sapiens
agcaaccctttgggtccccttctgcactgtggaagctttgttcttttgctctttacaatatatcttgctactactcagtttttgggtccgcactgcttttataagctgtaacactcaccgtgaagacctgcagctttgctcctgagcccagcgagaccatgagcccacggggaggaatgaacaactccagacgtgctgccttaaaagttgtaacattcaccatgaaggtctgtagcttcactcccgagccagcgagaccacgaacccaccagaaggaagaaactccgaacacatttgaacatcagaaggaacaaactccagacgcgctgccttaagagctgtaacactcactgcgagggtgcgcagcttcattcttgaagtcagtgagaccaagaacccaccaattccggacacaccaggaggtggaggttaaactgagctgagattgtgccattgcactccagcctggataacaagagtgaaactcttaaaataatacatatatgtatatgtatacgtatatatgtatgtatatgcacaaattaaacttgtcattataaaatgtttcttgttgttgttctcatgctatatcttttcccatccttttcttggacacctctaataacatacccttttatgttgacctttctgtatcattttgtttcaatgtgtctcaattgaatgatttatctagtttgttcacacttactgatttacttggttttaaaaaatctaccttttgtgccttttttcttgctttttatacatttccttgtctctcgtttctttaaattttgtttacttatttgagacaggagtcttgctctgtcacccaggctggagtgcagtggcacaatctcactgcaacctctgccccggggttcaagtgattctcctgcctcaacctcctgggaagctgggattataggcatgcaccaccatgcacgcctaatttttgtatttttagttgggggcgggagggagtctgaccacgtcagccaggctggtctcaaactcctgacctcaggtgatctgcccgcctcagcctcccaaggtgctggggttacaggtgtgagccatcgcacccagctggaagtcctttttttcccaaagtgaaaaatcatttaattttgtgatcataagttacacgtgaaattttaaatactagacagtaagaggtatttaaaagttacctcaaatcctccctaaagatgctagcgttctgcggtatatatttagacatatctacagacaaggatataactttcccagttctatttgtgggacctgggcggtccacctctctgaaactgtttccctagctaagaagtaggggtgcgatcaacatgggtaggctatagtacccagttactttgtcaaacactaatctaggtgttcccataaggtattttgtacatgggttgagtcaacatctacagctgacttcaagtaaagattacccttggctgggcttggtggctcacacctgtaattccaacactttgggagcccgaggtgggtggatcacttgaggtcaggagttcgagaacagcctggccaacatggtgaaacatctgtctctgctaaaaatacaaaaaaattagccagatgtggcagtgcacgcctgtagtcccagctacttaggaggctgaggcacgagaatcgcttgaacctgggagacggaggttgcagtaaaccgagatcataccatttcactccagcctgggcaatagagtgaaactccgtcttgaaaaaaaaaagggggggggccaggcctggtggctcactcctgtaattctagccctttgagaggccaagatgagcggatcacctgagttcaggagtttgagaccagtctgggcaacacagtgaaaccctgtctttattaaaaatacaaaaaattagctgggcatggtagtgcatgcctgtaatcctagctactcaggagacaggcacaagaatcacttgaacccaggaggcggaggttgttgtaagccaagatcacaccacttcactccagtctgggtgacagagtgagactctgtctcaaaaaaaaaaattacccttgatgtgtgggtggtgggcctcatccaatcagttgaaggctttaagagcaaaaacgcatttgccagagaagacattctgcctcaaaactgcaacatcaaatcctgcctgagtttccaacctgctggcccaccctacacattttggacctgccagcgcccataatcacatgagccatatccttaaaataaggtataggccacacataaacacacactctctctctttccctctctctctctatatgtgtgtgtgtgtgtgtatatatatgtgcgtgtatatatatatgtgtgtgtatatatacacacacgtatatatagatacacacacacacatatatatatatgttgtattccctatctaagacccaggggaggcagagcagcattcatctccactgtcggaaggtagtccaaggtcaccccaaggaggcagaacccagggctacagactctcaaaccagtgttcttcccacaaaatcaaaggcagtgcagtccctgagaaagggtcatctggtgccaggctgcccaagcgggatccccactgtgtgaggctgggtggggaacttgacatctgctctcctaggagtgggatcatggaccccagctcacagggtccttgtgcattttctatgcaagtagagtgtagttcagcccggcacacagtaaatgcaagatattgttgctattaataaaactctagaacaaattccccagaggtcaaagtctggctgtgtgccagcctccaacaggcttctgtggctggcggggagccaggctacagggaaaactccccgtacacccagacctggagcctggggcctggtgaggaacgtgggatgattctgaaaccagttggcggaggaagggtttatggtgtgtctcagcgagtggtcagcacggcaccagggtggcgtacagaaggggcctgggagggcagcctcacctacaggggcccctctacagtgccactggcaccagggccgtgtccatccctaggctggaaaacgtgcttcccacttagggccccggggaagctgcttgggtctgctctgcgtcggagggagctcaggagggaaggccaagatgccaggctcaggaggtcccctgccctctggcactgcctgggactctgtctcaggtgcagtcaggtggctccgtaagtagcttctcccctacacctggccgggcctccagattctcttaacagccttattagtgcaagtgttctttgagtcatcggatgtgtcattggccccatttgacagatgaaagtgtggctcagaggggcagggactcgcctgagctcatggctggattggaaccctgcccccatcccacccagctcagattccaggctctcacaccctgccccaccctcagcctcggcagtctgccccttcccagcccagtgccccagccccacaagtaacacgctcccagcctggtcctctcctgtggctccctgctgcccggttccagcctctgcagcagaacaagctgctgtctagtccctgcctggttccctgtcgctgtgcccatcaaatgccacttacaaaggctctcacagctcctcaaagctactgctccccctccatctggaaattgagtttagtttgtttgttttgtttttgagacagagtctcactctggtgcccaggctgcagtgcctggcgcaatcatggctcactgcggcctcgacctcctggctcgggtgattctctcgcctcagcctcctgagtagctgggaccacaaatgcacatcaccatgcctggctactttttaaattttttttgtagagatggggtctcaccacattgcccaggctggtcttgaactttggaactcaagccagccttccaccttggcctcccaaaatgctgggattacaggcgtgagccactgtgcctggccaattt

SEQ ID NO: 544 - DNA, 9058 bp, Homo sapiens
accacaccgctagcgcctctgaacctcgccaggcacgtccggttctgcggcccccactccgcccccgcctgccgggagccgcgcagtgagttactgactccgccggcgcgcacttcatttattcaatagctctgggcctgaaaaacaccggggaaattgcatcccattttccccaagcccattagcaaccagcggtctcattctcgatgattccgctgagccaccccggctctaggggagggggttttattctgcctctgccgccacccccacccaccctcagaagggcaccagcttttccaatctgtgaaccccaaagaactgcagggcagggacccctggggacccctcaacccccctcacccccgcagccttcagtacctcccgccggcattcctctaccccctctccatgtccacccagcctggccccaagggcggatttcttctggctctgggctctattctcgggaggggggcactggggtgggggcgcccagatttggagtggcagcaccccctccgcctccacctcgggctgtgggaccgcaggcaggtggcttctctggcctgcgtttacttttttttggctgaaaaggggaaaggtggaaccactggctggctgccaggaaagggcattgggggagataaggggtgtaaaggccttgacgaacggggtcctcttggccaggaagcatcttggggctgcactgggcacacggcattttccccaacccagaggtgggcgcccagtgccagtaactggtccaggcttctaaaggtcccattcctttgtctctgcagcctggtgcgccctgccaggcagttgcggggaggtggtggtctctctgtggggtcatagttcagagcacgcgtgctcggagacatagttaaatagaagctgaatgcgtgaaatatgaatacatcctcacggtcctcgtctcgttataggttacaaagtgccgggagccgtgcagggccagtgaacccctcgctgagactcagtttgctgccatcacaagtgctctgagaatcctggagagggaggatattggagacaaacgggactgctgcccgccttttaggcgaccgttggaggctgctctgtgccggacacaggcagggaggtggaggccagatacaagaaaaccacagtaccagtaaatgacaaaggctggatcttaacccaagtcctccgactctgaaggccatacccaacaggtcccattttatttgttttacttttttttaattgaagaaaaaaaaactagcattcccctacagtgccccccacctggtggggacatcttgggttggcaaggccaccactttcaagagtagaagtgtttttcagcaggaggagttggctgcaccaaaggagctcaggagaagctggagtctcaggcccagcaggaacagccagaggttttgcagctttgcccagcggctgggttcgccgaagggtctccctgggggttcccagcatgagccgaagccaccctcccctgtgggatctgtgaggccaggcattgggcctctttaggcctcagtttcctcccctgtcataggcaactgacagtccctctggagcgccactggggctgcagagggaggccggagagatggtgccccccctcctccccgccacccccacacacagccctcagcaggatggtggctgcctggccgattgcttttgcatttgcagcagagcgggggagtgaggccaagctgagtgccccctccccctgcccagccagctcagacccaggcggtggagcaggaaggctctggggaaaacagtgtgagtcaccgggcggccagagtgtgtccttccctgctagcgcactacacggcaggtttcatagcttgacagcaaagtgtttgaaaacgaagagcaggaattccgcggttcctgcccggcctcgccatccagctgggagaagagcatggtcatttccttcacttagtccacggccactcggcgctcatccccagcacagccctccccaggctgcggcaaagactgttgctgtcctgctgagggatgtgcccccggggattcaatcgagattctgtaagatgtgggggatgtggcggggtggggggtggcttctccacatccccagggctctccttcttccccagtgaggtgggagaagccgcagattggggtctgctgaggagcgggcctacatgaggcccaggtcgtgacccatggctccggggaccagaaggtaaacagtttcggcacagggtgctcccactaggtcataggtggattcagccttctctgagaaccgagaagattctggagtcttttgaagcaggaaaggagatcagaggaggagatggtggcaaagcggggactgagactcttgaaatgtgtttatcccaggcagagcagccgctgaaaggggagatggagagagaatgtcaaaagcagcactgggtgttttcctggggtctctccacagtgccccatcatttccgaatcaccaggcccgctggcacaggggtctgcagcccaacctcgcagaatgaccccctctctgcaggcgggcatcaccctgacagccccctcccaggacagaaaacctatagacacctggctgctgggtgtcaggccacccgcccgtttctcttcctttccttccagcctttcctctcccaaccagccccctccccacccggtcccccttctatttttcctggctaaaaccagccacagataccaccacacccggaaagagataaataaataaaagaaaaacaacctcaactgtgaaaagcagtccaaatctgaattttttccggcctgagttaattacactttaaattggcatgtttactgatcggggaatttcaagttaacagagacagcgccccctccccaactgtttgtacagtagaactcagcaggctggcgggctcccccaggccttggcaggtcctgccgctcccctgccaacgagagagcataacagaaacatctatttttgagtgttagagaaaacgaagatctcacagatggcgggaagcagcattctggatggtttcctgcacccaggctctgtgcaccttctcagcagcctcttgccccaggaaagaccagggcctttggcctctcgggaccctgcaagctagctgccttgcacagggggctgtctgcctatcccatcgtcgagggccgagcctggtcgaggctccccatgctgtagcactgtccagttggctctgaccccttctccttggagcaaggctgtgtggggtgcggagggggctctgggcaggaagcaggagtccctgatgcattcattcactcagcacacaccaatggagcgaggagctacaccaaataaagtggtggcctgatctctgccttctcaagaccgaccctaataatgggcctgggtctcccctagaccccatgtaccttggaaaaatcccatccctgctccaggcccaaatagaggcaaccagtggatcttctgatggatgcaaacccaaggaatgcctccggggacaggccagacccccagctcacagccacatctctcctggcagaagtggcctgatgtggccacccccgccccaggccttggttcatggtcgggatcaaccgcaggctctgccgtgggatgtccacaccctcaggacccgccgggtgccctgtgctgcccacagaggagagacaaggccaacaagcatcactgagcactttctctggactcagtcctgtgctaggtacagggatgccattgtgcacaagtcagaaacagccgcggccccagcagagcctgcagtctgggtagggagatacttgctgatctaagaatcagagcagtggatatctgactgcaaattgagactgcctgtgaaggatgaatcagggaaggcttcctggaggaggtggcctcccagagctcagcttgtccttccttgaggtcctttccattcccagtccccctctggtcactcacttggcccagggcctagggccttcgggcaggcagtgcagctgcacaggcaggtgctgtacctgctcccctgcacgctgctgggataacgggaaaatgatgaatgaggccccatcatgccctgcttcccggccctcaagcccattcccatccatgacaaattgtccctctacctccacagggtcttttcagcagcctcgcctgggaagccttggcagcacttggtggagatttatgcccatcttccccagattcttctttgtttttctgcttctttattccctcaaaatatgcttttatttattcattccacaaacgttctctgagtgcctcccgtgtgcttcctcctggtgatagagagatcgggttcagtacaccctcctgtgttgaacacctgctttgcactggtgtctatggtcagatttcatccaaggagacaggcatgaactaagcacctactatgagccagcactgccgagccaagggccctggcttctaaaagctctgccacagggtggccgaaaccccagccccttgggtattgaggtcctggcttggtgattttgcagcccttcttggtctgggtcgcctcaatttttacaaagaaggaagccgctcgttcatcagaggtgggtcttgaccccagagtctcaaccccaaagctggggagacagtgctcagaacaaaagccacagcaatgcaccctgccctctgtggacctcagttttcttacctgtccaagggtgtgagcagagaggcaggacaagaagggagcagccctgacatttgggggttctctgaatccttgaggacccctgacgaccgtgagctccgtgggtctccaggactgcaccagccaacgtgtctgtgcagagtggtggtacacagacaagggtgggggtggtgaggggagcacctggtcccacccaggagagatcaaccagatggtctcagcgcacccaccaccttcactaggtcttgttcactccatgcaactgaggcagtgaatatagccctcaactgccatcaagcggagtgaaaaacacaggtcaacataggtctttggtatttggatgcccatcatgctttgagtcttctgacaaagcaagcagccctctccccaggccagacacgcaccaaagcatcccacttcatgggtgatggcaccaagttggagagatgacaggtgagtacagagaaaaaaccatgaatattctggcaagctaagtctgggggaaagtgagcctacctcatcatatgataccaagaaaagaggcccattcggtgagcgatctgtcttccaggacacaggggctattcctaaagcccgtgcaagcagggtgggtgagagcacacagcctggagccagaccctgccccacctccagctgggtgaccttggttgactcactcaacctctctgcgctccatttcctcaactatggaaaagaaactgtctcctcacagcagctgatggggcccaggaccaaggcaagcgccccaacacgacagctattacttctcctcttatctcccgctgaaacaacaaggaaatgggaacggaggtccaggttgttcaatttcccaaccacgtccaggagacatagtggggataaaccgggcccttgcactggagaagggagcacacctcgtgaacttggaccggcggcagggtttacacaccgcactgaagacgggacaagtcacagagcctctggttgaagggtccatggagactttcatcctggccacctgtggggcacacgttcttatttggcttatctgatgagaaaggccctttgtttattttttcttctccgcaaacaatagataaatcaatcatttttgcttttaatgaaattctgcatcaagtggcacagggtcactgtgtttgggttagaaatcggcggggaacatgcacgctgctgcatgccgggccgacgccggactcaccccctaattctcaagtggcgcgtgatgcacccagcactcttcctgagtggtggcctgggagactcggcgggggggccgtgcctgttaacgccgtggtgtgcggggatggttatattgaagctattaaataaggctaatgtcactcttcccctcacacacacatttaatatattccaaagatgtgtagatgcattaacagcaattttcatctccaaatgttcccatttagtcagccccatgcataaaatatgagccctaacaccacgctccagcccgttgcagatggagttccccagagcatttggctctcagcgctggggcgtttgctggaggggcgggggcgcgatcagtcggcatctgcaggggaacacagggcctgtcacttcctctggggctttggtgcccccaccccccgacaagtggaagagagaacccagacccaactgactcgtgcctcctgcagctaatctcagcctcatcctggaagggcagaaaaagctagaaaaccaaacagctttgaacaaatgggaagaatttctaaaaatcaattaacatattcatgtactccatcaccacatcttattgactgcctgctttgtgcccagcacctgcctgggaattcatctgatccggtccctgcctttggggactccattagtcaatcaacaaacactcactgttctgctactgaacacagcaggggatgagagagagagagagagagagagagagagagagagagagagagaaatttctgccaatgagaaatctcacagtctagggcacaaagaaggtagacattaacattaggcaatttcagagaactgtaagctaggaagaaaacagtaacggggcaactggtagaatgtgatagggaagaggcaaggggagctgcttttatagggttatcagggatgaccttgctgaacaagagccattccatccccttgggaattgtgaacccctgggaaaggaaaatgcaaaggatgtgggcctttaaggaaggaagggccagagcctggacaggaggcagccgagggcagagcagggcggcccaggacccagctccggaaggaggggcatgtgcaaggccagaatgaaggatgaaaacacgtgggggataggctgtggctccaaaagaagaggggggctgccactctgagggcctggggggtcctcggatcattttggtaccaagcccaagggaaggggcctgcagaggtgccctgggcagcggagttaaacagctggactctgcacttggaaatgctctccctggcagagggaggggcactggagggagacccaagtgccacaggctggagggacctagcctgtggggcggcctctccagcagggctgtggcccaggggctggggaagaggggtgctgagggagagtgggagcaggcagcccagagggatggtgccagggatccccactcccatgctaggcatggagaggagcggtcccgaggaggaggacaagggggagggcaggcacaggctgtgacttccaaggcagcgacgtctcaactaggggatgacgggagcccagctcaggaagatctcccgagcccaggagctcactgatcaacaatgagtgataaaggacagccttagctcattctttggggtcactcctgaggtgctccttgccttcagccctggaccctgggcatgggcagcatgttctggagtcactaagtctccaggtcagctgcaaacaggcctctggtcatcttcctgtagtctgggcaggccaggggtgcaaatatgacataagcatcgggtagctgagagccagcccagcctgggggatgtgccaaccggaagcaagggcatggcgggtgctcccgctgacactggaattggggatgccattctgtcacacttccaaagccccccagaacagagtggagctggaaaattaacaggccaagtgacacaggtcctacacaaagtccacagggtcaaccagcgcagagccagctgctgcctggagttgacagcaaagaggaaggcatccaaggtgggattcgatatcggaaagaggttgactgtataatattcatcatatagaaagtgaacacctcacaggcaacctatttcaggtaccactgagcagcactgactccagggaggaggcttcttccacagggaagggccctgccacccacccgcctccaggatggaggccagcacagggctgcaggtggaagtcaagcgcgtgctcggccaccagccatgcctctgggggcccacagggcgcgcaaccggacctccccgacatcagcaggtgcaggaatcatgcaggtgggatctgatactgaagagaggccgctcgtgtcttgtgtgtcatgatttctgtgaatgcaacacaggccacctctcctcaggcaccacaaggagcagcacacgcacacggccacccaaggcaccagctcccacccagggtctcacagcactgagatgagcagaaggcagcccaggtgcagggaatgcatgcagccgcccccaacatcctggcgaggggtgggtggccttccagcaggatgccttccagcgggactagctcccccgtgtcctctgcctcgatgacactggccatgaaaaacagactgagccccgtcaccattgctcatcagcttcatgaccgccccccaccacagtgcacaaccctagcatcttccccaaagtccacatggccccccgaaagctctcccaaaatgattcaatggcgggggtcaggggaaaggatgacaaatgtcacaccagcccatgcattcacgtaccctggaaagtcccgcctcaggcgtggcgcccgcacaccaccgggcggtagcggtactgaaaacaggccatctgtgttatattcgtcattaataaaagcgaactcatcacagacaacctcttctcaggtacccagagtgccatcggctcaagaacgtggctgccgcgtcccgtggtgccagcgctgcccccgggaagcagtcctgaggacggatgggacatcaaaggtgagaagacacagagacaggaaagagacccctgcccggcccactctcggtgaccaggccccactgaggcagcgactccaaagcacccgtcctgctcctaccctcaaa

SEQ ID NO: 545 - DNA, 8200 bp, Homo sapiens
cccagctactcgggaggctaaggcaggagaattgcttgaaccaggacccaggaggcagaggtggcagtgagctgagattgtgccactgcactccagcctgggctacggagtgagactccgtctcaagaaaaaaaacaatggactagctgaatccatttttttttaaatttctgtaggttattggtgaacaggtgatgtttggttacattattaagttctttattggtgatttgtgagattttgatgcacccatcacccaagcagaatacactgcaccctatttgtagtcttttatccctcacccccttcccaccctttccccgtgagtccccaaagtccattgtgtcattcttatgcctttcatcctcatagcttagctcccacttacgagtgagaacatatggtgtttggttttccattcctgagttacttcacttagaatagtaagtctccaatctcatccagatcactgcaaatgccattagttcattcctttttatggctgagtagtattccatcatatatataatatatataaaacacacatatataatatatgtatatataaaacacagtttctttatccactcgttgattgatgggcatttgggttggtgccactgaatgcatttttaaaaataacccaactatatggtgccatcaagaaactcacttcacttgtaaagacacatacagactgaaagtgaaggatggaaaaagatattccacacatttcacacaaatggaaaccaaaagtgagcaggaatagctatagttatatctgataaaacagactttaagtcaaaaactataaaaagataaaaaggtcattatatatgacaaatggatcaattcagcaaggggatatattagattggtacaaaagtaattgtagtttttgacattaaaagcaagaactgcaattacttttgcaccaacctataacaatgcttgatatacatgtaccccacactcgagcacccagctgtataaggcaaatattacatctatagggagagatagacttcaatacaataatagttggggacttcaacaatctgctctcagcatttttaacagatcacctagacggaagaatcaacatagaaacattggattttaactggattttagtaagaacagaaaataaataagctggactttagatcaaatttgacttaacatttacaaaacattttattttatccaaaagctgcagaatacacattcttctcatcagcacatggaacattctccaggataggccatatgttaggccacaaaataaatctcaacacattttaaaattaagatcaaatcaagcatctttttaaactacaatggaataaaagtagaaataacaggagctttggaaactgtacaaatacatggaaattaaacaatatgctcctgaatgaccactgggtcgatgaagaaattgagaggaaatttttaaaaatatgtttttaaatatttaatatgaaaatagaaatgcaacatacccacacctatgggatacagaaaagcagtgctaaaagggaagtatatagcactaaatgcctatatcacaaaagcagaaatattttaaataaacagcctagtgatacacctcaaggaactagaaaaccaatgacaaaccaaacccaaaattagtagaaggaaaagtatagtaaatatcagaacaaaaacaaaatagagactaaaaaacaatacaaaggatcaagagacaaaaagtgcgtgttttaaaaaaaagatacacaaaattgataaacctcctagctagactaaccatgaaaaaaggaagaagagtcaaataaaatcagaaatgagaaagaagatattataactgataccacagaaacacaaaggatcatcagagattactatgaacaactatagccaacaaaatggaaaacctagaggaaatgggtaaattcctggacacatacaaccttccaagattgaacctggaagaaatagaaaacctgaacagaccaataactggtaatgagattgaatcagtaataagtctcccaacaaagagaagcccagtagtggatgactttattgctgaaccctaccaaacctatagagaaaaactaacaccaattcttcacaaactgtttaaaaacaattgaagaggagggaatttttcctaactcattctacaaggccagcacaaccctgacaccaaaaccagagaaggacacaacgaaaaagaaagctacaggccaatatccctgatgaacacaggcataaaaatcatcaacaaaatgctagcaagctgaattcaacagtacaccaaaaagataatatactatggtcaagtgtgatttacccaaagatgcaaggatggtttaacacatgcaaatcaataaatgtgatgacatcagtggaatgaaggaaaaaactttatgattatctcaatagatgcagaaaattgtttgataaattcagtatcccttcatgataaaaaaaaactctcaacaaattagacatacaaggaacatacctcaacataataaaggccatatatgacagattcacagctgacatcatactaaatggggaaaagctgaaagaccttcttctaaaaactggaaccagagcaggatgcccacattcaccactcttattcaacatagcactagaagttctagccagagcaatcaggcaagagaaataaataaaaagcatctaaattggaaaagagtaagtcaaattgtctctttctgtagatagcatgatcttatatatagacaacctaaagactttaccaagaaaaacccttacaactgataaattcagtaaaatatcagaatataatattagtagtattttgatgcatcaatgatgaaaaagctgaaaaagaaatcaggaagacaatcccatttacaataattaaaagataaaatacctcggatctaaccaaaaaggtgaaaggtctctacaagggaaactacaaaacactaatgaaagaaataaacaaatggaaagacattccatgtgcatgaatcagaagaattaatatcattaaaatgtttacccaaagtaaacttgattcaaagcaatctctatcaaaatactattgtcatttgtcacagaaattgaaaacaaaaataccaaagttcatatgaaatcaaaaaagaatcagaatagccaaagcaaccctgagcaaaaaagaaaaagctggaagcatcacactacttaacttcaaaacattacagggctatggtaacccaaagagcatagtattgatataaacagacacacagaccaatggaacagaatagaaaacccagaaataaatacatatatttaccaccaactgattttcaccaaaggtgccaagaatgtgtatcagggaagggataccctcttcgataaagggtactgagaaaactgaatattcatctgcaaaataatgaaactagacccctaatgtctcaccatacacaaaaattaaaatgattaaagacataaatataagacctgaaattatgaaactactggaagaaaccacaggggaaatgtttcaggacataggtcaaggcaaaaattttgtggctaagatctcaaaaacaaaaatagacaaatgggactatattaagctaaaaagattctgcaaaacaaaggaaacagtcaacagagtgaagagacaatctgtagaacaggaaaatatgtgcaaactatttatccaacaagggactaatattgagaatatacaaggaattcaacagcaaaaaaaaaatcccttttaaaaagtaggcaaaggacatgaagagacatttctcaaaagaagacatacaaatggccaagtatatgaaaaaatgtttaacatcactagccatcagggaaatgcatatcaaaaccacaatgagatatcaccttaccccacttagaatgactattattaaaaagaccaaaaaaaaaatgctggcaacaatatggagaaaagggaactcttacacactgttggtggatatataaatcactacagtcattatggaaaacagtatagaggtttctcaaaaaaactgaccactaaatcagactactaaatccccactactgggtatttacccaaaagacaggaaatcggtgtatcacagggacacttgacctccatgtttactgaagcactattcacaatagccaacatacggaatcatctaagtgtctatcaatgaatgaatgaagaaagaaaatgagacatacttacacaatggaatactgtttcgctattaaaaaaatgaaattccgtcatttgcagcaacattaaaaaatgaaattccatcatttgcagcaacatggattggaactcgaggtcattatgttaagtgaaataagccaggaaaacaaatatcacatgttgtcagcaatatatgggagctaaaaaaggtgatctcatgcgagtagaaggaagattgataattaccagaggctgggaagttgcaggggttggggcgacacggtgtcacgaagagaggttggttgatgggtacaaagttacagctcgaaagaaggaataatttatattgttcaacagcacagtagggtgactatagttaataatatattttataatagctagaagagaatattattatactttaagttctggggtacatgtgcagaacgtgcaggtttgtcacataggtatacaggtgccatggtggtttgctgcacccatcaacccatcatctacattaggtgtttctcctaatgccatccctcccctagacccccatcccccgacaggccctggtgtgtgatgttcccctccctgtgtccatgtgttttcattgttcaactcccacttatgagtgagaacatgcggtgttcggttttctgttcttgtgttagtttgctgagaatgatggtttccagcttcatccaagtgcctgcaaaggacatgaactcatcctttttttatggctgcatagtattacatggtgtatatgtgccacattttctttatccagtctaccattgatgggcatttgggttgattccaagtctttgccattgtgaacagtgctgcaataaacataggtgtgcatgagtctttatagtagaatgatttataatcctttggatatatacccagtaatgggattgctgggtcaaatggtatttctagttctagatccttgcggaatcaccacactgtcttccacaatggctgaactaatttacacttccaccaacagtgtaaaagcattcctatttctccacatcctctcaagcatctgttgtttcctgactttttaatgatcaccattctaactggcacgagttggtttctcaatgtggttttgatttgcatttctctaatgaccagtgatgatgagctttttttcatgtttgttggctgcataaatgtcttcttttgagaagtgtctgttcatatcctttgcccactttttgatggggttgtttttttcttataaatttgtttaagttctttgtagattctggatattagccctttgtcagatggatagattgtaaaaattttctcccgttctgtaggttgcctgttcactctgatgatagtttcttttgctgtgcagaagctctttagtttaattagatcccatttgtctattttggcttttgttgccattgcttttggagtttgagtcatgaagtctttgcccatgcctatgtcctgaatggtattgcctaggttttcttctagggtttttatggttttaggtcttacgtttaagtatttaatccatcttgagttaatttttgtataaggtgtaaggaaaggacccagtttcagctttctgcatatggctagccagttttctcaacaccatttattaaatagggaatcctttccccattgcttatttttgtcagatttgtgaaagatcagatggttgtagatgtgtggtgttatttctgaggtctctgttctgttccatttgtctatatatctgttttggtaccagtaccatgctgtttttgttactgtagccttgtagtatagtttgaagtcaggtagcatgatgcctctacctttgttctttttgcttagaattgtcttggctatgtgggctcttttttggttccatatgaaattgaaagtagtttttttccaattctgtgaagaaagtcaatggtagcttgatagggactgcattgaatctataaattactttgggcagtatggattttcacaatatttattcttcctatccatgagcatggaatgtttttccatttgtgtcctctcttatttccttgagcagtggtttgtagttctccttgaagagatccttcacttcccttgtaagttgtattcctaggtattttattttctttgtagcaattgtgaatgggagttcactcatgatatggctctctgtttgtctgtattggtgtgtaggaatgcttgtgatttttgcgtgttgattttgtatcctgagactttgctgaagttgcttatcagcttaaggagattgtgggctgagacaatggggttttctaaatatacaatcatgctgtctgcaaacagagacaatttgacttcctcttttcctaattgaatacgctttatttctttatttctttctcttgcctgattgccttggccagaacttccaatactgtgttgaataggagtgatgagagagggcatccttgtcttgtgctggttttcaagggaaatgcttccagcttttgcccattcagtatgatattggctgtgggtttgtcataaatagctcttattattttgagatatgttccatcaatacctagtttattgagagtttttatcatgaagggctattgaattttgtcgaagaccttttctgcatctattgagataatcatgtggtttttgtcattggttctctttatgtaatgtattatgtttattgatttgtgtatgttgaaccagcgttgcatcccagggatgaagccaacttgatcatggtacataagctttttgatgtgctgctggatttggtttgccagtattttattaagaatttttgcattgatgttcatcagggatattggcctgaaattttctttttttgttgtgtctctgccaggttttggtatcaggatgatgctggcttcataaaatgagttagggaggattccctctttttctattgtttggaatagtttcagaaggaatgttcccagctcctctttgtacctctggtagaattcggctgtgaatctctctggtcctggactttcattggttggtaggctattaattgctgcctcagtttcagaacttgttataggtctattcagggatttgacctctttctggtttagtcttgggagggtgtatgtgtccagaaatttatccatttagaagagaaaatttttaatgttcctagcacaagaaaaagataaatgactgaggtgagagctatcctaaataccctggtttgatcattacaccttgcataattgtctcaaaatatgacatataccccataaatgcatataattgttatatgtctattaacaaaattttaaaaataaggactggatgtgggtgatgaataaatgaggatttggtatactattttctctacttcttatgttcaaaatattttataataagttaaaatgaataataaaataaccaaaaaagatctcaaaaactactatattttgtacattcatattacaggcacactttattgtacttcgctttattgctctttgtaggtattgagttttttacaaattgaaagtttgtgacaaccctgtatcaaggaagtctatcagtgccatttttttccaacagcatgtgctcactttttatctctatgtctcatttggtaattcacataatatttcaaactttttcattaataaataactgttatggtgatctgtgatcagtgatatttgatgttagtgttgtactatagggtgccaataactctgcctatacaagatggtgtacttaatcaataaacgtgtattctgactgccttaccctccattccctcatctctttcccactctcttccctgacacacaacaaacaataatgaaattaggctagttagtaaccctacaatggcctataagtgttcaagtgaaaggaagagttgtatgtcactcattttaaatcaaaagctagaaatgattaagtctagtaaggaaggcatgtcaaaagctgaaacaggctgaaagctaggcctct

SEQ ID NO: 546 - DNA, 2114 bp, Homo sapiens
tcatgatagacacaatgaaatccaccctcaaagaggtaaggcggggctcaggcagctggtgtccagccactgtcgcccactctggtcccacctcacccatctcttctcatgcactgggaaagacccctggtctgcccccaggcccaacaagtgaccaccaggatctatcaggcctcatgctccagtgatcagtccctagaggcctggggacacatgtaatcagaatttaagaaacagagacctttggtggggaggttctttaccatcctcaagtacccacccctccttcttggggccaggcacaattaggtgacccaactgccagagacagtcccacattttttgagagacagggtctcattctgttgctcaggctcagtcatagctcactgcagcctcaaactcctgggctcaaatgatcctcccacctcagccacctgagtaggtggcactacaggcgcatgccatcatgcccagctaatagtcacactttttttttttttttgagatggagtctcactctgtcgctcaggctggagtgcagtgggaagatctcagcttactgtaacctccacctcccgggttcaagcgactctcgtgcctcagcctcctgagtagctgggattacaggcacctgccaccatgcccagctaatttttatatttttaagagatgggggttcaccatgttggccaggctggtctcaaactcctgacctcaggcgatccgcccaccttggcctcccaaagtgctggttttgcagatgggagccaccatgcccagcctagtctcactttataggctcccaaaccacagcagaacacctggctgcctcatccctctgcacccatcacgccagtgggcatgctggctgtaggtggggatggcctttgcccgggttcctgggagcacctggtgttttatggtcacctacccacttacacctgaccctggggcctctgcagttttcttggcgttgtcaccacaaaaggaagaagcccacctgtggctggctggctggccgccaggtcagagccaaggcaggcagggccttcctgtctggcttcttgaaggcagacacaagtctgcaggctgctcacgtcatctcattatcttttctcacgaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggcccacctagcctttccctgctgcccaactggatggaaaataaaaggttcttgtattctcactgcttttgaggctttttcgttgccagcaagggcttttgcattgagggaaaaggaagcacagaacggattcatccagggtcctggagaggagggtgtggaggcaagaagcaggaaggacaagtcctcctctcggcacgcctgggtccccaggactgctgaagcacaagacccgaggggtggcctggtccttccctcctggcctgtgtggactctgatggggctgttggacgcggtggccttcaacctggggcccgttggccagagctcggcctctcagagaccgctgcaggccctgcctcgcctcctcctggccctgcacctccagccattcactgcggctctcacagctcagtacggtcggaatttgcgctgggcccgcagcagctcgatcctctgcttgtcctcctcgaacttcttgcgcagctgcgctag

SEQ ID NO: 547 - DNA, 2412 bp, Homo sapiens
acatcttgttaaatggcgattgtgaaccagtagatctggagtagggtttgagagtctgcatttctaacaaacccaaaggtgatgttatgctctcagcaaggttctagactgctaaatttcctatatagacttagttgttgcgatgtctttattcaaaaagaactgctttgttcttggtcttataattgtaagatattttgttaggtgagtcccatatattttttctcacttaatcttcacaacacccctgcaagactgtaatacatgttcattatggaaaattcagataagcaaaaagaagaaaaataaaagttacgtagataccagaaattaaaataatatttatttataagtttaagactccaagtgaagattaaagttctaaaaggaactaaagttatagcttcgggagtattatatgcattttcccaccttaagtaaagaaaacaaaacattgtgggagtaatatgactgaaactaaaatgtatttacttagaaaagaccagaagaaaatgtcagagcatacagtagttgcattagggcagcactatcatcatgggcaccttaggctcagaatttgtcatgttttaactgtttctctgtctttgctcccatgtcatcttcagttgttgggtccaacttgcacatcttttccatatacctttattgttcttcctgtctttatcctagttcacttcatacctagattattatagtagcctgtgaagctggtctcttttcggcttaagtatttccagccgtggagagtatacctcaatgaaaatattgctgtagcaatttgtacctctttactctataatttattttttatcttacctttttttagtggtggagtaagaaggtaaaggtaaagggagatataggagctgatactattgtgtttcagtactggtgatctattgctaaataattatataagcttgcatactgacccaactcttctagaagggagagtgttaacaaaactaggagagagattgtagccaaggtttaaaatggatatatttatgggagaagcctgcttagtgaattgtgttttagggtaggaattctgaatgagtaagcatgtctgctctttttctaatatctgttaagtttggggctattttattccatgtcttttatcttcccttttagaaatccctcagttgaattaagaggaaaaaagatcatttaaaaaaatatctagactagcattgtatgaatgaagactgcagaaatctgtagaaacccgctagaaattggtcagttagtaaggtgtatccccttgatagcaatttctcatatggaggatgtagtagggaggtcatagcatctggagagctttttcctaagtgacagtcatcacattctgagatggcatcccacttatcacctttctccctttgagaatcagttttaatgagtcattattactaagggaatgtgttttatttctcatgtgcaggggcagaaaattaatttggaacagttaccttaaagaaagtgagttggcagtaacagtgattatttccttcactcccatgcccaaatctttcatactctttaaggctgaaaactgccacttcctgtaggaaatattccctgctttccttctggcctttcctatttaatttgtccctcttctgatcttacttgaatcttttttatgacccttgttattttctacattgtactataaattatgtgtgtgcttattaaaaaatctatattctatactagaaactcttcctagagcagagtacatgtctaacgcctcttgtattctcacagtacttaatagaacatcttgcacataatatagaggctcagcaaatatttcctgatcatattattaattgtgaagtttgctaggcaaaagttaatgaacttcaaatgtcattgctcttctacccctttaaaatgtcttttaccacagagaaaaattagcaaaaattataaagctgatatccaataactgaaattaggaaagcaatgtattgaagaaggagctagtgtaaatctagaagtgagtagagatgtagataagcagtgaattttataaaaccttgtgggtaatgcaaagagtttgacctttttccgtacttgaagagagccatttgaagacttttaagaggggagtcatttgatcaaattcgtgttttaaataaattagtgtgatacaatgaggaagctaactgtacagatagtaacaccagaagatgggaacccaattaggttattgcaagaatctaggaaagaataaatcctaaaatcttagagcagaggcagtatagtaggataaaagagaatagatttaagaaatacagataaaattgataggcttggtgccttatttgatgtgaagtaaggcagatggaagcatcttgatgaggctttagagattgaagt

SEQ ID NO: 548 - DNA, 4852 bp, Homo sapiens
tttctttctttctatcactgtagattcatttgtatttcatagaattttatgtaaatgtctagcttttcactctgcaaagtcaatcagagttatctgtgttgttgcatgtctcaataatttattctttgttttgcagagtagtattcccttgtaggaacattccacagtatgagacaaggccctgcagagaaactctacatagaaagggtctccatggggctgggcactgtggctcacacctgtaatcccagcactttgggaggctgaggtgggcggatcacaaggtcaggagatggagaccatcctggccaacatggtgaaaccccatctctaataaaaacacaaaaattagctgggtgtggtggcacatgcctggaatcccagctacttgggaggctgaggcacgagagtcgcttgaacccaggaggtggaggttgcagtgagctgagattgcgccactgcatgccagcctgggtgacagagtgagactccacttaaaaaaaattaaaaaaaaaaaaataataataataaaaaaagaaagagtctccatggaacacttgatccctaattggcagaagaggtcaaggaaaaacactaatgtgaaacaagggcaaaaggtgcaagaaaattaaaaggcagttaataacttcaggaaaaattaaaaagctctaatataaacgaaatgtggctgggtgtggcggctcatgcctatataatcccagcactttgagaagctgaagtgggcagatcgcttgaggctaggagtttgagaccagccttggtaacgtagcaaaaccccatctgtacgaaaaatataaaaattagctgggcatggtggcctgtgcttgtagtcccagctattgaggggagagcagctaaggtgggaggattgcttgagcctgggaggtcaggctgcagtgagctgtgattgtgccactgcactccagcctgggcaacagagcgagaccctgtctcaaaaaaaaaaaaaaagaaatgtaattatagtgaacactagctcggcagtgaaaaatactgcaaagtcacatcatcaatgtgctttcaaaatcaaactgtaggcctaaatatagctatagaagaatgtaaacaaggaagcaaatgtaatcagaagctgagcagtaggagagaggaggtggggtgaaaagggaaggatgaggaaggtgggggtgtgcaaggctcttgcttacctgggtacccgacaggtgagatggctgtagcagacactggcagttccctgcccacacacctggccctgaccacggctgcacaaggcagctctgtgtgcaattgccagcatctgctttggtgttgctcttggtgctggagcttacttgctgcccatgtgacaggagcagctctaaaccagtggtcgtgagctctgtttcgcactggctcccatttctacactgggtctggtgcaggtgcctatggtggcagctggtgtgatgatttgccctttactgatggccttctcctcatcttactttcccatcctgtccttgaatcatccatttcaggatctgcctctgaaagaacccaaactaaggcagtcaatccaccacagacagacaaggaaatagaagcagagcgttttatttagagattatggaggaaaatacgaaaagaagcaactaacagaactgcaggtcattacctctagggaccaagactagaggtgggaaggggcggaagaggagaccatgcttttaaatatatgcatggcatgtgctactttaatataattaaaaacaatcacttaaagcaaattggaacagtgtaacaaatgaaatcaaatgaaatcaaaaggagagagcacaaatatatctgagtaacttggtctgtcccccagcccccttaatgttgttacctgaatatgtcaattgttgtcaaaagacaagcataaactgaaatcgattattgtatggatctgaaccgatggaaaatattctctgtacagcaattttaaaagtataatggtaatcactgtgttagggattaagtatacttcccaccctgtgtttttgccattgtataggaaaaatcatgcagaatacattgataatcactgtagaaatgagatgagatttattaactaaaacacttagcacttcacctggcactactttatgaagaagcactttgtatagggcactatgtgtagtttatatatataaagaaacatttgtgtattgggtttgaatgttacttgttgttgttgaatattcttctgctagtccaccctgtccctgatggaagctatgcccccggatcagaaacgcttgatgctcaagcggtcctgggaaaccactattgcaagtaactgtcagtgccctctactttccactagatggcagacttcccccagctctgtggacggcagatacccaggagaggaggacagagcttcagatctttgctttctccctttcccttgacctggaaaatcactgggctgcctctgaggccagatttagatttcctgcacaagccatcattaccttgtttagaggagtgaaattagggtcgacctgtcctgtcattccaggacagaaggtgacaaataaggtcctttatgtgtagcactgaggagaagggcttgttcttaatttttaagatattttccaaaaatagaaaaattctgttttacaagtcaaataagaaatgattgaaaaacaagtatcactgttcatatacagagtcgtaggtaaatgttcagatacaaaaattgtgaccatagagcatatttttggatatttgttttcatagtgtgatgaatatttttgtttgcttaaaattatttcagaagtataatcataattcaagcttgaaatacaagagtggtaaaatgagagcaaaaataaacaagtaataaaacgcaccacaaaatttctgactccattcccttttagggatttctttttttacaagagttatttttattgatttgtgtgacacactggctgacacgttttaaaataaataaactttgggtttcagatgaacacagtttgcatgctgtctctctggaacaatacacatcagaggaagaagttaataggaaaatcaggcaacccaaactgtgttttttaggttaatcaggaatttccttcaattctagtaaacaggtggaaatagaaattttgagctgagaaaagtaggaatcaggacgtggaagggaaaagctgggttctgctgcggtgatgtgggtgacccttcatgatgagccagctgtctattctcccagctctctcccggcggtaggaactgagaagaggcgcccctcgctgcaggccctttgatgcctctcctctcccctgtcctttcacccccgactctgtgagttgcttttagatatcgttctttacttaccaattgtctctttctcccctgcttgttaacgtatcatgaaaaaactgtgacgtgatgaccccccatgaatgcctctggaggaaaagtgctagaaaatttaaaaagaaaattaaggtgataaaactggcctcattaatctgttaaactccttcaacattgccaaaaacagaggtgagcttctcagctcagtttccccaaaattcacagaaaaaattactgtgcttgaaaagaaaacacagcgggccaggcgcagtggctcatgcctatgactctagcactttagaaggccacggtcagagaactgcttgaacctaggagtttgagaccagcctgggaacatagtaagacctcatctctacaaaaaaaggagcaaaaattaaccaggtgtggtggtgcatgcctgtagtcccaagctacaggctgggaggcagaggcaggaggatcacttgagcccaggaggtagaggttacagtgagctgagagggcatcactgcactgcagcctgggcaacagagtgagaccccatcccctccccacaaaaagaaaagaaaaacacagaggatgtaaaatggagctgagatagtgatattctgcccaatattttaggcagtgctgggattttctcactaaatgatcaatattgaaaactaaaatattttattaaaatgagaaaaaattatcaaagtgaagattaaaattataaggctcattcaaagagacgagggtgtacttatataatctcccagttttaactgcaagatgtttcatgacttatgatggggtcatgtcacatcctgataaacccatagtaagtcgaaaatagcataagccaaaaacgcatttaataccccaataaaccaatcatgaagctgaaaatcgtaaatcaaaccgtcactaagttggggactgtctgtattgtttactttaatattttggaaagttttttagtgtgtgataccaaaatctacttgacatttaagcactgattaacgctaatgattttcactgggtcttttttaagccctagcacagctgtttgaaaacttggctgaacattagaaccacctgggcgggagctggggttagcttttaaaactctcaggtcatatcccagaccaattaaagcagaatctctggggtgggacacaggcaccagtatttttaaaattcccccaggtgattccaactgctgccaaggttgagaaccactgcagtctggcttcattctgaccactgtctacacatgatgttagtaatggttgggattgaaggactataaatacaaggacagtgtttcccagtgccctcccaagtggaggaggccaggagggagagatgacgggatttgctgaccaattaggtagaggtttaagagaagctgttaggccgaggcggacagatcacttgaggtcaggagtccaaggccagcctggccaatatggtgacacccccatctctactaaaa

SEQ ID NO: 549 - DNA, 2252 bp, Homo sapiens
cattcgcctctaagctgatagctcttacggatctgctcctcagggaccccacccatctcctagttaaccaataagagcaccccacccccaccatcccagcaacaatgattggttcaggaatgagggcgtggccaaagctaagccaaccaaagccagtgatactggattctgggactaatttttaaatttcttaagaaaaactcttcgtactggattgctgagagaatgggatgtaaggtctgaactcatgtctgccttcatgctaccagcaaagagaaccttgaaaccaagtgccctgtatccagtaggtgcttaatagtagtttatcgagtgaaggaaataatggggaaaacatctgccaatgcaagtagtgccagtgcaatgattcaaagtggtactaagtgccccctggagagggctgcatacacatgcaattccaagtctaagaatgtatctcacagatacatttgcacatggacccatatcagtgttacggtgaaaggttggacaggttatgcactgcccaacattagtgtgcaccattcacatcaggcgggacagagtgggagaagataactttgctgtaaacctttgtgccctgtgtgattttttttttaccatgatcatatatagtttcttcagaagaaaaatttttatatcaaagccgaaactgtgcatttacatttctttatacattgcttggcacatcagtgctcaatatgtatcagctgtatcagcagccatcattattgttattttttaagctgttttgaaaaccttacggtgttattacaccatggagacacacgagggcgcgccaggcatctatttaaaaagtgttttcatagcagttcgtggaggctgtaattttgagtgtgtacaggagatgggggaaaaagtcttgggggtcccgtgtgggtgacaagggcaagtcttagttccaacttggtccagtctgccagccttgtcaatgaaataccaggactcccttcctgagtgctccatagtggaatcagggtgagcgtccactctttgcaagtccttagaggagagagctggctgagccggaggactggcccggggagcccctgctgcacccggacctgtgttctcatctgtgcagcagaaacaatcaaacccacctgcagggctatcgtgagattaagcagggtctctcagagatcaaaagaagcccgaactactttctagagtgaagaactggaaagaagagagagagagaaggaaaagaaagcctcaaacaatcaccaagattgaagtcactctcacaaggttaaattttacaactcacccctctgcctcatatacacggcaacctaacagtgccaggcagagatggtgggatttattttaaaacagtaacttatatggtctgatagaaggacccaagcttggccgggcgcggtggctcacgcctgtattcccagcactttgggaggctgaggcgggtggatcacgaggtcaggagtttgagaccagcctggccaacatggtgaaaccccgtctctactaaaaatacacaaattagccgggcgtggcggcgcgcgcctgtaatcccagctactcaggaggctgaggcaggagaattgcttgaaccctggaggcggaagctgcagtgagcggagatagcaccactgcactccagcctgggtgacagagcgagactccgtgtcaaaaaaaaaaaaaaaaagaaaagaaaaagaaggacccaagcttaataatttctttctgaccccttctgctatcagttctggcggtgcttctccgtgatttgggtataagcttattcgataaggttatacatatactcataagataatacacaaaagcatatgcagagggctgcggcagacagattgctggtctactggaaagccagctccccttcttggctaagagagtgcccaatgtgttccatgcacggcggatgacaatgtgcccaatggagagatgcttcagccccagccccagggcatccattgcgattgggctaagtcattcctttccgccagcaattgctttataggcaggcagatgccctggttctggccacagagacacaagtggatgtctcctgggagcttctgaaacagagtttttgtgtgtgtgtgataagatagagacacttgagaaacttctctcctgttggtcttatctttggatgttgtcagaacgtttggagctgcagcagccatcttgtgaccacaagggaaagaccaagggaattgtagaga

SEQ ID NO: 550 - DNA, 11880 bp, Homo sapiens
gtcctggcgaggaaggaaggagggcgcgggacgccggagggagctgcgcggggccgaggctcccacgcttgcaatcccaagggacccagggccaagggcgcagtaagggtgtgggctgggaggagggaggggtcgggacgagacgtgcctgaggggagggaagacacggactccggtttattaataaacatctacggtttgtacggcattttaagatgtgcagtgtgcttttgtaggtacatcgccttatttaacacaaaacctctctgaggtagctattacatttcacagaagggtaaacgaggcgtaggtggtttgagtgatttgcttgagatcgttcggctaataaagcaaaattgggacacaaggcttttgtcatttttaaaaaacataatattgaaggcctggtatgttccgaaccctgtgctgaggctaggaatacaaaaaaggaccaggccggtgtggcctctgggctagaggagcaggggtactccggaggctagaggggagagaggggacgatagtgactacaaattaagtaaatgtgatcatgaccgacatatgttgggccctttgaattgcgttatcaacacagttctaagtgcttacatcctttatctcttttaatcttttcaataaccttacaagtacaatttacaggtgaagaaaccgagacatgaagggcttaaataaatatgcctaaggacatatttatgagtctagaatccatgctcattacactattctgtattgttcaaatataatgtaataaaacggccttatagtctgctgccacaggatggagacatcttagggaatctttggactgacagctaaaagataagagcgaactagtttggggtagtaggatatttaaaacaacattacgtgcagatctgcttgtgcaaaaacggaactggaaagaaggcctaagtctggctaaagttcagaaagtaaagtggagagtactgtgagatgaggttgtaagtagatggaggcaagtggtttttgttgttgtttttgtttgtttgttctaaataatgatagggtttagctatgttgcccaggtctgcgttgaactcctgggctcaagcgattctcctgctgcagccggctgagtaatgggaactacaggcgtgcatcatgggacctagctacaggttttttatgcagcctttgtaggcaagattaaggatgaggctttgtctttaaaaagccatcgaaggatttgagagaggaaaatgataaggccatatatgttatgtatatccactgccatggtcatacaactttgaagttccagatgttatgtgttctgccatgctgtcctttaggtgtcttctggtccttcacaatagccatgtttaatcctgagatttgagttggagtgtttcgtttgcatctttttttctttccgtcaattccacctgagaaattgtaaaactgcgaatcttttcttaaaaatcattttaacatttgctgattgctcacagttcaatgaatatgtattgaacatttgcttggtactagattctggagctataaagaagaaaagagcaattccctgtacctgagatgcttatatattttcctggggaaatagacatgcaaacagatatttaaaatgcagcatgggctgggtgcagtggctcacacctgtaatcctagcactttgggagctggaagcaggcagatcacttgaggtcagtagttcgacaccagcctggccaacatggcaaaagcccatctctactaaagatacaaaaaaaaaaattagccagacatcatggtgcatgcttgtagtcccagctattcaggagactgaggcacgagagtcgcttgaacctgagaggtagaggttgcagtgagcagagatcacgccactgcactccagcctaggtgacacagcaagactccatctcaaataataataataaaataataaaatgcagtgtgataaatgcttgatagagaaaggggctaaaccagaaagttgttgggagcaggagaaaacagcattcacggaagaggaacatgtaaaggcaagagatctgtgaaaagtcgtgttgttatctgagtaatggaaaacatttccctgtggctggagctctgggtgagcaggtgaagcaaaatgagatgaggttggagggacaggttggggccaaaacgaagggccttctatggtatgctgaggtttagggctttttcttatagacaacaggagataatggaggtcttttcacaaacatttggcattaaaaaaaaaaaattctggtggcagcatgaaggacagactaagattgggagaaagtaggaaccaggataccatttaagccactaatggtacgctaaggtagtgtcacatactggaaaggctttgaaaggaaggaaaaagtaggagtgaacctaagaaataccagaattcaaaagacagccagaagaaggggagcctgctttaaaggctatgccatcttcgaatcaaaagggcaaggaagtattgagaggttagaaagtagttcaaaagtagctaaaaagggatcataaagccctgaaaataggcttttggtgaccagtgtgaagagttgttttagtggctcagcaaggagaaaattccctttattttgagtcttacactcaagtttatgtcctattttaaatggtttgttacagtattaactaatacggggtacttttgagtatgctaaataagaagtaaattagatttgatgctggaatgatttaattatgtttacttaagctttatgttaaatagcttagaggatagaacattagtaatgatagctaacatttgttacatgtcaggccagggtttagttttttgcatatattgtttcaattaatcctgtgaggtagatactatcattatgcacatttcacagaaaatgctgaggcattgtatgagaacaagcaccctattttgttttactttttgtagtcgtctttgactttactcttaagtcagtctggtgacatagctaggtaaactgaggacaaattcagcttcattcacatctggcaagaaccctcctccctcctcctagctctttccccatttgttacctcatctgtctcctgtttgggtactattcttgtacttcatcttgtcagctgaatttgggtcttctgacctaaattttagtgctccctaacgatctaaaattacacttaactttgctcttttctgttatttgcctaagcttggccctgggcacccaaaccctattacccagcctgcttggttagccccctcttaaaagctgctttgtctccacagcacagtgccttgcatactttaggcaggtactcagcaggattttgaaatctagtatgtagtgagtgtctctttagaacttaagaagctggaagaggcatagagaagagaggtctgaaaatgtctcagagctaaggaagatacgatgttgagataagggaatgaccagtgatgtcagataatgattatgggaagatcgatggggtttggcaaatgggatgtcatttgcataatcttctggtgagcagtttaactataaaccagattgttaggaatgaagaatttataagaagaaaatggaggcagccaaattttatagatcattcttttcagaaagttgtccatttcaaaaaatagaatcaggattttggtttgaatgaaagttgggttttgtttttgtttcatgtgcatgattggacagaccaaagtttgttaggcagatgttagaaagagttggtgaaggggcaagagtgaagacagcagggaagagaagcagcaagaaggaatgattgagataatgatctctcagatgcccagaacagttgtgagagggaatcaaggacaaagatgcagctgttagaaaaaggaggcaggcccaggcgcagagactcactcctgtaatcctagcactttgggaggctgaggcaggtggatcacctgaggtcaggagttcaagaccagcctggccaacatggtgaaaccctgtgtctactaaaaatataaaattagctgggcatggtggtgcacgcctgtaatcccagctactcgggaggctgaggcaggagaatcacttgaacccaggaggtggaggttgcagtgagccgagatggtgccactgcactccagcctgggcgacagagcgagaccctgtctcaaaaaaaaaaaaaaaaaaaaaaaaaattatgcttccctacaaggctaggggtggaggagtagttcatataagggtagtggtattatacaaatcttaaacaataagaaaattactaggttttcgagggcctgaaaagaatctataagttataaaaaatatatccagatcttctttaaatgatttaaattcttacagtgttgggaagggttcaatatgcataatttaggataagtcatatttacaaatcttctctgcaagccccttcctatgtgttaagagatggagaaatatcaagttcatttgaccctttaaccctaagagatgagtgtttcatattttgaaatattttactagctataatttcagatgcagctgcttttaaaagagtgtctgctgattatgaaaagctgggttttgagaataagtactagagtagactatttggaatccaggagttttattttactactttacatctgcattgcatcagacatggcgcaagttagcattccatttttcatgcttttgtagccctattttaggtctgtctgtgctcagaattggtttatattttcaccataatctattcatttgcctgcacagcatacagctgatagattatatgcaatgagttttaaattctacacctatttcttttactatagccttctcccatcatttgccagcccacatgtgggagcatggagtaattttaatattagccaaataaaaatttaattcagaaagcatatctgccaaaagtatcatgtgcagagcctcacaaagcctaatatatacatgtatacatgatggtttcaattccattatatttttggatagtgtcagtattcccctccactggcatgaataattagtgggaatatctgtattttgaaaattcaaaaatttattccctgaagatacagacttgaggaaagaaatttagcctactcaaaacacaccagaatgttaccttgaaagcagtttacattaatcttattcagaattagaaagtcgatgcagaatcagagagctgaaaaagatggcctgcgacattctgattgtatggttggtatttgacttttttgttttttcttccagaagcaatgcatgttcactatagaaaatcagacaatgccaaaaggcaacaagaagaaaatagagaacacttaaacgcattacccagagataaccaacgtaaatgtattggtggatatccttagacgttcttctatgtgacagaatatatctatttatctttaagaaaataatagattgattccattttctaagtgagctcggaaattttcttttggcttttttatgaccatgttattatttaataaaacctgtcattgtggagacttagaaaacatccttcctttacttcttcgggaatgagaaattacacgtaggcaatttattcaacatttttcattatgtcagcatgattagatgccaaatggctgtttggaatttttgaaggtatgttttttggacactttgccagggaaatcataactcttaaaattctccagtaaccctaaccatacaattggagttatggatagatactatgttccatgttttgttgttttctcactgtttcagtatctgggattaatgccaaaaactattcagcctcactcatttattaaatgagggtgtccaactaagtttatacaatagagtttagaaaaaaaagaagaccttgtttgtttatcattctagttaggtgtttttacatgagcaagaaagaaaagtattgtttcttaaattccttgatgaacttgcctggttgagaagtagagtatcatggataacagaattaattacctgacacccgagccacaagcagacatccttgcttattccaaaccgtcctccacaccgctgccaaagttgttttctcaaattcaaattgattactttccttcttaaagccctgagtagctcctctttacccgccctacagatttaatttatgactctttagaatgtgaaacaggctttctgtaatctgtcaaccccactcttaaattctttactccagtcatattaaagtacttggaattctctgttaatgttgatttcatacccctatacattttttcctgttctcccctctttttggaatgtgctatcaaaccatgtcaggtcaagcatcgcttcctctacaaaacctttccttaccatctccgctgccctactttccctgcttggggaaaatagactctttatgcctcattgtttatgcatacatatgagtaattgtatctcaccagcagtaacacactgttgtacctcttgttttcacatgtgcttctccttattagactataaactccattcaccatctttctggagctgtcatctttcattaggaacatcgtaatagcctttcagctagtagcctgcccccctccactgttacctgcttttgaagtgattctccccatctccagagtaagtgggctcatcaaactatgcttctctgtgtgaaaggtgtggtggtgggaactgggtgaaattagctccaggacaccattagcacttggtctaatttatttactacagtaggtatccatgtgctgagaggttctcaagaaggatggggagtggggaagagtaggagtaagtggagaaagtaggggctgagaaactaggtgaagaatcagaatcaggtgtagacagccatacgagtcacagatctgaaaaggtcgagttagccagagttcaaccagggctgccagaacttgtgtggttagggtgtgccaggcagtgccgttaggagcttccatgtattcaagggttggagtggtcatgaaatgagaaaacgctgtgcagtgacaaaaagtagttgcaaaattctgagtttggagccgagaggaacatacactgtgggagatacaacgagcagcctaagtcagagtcttgtcaaaatccatttcatgaaaagctgaactttcaaaatagtgtagttatatttggtgcattgcaatgccacataatttcctccttgaccactatattaaagggttgctttcaaacgtcttccccaaatggtaaacatgattccaagtggtttaagttcacatttctgtcaacagaaatttaacttttgtggttctgatgggtgagaagtgataactcaggattactttagtttggatctttctgattactgttcagatcatgcattttttcatgtttactgtttagatttgcttttctgaaaatgcctattcacacattctttactcgtttttctgtggagttttttttttctttttcctgtaaatttttggtcactcatttcatactataggtattaacctttttctgatacatcccagatatttcttgaagtctactgtataataagattattcttttctttatggtatctttgacaatacacatgtttaaaaaattatcttttcctttgcaactccctggtttgctatttcagttgagaatgttttcctaacctgtagtgtataaattcattctcttaaattttattctaacatattaatttttttacatttttgtttttaatccatatggatttaactttggatatggattaaatagaggtctagttttttttcctctagatggctatattaaaatcccatgtatactaagatacattttggcactccccattttaaagatttatttttctgagtaatactagccaacacatatcagtgcatatactatagatgtcaaatcctgtcctgggtgctttacatactttacttcatttaatcctggcagcatcattgtgggtaaattctgttccacatgaactttaaaatgcctttatcaaattaaaaagaaaccattggaattatgattagaattacatgaaatttatatatggattttttggagaattgacatgctttatgtctttcaataatattttattttcttcatatgtcttaaacctgtcttgtcaaatttagccttaagcattctgtacttttatcactattacagaaagaatatagtcatacgtctcttaacaatagggatatgttccgagaaatgcagcattaggcgattttgtcgttgtgaaaaatgtcatcgtgtcgttacacaaacctaggtgggatagcctactaacacctaggctgtatggtctagcctattgcttctaggttacaaacctgcatggtatgttactgtatggaatcctgtaggccactgtaatacagtggtgtttgcttatttaaatatatctaaacatggagaaggaacagtaaaaataaagtgtttcattataatcttaagggaccaccatcatatgtgcagtccgttgttgactgaaacatcatcatgtggcatatgactgtgtttttccattctcacttctttttggttactgctgtaaccattcctacagatgcagtaaggatggtatgtgtattagtcaggtttgtctaaattacactgcaataacaagcaacctgaaaatatcagtggcttataacaacaaaaaatttcctgctcatactgcatgcccatcccaagctggctgcagctctgcttcacatcacccttactctggggcccaggctaatgaaaccattgctgtcgggcacattgcagtcttgtagtagagaggagtcaaagtatagcatctactggttctgaaagctcctgccaggaagtgtcacacatcacttcccccacactttataagccaaagcaagaagtgcccatatccgacattgaagcatccgggatgcctatgttctccacaaggaagggcccttcaagtcacaatgccaagcctgacacctaagaaataaccagtgagataggatcagtactctttcaacttgaagggcagcaaatattttgatcactaataccatgtatcgcaatatttttttgttaagttggcgagattgagaaatcctagaaaatgacacctatgcaatagatgtttatctccattcaaccataattggtttttctcttactttcaagtatgcaagaaggtgacgctttttcttgtctcttaaatatagccagccaggtgcagtgggtcatgcctgtaatcccagtactttgggaggtcaaggcaggtggatcacctgaagtcaggagtttgagaccagcctggccaacatggcaaaaccctgtctctactaaaaaatacaaaacaaaattagcctggcatggtggcagatgcctgtaatcccagctactagggaggttgaggcatgagaatcgcttgaacccgggaggcggaagttgcattgaaccgagatctcaccactgcactccagcctagaggatacaccgagactctatctccaaaaaaaaaaaaaaaaaaaaaaaattagatatagccatgtgactaatcctggccaatgaaaatgtgagtagaagtgatgtgtgtgtttcattcctgcacagaagcattgagaagttgaagcatgattctccatatcttccctgtcatagtgataatagaagtatatgctgatgtagaagtaccgaaagggtaaagtagctagaatgtcatcatatagaagacagtggctctggatgtcatccagataaagagtctgtggttttaagtcactgagacttaagggtttttttggttttacttctttattactgtaatataacctagcctagctttaatcaggataggctaggttatgctgtagtaataatacatatttaaaatattttaacataaaacatatgtgtgtgtgtatatatatatattcatttatccataatgtgatgtaggacaaggtccttctcttaagtatgggtctactgatttggagtaccatgatatctttcttgcataaactacatcaataatgcatcatatacagttttcagtttggatttctctaatgtggttcaataacttaataagacttgtagaaaaatgcaaatacaaaatcttaaaattttctccttatgctttacaattgttatgcccaaaccaacagcatttttttgcaacctgtctttattgaacctttctaaagcagacaacagcttccatgaaaacaaaaattcattcttatcacattattatgtgttggcttcagtagtatttgttcaagttacttggtttataataacagtacaactgtcataaaaatgtttaggagcaagcacaactagaaattggtaaacaaacaactcatctggtaaaagtggagtacatggttatgtaagcgagtagctcacaagttgagtgcattttttctgccataagcaatagtctgtaggtttcacagatgacattgagagcttgtgtaaaccccaagagttatttagatagaagcaaacgaagagaacatatggagaacaatgtacacacgtatgtatattcacatatttatgtatctttgtgtatttatcttgtgtccagccatgttaattaaacagatatgttctttttaaaagcatatcttagagcttctaagtatgttggcatattatcagcaaaaagataatttaatctcttctttcccaaatttatattattttctttccttatcttactgtacctgctaaaacctccaaaataatgttgaataaataatggtgatagtgaatgtcccagtttttttcctgatttcagtgtaagtatatttagtgtttcactctttgggacgatatatgttattagttttttggtaaggtctttaatattttaggtggtaactttctgtggcagagactggctagatgctcacccatacattttccttttctcctgagaacagagatcaactacattttccagtcttgcttatggttatgtagacccaacctaactgaattttgatcagaagaatgtgggtggaaaaaagagattatgtttccagtactaaccctgagcctcccacactctccacactgccttcctttctctaccagtcagatgcagaggacttgggacatctttctagaagatggaagaactactgatggaaagagcccaggtctttgaatgactgtgggtaggagagctccattgttgtcccacactggattatgacatgaggaaaaataacttactgtgtcaagccaataaagtttggggctctttgtaggacaagttagcttctgctgactaaaacatctagtcagatgttacagagagtttttaattgggatgactgctcaactttttcaaatgccttttaatcatctatttatataatcactatttttcccccgctaatttgctggcatgatgaattatgttgacaggtttcttaatattgaaatcatacctgtattcctagactaaccccacttgtttatatttttttattttgaaatattgtttcttaaaattgtatccagaatttttgcagttatagtcttaagtgaggtcattctatattttcctttgttatactatttttaatcagatattcagattaatattttgctgactttatacaattaaatgtggagctttctgtctttttctatggtctagaatgatttgattttaaaaacattgaaccaggtgtagtggcttagtctgtaatcccagctatttgggaagctgaggcagaaggatcaattgagtccaaaagttaaagaccagactgggcaacacagcacaaccccatctctaaaaaatatttttgttggatttatttctagatattttacattttgtgttattgtatccccttaaaat

SEQ ID NO: 551 - DNA, 565 bp, Homo sapiens
aactcggtggtggccactgcgcagaccagacttcgctcgtactcgcgcgcctcgctccgcttttcctccgcaaccatgtctgacaaacccgatatggctgagatcgagaaattcgataagccgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaactactgacaacgaaggccgcgcctgcctttcccatctgtctgtctggctggcagggaaggaaagaacttgcatgttggtgaaggaagaagtggggtggaagaagtggggtgggacaacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagttt

SEQ ID NO: 552 - DNA, 2264 bp, Homo sapiens
atttgcctatttttgctcttacctaatttttaggaggaatgatagacaaacattaagcattggtttctctctagatcccgtcagtttcctcaaacacagtagtctcctctgttagaccctggtgtgctgctgggaattactgggactcactggccagctgctgtctcttctctgcggacctctttgcttttagggagcaggaaactaattcctctaagtgttatacacttggagaccctttagcatgaacaacggtgaagaaacagaagctctcgttgctttcctgcatcagacaaaaggctgtggccacttaaataccacatttttacttcctttttagttcagttgagggagcaggtgcaaccctgcagcaagataaagctgacctttccagaaattatggagtggagcacaaatataatcatgtccttgcctagcacgtagctatctctcaaccttcctttaattggggcttctttatccaacaatcttaacactccatgaaagagtctctgaatagccatatatcaaagcttataattttgcatatagaattgtatatagaaaagtacctagcacaaaagttttaaactcttattttacacaacttgcttattaggctctatgtccaaggcaaatcagaagtagaattaaagaggagtggtaagaaaggcaggcttgctgagcctggatggcatatgagtgtgagtgggtgtgtgattgagtgtgtgtgtgtgtgagagagtgtgtgtgtgggtgagtgcgtatgcgactgtgtgtgtgtatgcgagtgtgtgtgtatgcgagtgtgtgtgagtgtgtgagtgtgtgtgtgtgagtgtgtatgcgtgtgtgtgtctgtgagcgctcatgcgtgcacatcttcagtcatgtgcccactcctgtaccaaacatttatggtcctatgtgggagatagcctgcctctggggaaagaagccaagtctttcttcatagtcattatgctctatgcatgtgactctgccattcctatgactactactgagccagggggtctgtgcctgggccaaagggcagccatgtccatgagaaaggcccatgcagaggctctacaagagactgcccaatagcagggcaccatattagatggtatcaaatggatccagtttcctcctctctctcagtgagaataaatgtgagatacacagagcagttatcatggcactattaactcccatcaagcttggtcctggcttcagaaacctcaacacagtgctttgggtggctactacctgaaaatgcaacttatttgcaacctctgatctagaaggaatataaactcagaaaaagatagtctagaagtacacactcatcctcagagtttgtcaatatctgccacaactagagaaaataacccatgagatatttggttcattgacactactaatggtttcagtcttgagacacttatcaagatattaaagttaaagggaccaaagtcatcttgttctatgccctcattttatagatcaggaaactgcatcagacttatgtacattatcaaagcttagaacgtaggcttcctggtcttcctgctccgatgttcgtccatgctgaccctcttctgctctacttatcatatgctaggctcaacgaatctttatcatcttgattatatcatctgtgttcctacatatagacgtatggagtactgtatgaaatgttactacatgaaaatgattcactagtaaactaggacctttatcaatatgtagataaatggtacgaggctgatatgggagcatccatcactgactaccaggttgctactcccagctcctgtcttcacatctgcataccaaccagtaagaagaggagaaggagcaaggagagcacataactttccttttaaggacacaactaggcaagatgccatgttgtgagctgctctgtggagggggacctgtggcgaggaactgagggcagccagcaggcaacagccagctgccatgttgtgagtagccctatggaggggcccacatggcaaggaactgacatctttggtcaacagtcagtgaggacttaaggctgccaatagccacatgagggagcttggaagcagatcttcccccagtggagccttgagatgactgcagtctggctgacaccttgattgttgccttctgggagaccttgaggtgggggacccagctaagctgcccagcttcctgaccggcagaaactgggagacaataaatgttggtgttttaagccactacatttt

SEQ ID NO: 553 - DNA, 2787 bp, Homo sapiens
ctttttgaggcagctaccagaagggagcaccaagcagatgcagctccccttccctcccattccaccatccactgtccccagcaagaacctgcgggagggtggcccaatggggagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccacctctgatggccaacaggtgctgctgtgtgcccagatcaagaatccacctctgcggaattcaaaaccgctgagggttctgggacagcagggaggagagaggtggagacgcaacatgggttttctgtgttcagactgcagagaccttggaaaggatcaaccatatacaatgtccatttcctgccctctaacctggcaggggagcaaggcccagccaaggagttacagaaactgaggcttggccaggcgtggtggctcacacctgcaatctcagcactgggaggccaaggtgggcagatcgcttgagcccaggagtttgagaccagcccgaggaacatggcgaaaccccatctctacaaaaaatacagaaattagccaagtgtggtggcacgtgtctgtagtttcagctactcaggaggcttaggtgggaggatcacctgagcctgggaggtagaggttgcaatgagcagagattgctctccagccagggagacagagtgagaccctgtcccaaaataaataaataaataagaataaaatttaaaaaagaaactgaggctcaaagagaacaagtgactagttcaaggactcattttcactaagctgggaccagatcccagggttctaaccgcttaccagatccttttccattaccctcttgtttaaccacatcttgagtacctgctgtgggccaggagctgagatactttggagagtctttcaggaatattgtcccagctcctgaaacctttagggatccccaagttctagactctggccaaagccggctgccttcacccccaccaagggagacccccacaaaccaagggagccctgctctcaggtgcacagggcctcttctctctgggaggtgacagttttttgagggtggggccagacacctcccaggctatccctcacaggagaggatggtctggactggaggagtagaagcaagtaggcactggggaaggggaggagagcgtcctgagtcccaagggtcagagataggagcaagaaggaaactgacgtgttgcagggcgtgtggttaaggaagtgagagaggggctcagggtcgattctgcctgcttttccttcctccagcttgctcagcactcttcccagaatgtgggccccaaactgccaggtgacaaacaatgcccccaccccaagagagtcatccagcatgtttgaagctccatctggtcctgtacaccagttgcacaccaccaaacgcagacccatgaccactccacaacctcgcacacagacagggcaaatcccaccacagatccgtgcatcccaggcatgcaggcaatgcgatactgacacatgcccgccccgcccacgcctgggcctctgaaccctgctccagtctcctcagtcaagggcggcggccccctcaggcctcttccacccttttgccccattcagatgcctggttcccagcattgcttgggtagagactcccgcctgacaagccccagcaggccaagttgatgagccggccaagcaagcctgtgtctccgcagcgccctccatgtacacataacccccatcaccgggaacctgggcaccccgcactggcactatgtctggcccacgggtaggggatggttcccagggtctccccagacccagtgctcttcccctgtagggccactcttgcccagggttaggatggactgtgctccctctccctcaaactaggccagagccacggaagcctgggaagggagatgaggaagcacttgtcactccagacatcccaccaccatcagggaggtgggctgagataatgccaaatgcacaaaatcctcaaaatctgtctgggcatgatgattcatgcctataatcccagcactctgggaggccaaggcaggaggatcgcttgagcccagaagttcaagaccagcctgggcaacacagcgaaaccccgtctctacaaaaaatataaaaattagccaggtgtggtagtgcatgcctgtggtctcaactactcaggaggctgaggtggggaggatcacctgaacccagggaggtcaaggctgcagtgtgagacccggtctcaaaaaaaaaaaaaaaaaggctgggcaacttggcaagaccccatctctacaaaaaatttaaaaattaatcggggatggtggcgtgcacctctggtcccagctattcaggaggctaaggtgggaagatcacttgagcccaggaagtcaagggtgcagtgagctgtgttcgcgccactgcactccagcctgggtgacggaccaagaccctgtctcaaaaaaaaaaaaaaaaaaaaaactccccaagttctttcagtggcagcacagctcaggggctgacacacgggatctggagtcctctggaggctgagtcagagccctatctctaccactttctagatatgagactttgggtgagttacttaacctctttaagccttggttcctcatcaataaaatggtaatga

SEQ ID NO: 554 - DNA, 1813 bp, Homo sapiens
agagcctggttttgggtaggagtgaggcggcagcttgtcgtttcccggcccgcacccgcccttgcgctgacaccgcgggccttcctttgctctgggaacgagcgtggggagccctgttcaccctcacaccccggctccagagcggcgcggagcactccatgtttgctaaatgaaaatgaagtctcggcgcgagcgccacccaaacggcggcgtagttgcttgagaaccgcggaggcaaccgcttgggagggcgccccgaccccgaagctgcttctccaggcgcccgaggcggagagaaggcactggggtctccgtctccaccagtgatttctggtgaaacaggaaacaaaacccgggaaacaaatgggacgaaatgttggcggttttgatgctggatgatgggaatatgggcgtgtgttttgtacctttctgttatcttcagttttctcaaaacacgaaaaacagactaagaacagcgcatagaaaacattggggcacaactaaagctcataaatgcacacgttttcataacctgaccgaggtccatgctgctgtagcgcatacccccaagaacagagggccgcgtgttcttatggccccggtgccggcccccaagcggggttcccgcaggagatagggcctggctcccgcttcagcaccgcgtggcctggagtgcagttctggcggccaagatctgagggctgtagcccgtgccctcaccaggatcccagacttagagtccctgccctccccgggatcccagggctcgatcctgtgccctccccgggatcccagggctggagcccatgccctccccaggatcccagggcgcgagctggtggcttctcaagcggagttttgcctgcttgttacattagtgaatgtaggaccacttgagtaaaggaccaaacctttattcttttgcttttctgccattgaaaccattcaacccatgctgattaatacctactgtttgccaggtaatatgccccttgcagaaagacgcaaacagctaaaccccaaatgggatgttgtacaggacaaatgaccgtgtcaattaataccaataattaagataatagtataattatgatgataatataattaattcgagcctggaggaaacaaaagaaagtggaactgaactattagagaataaatgagcttaaaagacgtcattgaatggaatgtgtggaacttacttggatcatgatagaataaactagcttaaacggggcatttgagagataggtgggggaaattggaatataaagctgggtattagatgaaaactgggagtatcgatacttttggtagggagcagtaacggctggtgggtaaaatgtcctaacctttagagatgcaaacggaagtatttacagcaaattgcccctatgtctggtattcgctttgtaaattctccatgaaaaaaaattcaaggacaggtgaaacacaagtggcaaatgttagtaacggttgaagctgggtgatgaatgccataggagttatgacgattttcttttgcatatgtttgtagttttctgcgataaaatttattttattttatatatatattttgagacagagtctcattctgttgcccaggctggagtgcagtggcgcgatctcagctcactgcaaactctgcctcccggttcaagcgattctcatgcctcagcctccctagtagctggtattagaggtgtgtgccaccatgcttggctaatttttcgtctttttagtagagacggggtttcaccatgttacccaggctggtctcgaactgctgagttcaagcagtccggcctcctca

SEQ ID NO: 555 - DNA, 5393 bp, Homo sapiens
gctgttcatatgacatactttatttccaatctacaaccattaaaaacgctttataagtttacactgtacagttattctcatgtctgaaataagacacaggggcagggagagctggtggattggactgcagttgtcctagcacccgatccatcctaggaaggagccttttgaagacagaagtggaaaggagagaatagtggacaagagaggtggacagttggcccaaggatgcccttggtcccttccctcccatgggccttgccctgggggtcccccagggcccatgactgcaggaccctcaccaggaaaccaggctgagtgggaagggggttcacagtattggcgggggctggggaggggccaggatgaggaggaagggcagcttctggctctcttcccagctgctgggggttggagctgttttttggcactgtctacaaggtatccctggggttgggaggaggaggaactggggatttaggatgctttctttgtggagttaagatttctttcagtttgaagaggcgctatctggcctatggtgaggttcccaagggagaaacagtcagggtcttctgcctcctgcctccccaggactcccaccccctccctggctggcaccatccacacagccttttgtaaaaccaagacaagtgagagaggtgagcaggagcagggaaacaaacaatgtgtgctttctccaggcccttcaacttctcttcctcttccaagaggagcgactatagggttggtttttgttggtggtggttcccaatctcaggagtccagataaggctggtgttttccacctgttcttggcctagccagtcccagtccctccccaggctctactaatggctagcccagatcagcagttggcatattcttatgcgtcagaatcatttggagggctccttaaaaccccagcttgtagggccccactccacaagctctaattcagtgggtcttgggtggggctgctaatctgcacttctatcaagttcccaggtgatattcctgctgctggaatgcaatacaagaaccactggctgagaatggtgcccgcagtcacctcattctgagcagcctggtgtctcctgggcagcactaaggagctgggccacagctggcaaagcccagccttggggcaccacatcacctgggaagctgctggaaatggtcttggggtgagtcccccgtgcagagaagtaaactaaggcacagagatcagtggcagagctgagagaggagccaggataccagggcccagtagagaaaggatggggctgcaggaccctacagcatgaggggtgctctagggaccacagggccatcctggtgctcatcacaggatcacaagactgggaaggtaggagaagtgaagacatctgcccagacctgggccaggtttccagattgccagctgaggtccctcttcttgggaatggtttgagtggcttccaaataaagagtgacaaggcagccagccctgactgcctcagcccttcaaagatgtttagagaaaaccaaaggtcccttcctcagggcatggtgtccagaaagctggtgaagggcaggaagggaggggagcagggccgttgggatagacaagcagcagaggaggctccaaggagggtgaggaaggagtggcagggctggcattggagagaagccctgagcaggagacttgggcccagcatcatgtcctcagtcccctcaggacttgggtctgtatattttgcaaactgcaaatgctgttgggttgggaggggtaaggcatagagttggggtgaactgtagattctgccaggacaagcagctctgagagtggtgaggtccagaggagaatggagaggatggttggatactgaatggacaaagagatggatcaatgaccagagacagggagagaagaacctgtcaggcagcacctgctttacagtcaaggccatctgggcctgggcagggcaggggaggaaaaaggagggatccaagccccccccacccaccaccacacacacgcccattgcaaagtgctggggctgctgctggcaggctgcttacagagaagacagtgtggcttaagggtggcaccggggggttgctggggcagggtgagcccagtgagaagggctggcagggctggtgcctcctgatgcattggaggaagaggcttttttttgtgtgtgtgagaaaacacaaaataaataaacacagaaccaggacaccaccacatttgagagcaaatatcagagttgggaaaccacagacgcggacaggaaggcttccctggtaggaagcagggggacaagaagccagttactgaggttacgggaaaatccgcacgaggcagcagtgctgggaagaacatcctgggaggactgagggctgaatactatagtgagctccggacccagaagaggaaaacctggcatggaccagggccactccatttgctggcaggaaccagccaaggagaagaggaggcaggaggacaagaggctttggagggagatgataaagaaagaatggccccacgtccagaggcttctgcaggaacagtgatgagtggccttgcacagtggcatgcaggaagtagaaactggggctttactgaaaaccaaggtctggctgagacaacaaagatggcaaggacaatcctggacggtacgatggtaaggctgagtggtccgtaggtcttggggctcaggtcccacggggatttctccccgaggctgagtacgcagcctccctggctgtcgctctgggaggtggcagaaggcctctggtggcttgtggcctgatgtgaatcccctcacctggagataaccttggagggcccccctgacctcatgggtgagagcagcagcatccaagagcggaactggcccacagctccactggctgcctgctctgcccacaccagtcactggggcatggaggaggcggctggcgggactggcatgaccctggtgttcagcctgcagggaagggagatgcaggacttggggtaactggtccaggtgatcccgaatgggtgggtctgggaactggcaggtgggaggtgggagtgcaggggcgcctccagagtcctgggggcagatcagcaaagctactggcttttggtcttcctgatgggcaattctgcagacaagctgatccatcctggtgtttccactctgggtccccagtcagttacaggaaggctgatgtctatgtgtgtgtggggagcatgtgtgcaaccaaaaggggttcaccggcaccaaggcgaggccatgggaggcgctgccccacatgctgcaatgagccacatcgaaatccaaccaatggctcaggcagctcacaggggacgtgaggaagggcgggcagcagagctggggcagggagaagagccgtgaaaggccataaggctaaggagagaggctggtgaaaaggctggcaggctggtgagaaccgaggcaggctgggagacactcaggtttatgtgcaaagctgcgataaacaacattctcaaagttcagtcctgttttcctgtgagttctcatttgggaaacttggagggatctccacactcttaatagagctttagtaatccacgttcgactcatgaagaaaggtgtcagagggagggagggaaatgagacaggcaatggagaacgtctggggagtggtgatggccgtccagccctccaccttgtcagtgagtatttatagactgaccgctggggctggccaagtaccaggcattgagtaataagtagtgttctgaggccacatggccagccgtgttggggtgcagggctccagctctgttgaggggccctccaaagctgaccaggaggccaggtctccaaacctggctgccaagcggcctcgtccacccaggggaccccatgcctgcccgtgctgttagaggcctcatgttgtcccagtggcaagaatgcatgtttcaacctccaataaattaccttagggactttggggtaaattaaattattaaaataaagtaaaccaccttaaatatttatagtaggaaaaattcaaataaacaatctaggcaagatacgtgtttccaggccccagtctactgctgtgtcctgggctctggcctcttggtgttctcctgggcctgacctggccaaccaagaatctcttactgggaatatctttgccccccgaccagctgcaggatgtaaacacagtggagatgtagtgcctgctgcctctcagggtgccagggaaagaggcctctgagatcacttgagatcaaggcagtgtatttaggcatttatctatgcaccaggtcttgagactgactctacctatttctgtcctcaaggggtctgctgggaacgttggggccccaagtcactttggcaaggaaggcaattgcaatcactccccaaccctgagccctgcatgtttccacttcgcctcccagctcttgctgcatccaggctatgggcagggagatccagggctccaggacactaagcaatggccctggctactgccctatcatactccctagtgtcccagcaatctagagcagtggggctgggaggaggaggtggtggagagaaggaggtgatggtgatgatgcccaacagggctccaccaggaaccaaacatggagccctagagcaaagcctgttcttctcagcagtgtctcctcccaaatgaaggggtggatggtcagcaggaaacatctctccgactccttttccccaaaggcatggccagacatgtatccttcttgggctcttccaagagggtggcatgggcagaaccaggcaaggctctctcttaggacccagggatcggctcttgacagatctctcagtggatgcttgggaagcccaggtttggtctctctcccactcactgccttcccctgggaagtcgaagctcaccacccaggggccagcaggagacccggctttaccttgatgtgaaagctgcattctggcagtggcatcactgctgtccctccagggccaggcaatgctgaggacacagcccctcgcctcacctcgtctcgtctctgctggttcccttctgctatccaggggctgggctggttgaggcggggagcttggctgctctgtcactcgctgggggggagtgccctctcctccccaccccagctggactctgaagggtgcagcctgcacttggaaggagagtggcggatggcagagcgggacgatcgggcgaagcaggaggtgagagactgggtactacagtcacaaacagcgtcctaggaagagggaggcagggaggcaggaagtcaagaggagccaggagacatggaccaccatgagctgtgtggtatgccaggcaaggaactgagactcggccataaaccagttcccaggggctgaagctcctca

SEQ ID NO: 556 - DNA, 1309 bp, Homo sapiens
ttatttatttatttatttatttatttatttatttatttattttctgagatctaatttagaccatggagaagaaaaacaaaaaggtggtattaataaactgctttggggagtaaaagaacctcttagaatccacgacatcatggatggaagagatccttaaggagggaatgaagcacagctcagagtgggaaggttagcaatgttcaagaccaaagttaatcatctctacatgagtcaattgaaagaaaagaattaaaagcattaaaaaaaaaacaatatgagtaatgggaggagctgatgaagcctgctgcccagatgaggattggaaactatttaaactggataatacagtatgtgttttagctctgagaaaacagaagttgaacttttgagtagtaatcaagggcacggtctcaaagtatttgcaaatagtgctggtatggagaacagatgccgacattattgccaatgggaatcacaatgtgatagttggagtgagagactaaaagaaaccacagggaatttttgcagaaagcttggcattgaacatgatttatggttgatttaagaaggagacaaggaaaataaggctacagtgtataccatctgactgctgcggaccaaggatgtaaacagttagccatggctctccaacctcctggaaatcaggattctgctcatacagaaaggcgccagaatgtttgtctgagttaagtgcatacttcttttttagtatctaagaatagttatcctcctttcctctcccattactgcttgggtatccttaaaaatcctcaccagctattaagtatcatggagttacgcaaagaggtctgcagggaacttgatggcttcccaaagtggatcagagaacctcacaggaggccctaggcttgaaaggatgattgcagaaaggatgacctacaagtggatggtcagatctggctgcaaatggatgtctgaaagaaaacggggatcctaggaaacccatcacagccctctatgagcttcagaaaccagcaaggttaattatgtcattgcctctaagtgaatgcaggtgacattgttttgataatttgatgaacatgcctcctccaggaacagtgtgatccaagatgccaggtccatttcagggcctgaatcagatgtccggaatctcaaaaagactgggaattagaactgggttctcaaggggaaggacttcttaagggaaatttttttcttggctaaagagacactcaggaggaaatgtcttttcttttgctgccattgaatgactagatcatctatctatctctctctctgtcta

SEQ ID NO: 557 - DNA, 1405 bp, Homo sapiens
gggtactactagccttgtaaaatgatttgggattgttccttagttaaatcagtcaaccacagatactgaatacctcattagcaccacagttacgaaaatgaagaaaccccgatacggttcatttatctatcctgtcacaataaccaaatttcctcaaagttaacatcactgctgctttcactgacacctcacgtaggagtcaggaaacccgcaagcagatctctgagtccccaaggcaggcaaagtgaaggcgtgatccctggagctgatctcgtgtcactccatttccccatgactcatacttttaagtcacattggcttgtttgtgactctgctacagtaacctgcctgcgtattccctttgaaataaggaaaattatgtgcttaaaatgggcctcttctattttcacacagaagtcttttcccctgcctctcttcattccttatttcttaacttatcacaaagctcctctcgccttagaacctgcaatattaatatcctcctgtaaggaaataaactgaacccacccacaaggtgaaagtgctttgtgaaactgtcaaaattctgttcatgtcattggcccaagtgtaggtgagagaatatgaccatagagggcctggacacacagggacctgaggcagagcagggcttcggagccacgtggaggatggagaatgaagacaccaagtttccaatagagaattaccagcggtcacctgcactcatgtttacacagcaatgtgcggaaatgcagaagaaaagatctcctcaactacaaatttgacttcactaatttcccttaccaatatatagccagctacacattgttgttaaattaaaacactttaaaaagtcaaatggtcgggcgcagtgccaaggggcttcactttgggaggccgaggcaggcggaggtcaggagattgagaccatcctggctaacacggtgaaaccccgactctactaaaaatataaaatattagccgggtgtggtggcaggtgcctgtagtcccagctactcgtgaggctgaggcaggagaatggcgtgaacccgggaggcggagattgcagtgagctgagattgtgccagtgcactccagcctgggcaacagagcaagactccgtctcaaaacaaacaaacaaacaaacaaaaagtcaaatcgacttttgttagattttcttccaatctacctgttctgattctcttttattaagcagactcttagctatttgatatgttctgcatggaagacacaacctgaatatttctgtatgtttctcttcaacttctgattttgcaatattctttccttagggacttcttgaagagagctcacagggaaaattactacccccaggactccatcagattttcatgtcagttaggaactttggcagtagttttaa

SEQ ID NO: 558 - DNA, 1052 bp, Homo sapiens
ggcgcacatggaggttcaggacaagatggaagagaatgcttatcacaaagctggtgacagagcaggggctggggaggggccgctgcacaggtccatgatgaagtctttttgatgttgaaccattggcattcagcagtgatgaagaagacggtgtctcaagaagctctggatcttgacccgccatctgccagcgtccctgccctactttcttactcagaaatggaaacataagccctatagtgagccataatatgggatcaatgccacctcttccatgtgggtggcattgaccgtccctcatattatggttccttataggactctgttctttataggacatcctgcagtgatttaaaggtggctcatgcctgtaattccagcactttgggaggccgagacgggcagatcatgaggtcaggagatcaagaccatcctggctaacacggtgaaacctcgtctctactaaaaacacaaaaaattagccgggtgtggtggcgtgcgcctgtaatcccagctactcgggaggctgaggcaggagaattgcttgaacctgggaggtttcaacccgccactgcattccaacctaggcaacagagtaagactctatctcaaaaaaaaaaaaagcatctatttcttcattatctcattatcctcatcacatgaataagtaatatccattcccacaggaggtggatggcatctttcctgagaagtgggcactagaaaatagatcagccatgcagtggactcttaggatgggatcatccccagcagggcattggaggcattggaggcattgatttcaacaaggtaaggccaagttggattgacgcataccaggaaaaggacatgatttctgtttatgttttgagcatcttctcttttgaatggttttcctgctaaaaataacacatgctcattgcagaaaatctagaaggttcagaagggtgtgaagagacaccccatccagaaataaacactgttaatatttttcctattcaattattatttgaagtcatattgaagatatgatttattttggttttctttgc

SEQ ID NO: 559 - DNA, 1415 bp, Homo sapiens
atgaggcccaagaagtcagctttggtatttctgctcctgcaactcttctgtgatggctgtggattctgggagaaggtcctggtgtggccctgtgacatgagccattggcttaatgtcaaggtcattctagaggagatcatagtgaggagccatgaggtaacagtattgactcactcaaagtctttgttaattgattacaggaagccttctgcactgaaatttgaggtggtccatatgccataggataaaacagaagaaaatgaaatatttgttgacctagctctgaatgtcttcccaggcttaccagcgtggcaatcagtcataaaattaaatgttttttgttgaaatgaggaacttcaaaaatgatgtgtgagagcattatctacaatcagacacttatgaagaagctacaggaaaccaactacgatgtagcactcatagaccctgtgattccccgtggagacctgatggctgagttgcttgcagtcccttttgtgctcacacttagaacttctctaagaggcaatatggaacaaagctgtgggaaacttccagctccactttcctatgtacctgtgcctatgacaggactaacagacagaatgacctttcaggaaagattgaaaaatccaatgctttcagttttcttccacttctggattcaggattatgaccatcatttttgggaagagttttagagtaaggcattggaaatggaaaatgttgtccagagttcaggggaagatgatattgggttgttttctctggggtcactgtttccaaatgttatagaagaaaaggctaatatcattgcttcagcccttgcccagatcccacagaagaaaaaaccatccacattaggaaccaatactcggctgtatgatgggataccccagaatgatcttcttgtactaggtgacctcaaaccaaagcttttatcgctcatggaggaatgaatgtgatctatgaagctatttaccatgaggtccctatggtgggagttcccctatttggtgatcagcttgatgccatagctcacatgaaggccaaaggagcagctgtagaaataaacttcaaaactatgacaagcaaagatttactcagggttttgagaacagtcattaacgattccttccagttataaagaggatgctatgagattatcaagaattcaccatgatcagcctgtgaagcccctggatcaggcagacttctggatcgagtttgtcatgtgccacaaaggagccaagcacctgtggtcagctgcccatgacctcacctggttccagcactactctatagatgtgattgggttcctgctggcctgtgtgtcaactgctatattcttggccacaagatgttgtttattttcctgtcaaaaatttaataaaactagaaagatagaaaagagggaa

SEQ ID NO: 560 - DNA, 7054 bp, Homo sapiens
agtcctgcagggcggggcaaacttggagaggcgctgcgtcgggggacggggctacaagccgtcgctgggggcggggcttgcggcccacctgtaggtcccggtgccacctcgtcagtgtcccgagagatccccagaagaacgagagggctgaacaggggaccccactgacgtccggtgggccgactttacgatcctttaggatgaagaaactaagactcagagaagacaaatgacatgcccaaagacacattgataagaacgcatctggtagtggtgttcgagtccagcgttgcagcagagagatgggtaactgtatggccgaacagctgtcttctcgtggaagaaggaggccaatgtccaggagtggcaggcatactggaacttggacttctgtaggccaacctgggttccacttggtagatgggggtcttgctgtgttgcccaggctggtctcaaactcctggcctgaagcagtcctcctcccttagcctccagagtagctgggactacaggtacacaccactgcaacccctcagtggttgttatttaactgaagggggttttagctttcatgtatcagctcactctggagccagacagcctggccttcatggcagctctgccccttactacctgtgtgacatcgggcaacgttactgagtgtcagatttcttatttgtaaaacagggataaaaatgacattgctgtgcaaattaaaagaaagaatccatgtgagatatttagcacactggcatacaatgagagcttaataaacattgttagttttgtaaactgagggaaaaaaatagccacaggcctgggaacataaatgcttggtaagcttctcagttccctggaagtctgacacgcaatgtgtatgtatgaacaaggcaggaggaagcatgacaccaagccttccttttaacaaacactgtttaaatcagaggtcggaagtcatggactggagattcattctctccccactcatttctgcccagagacacctggtgatctggcatacacagtgctatgaacctcagaattatttgctagcatttacaaattgtgagtactcccacatacaaactgtggtagatggaataatgcctccccacaaaaatgtccacagcctaatccctggaacctgggaatatgttactttacacagcaaaggaatgttgcagctgtgattggagattgagatagggagagtgtattagtctgttgtcatgcggctatgaagaaatacctgagactgggtaatttacaaagaaaagaggtttaattcacttacagctcagcacggctggttgggggggcgccctcaggaaatttacaatcatggtaggaggcacctcttcacagggtggcaggagagaaaataagagcagagcgaagggggaaccccttataaaactgtcagatctcatgagaactcactgtcatgagaacagcatgggggaaaccgcccccatgatccatcacctccacctggtcccccccttgttacaattcaaggggattgtaacaattcaaggtgagatctgggtggggacacagagccaaaccatatcagagagtcttcctgcagtgtccgggtgggtgcggcatgttcatagggtcttagaagagggaagcaagaggtgagaggacagaaatgccacattgctggctttgagggtggggccagaggagggacctgcaggcagagatagagctggaaatggaaaggaaaccttctcccttagagtctccagaagaagtgcagccctacagacctgtgttaggcttcagacctccagaattgtaaaataataaaattgcattattttaagccactcgaggcccatgtcctcaacaaagagaaagacggtggggtgctgtcagccagggtaggtacctgcttggtggtctgggtcctttcccactgtgtccattcagttacattacctgcccatctgctgaggcctcgagtttgggacctcaggtttatataattccttgcacaagcatgatcgattgattccggagagtagcagaacactgatatgcaggggaatctcctagttccaagtgtgagttgtagtctagacacttcctgttccctacagtcttttttttttttttttttttttttgagacaaagttttgctctgttgcccaggctggagtgcagtggtgtgatctcggctcactgcaacctctgcctcctgggttcaagcaattctgcctcagcctcccgaatagctgggatcacaggcacatgccaccatgcccagctaatttttgtatttttagtagagttagggtttcgccatgttggccagggtgatctcaaactcttgacctcacatgatccgcccgccacagcctcccaaagtgctgggattacaggcgcaaaccaccgcccccagccctcttccctactgccttgatgtgttcatctgggcaatgtgtgttgagggggcatagggaggggagctctaaggcaaatgtgctgggattctgcattcgtcatcctcaaaacaaaattggtccctaggtagttctgcctgtgatcctgcataatgtgcaaagccagtaagatgcctttgcctcatccccagggaacatgcctcccagccactttcatctcacctagtgcctacacagaaaggcaaccgcctccctgctgaagggaccccacgcctgtctcctgtttccacacaattaccccgggaaatgcctggcttcccatttccagttgcagccatcttgacagtttcagcctctccccacagcccacgtccctcacttgagcagcgagatgtgaagacagacagccgcttgagaactgcacagactgtccttaatctaagccatttaaaaggcatttgtgttccataaaacccgtttctgtaattctgtgcccctacttctttgaaagatgataaccctagggaggagattagccagggaggagaagttcagatgtgctaatattttaatcgctcattctttcatcacattagtcacattcattaagtatgattaatttcaggctttgttgaaaaccctatcagtttccctatcagccacacatccatctcttgccaagcaggctggtgcagtagcaccaaaagtcccccagtgttttttacacctggattgtattatgtgccccctgaaaatgtgtggaattaattgagctcatttgtttcaaatactttgcaagagcctgggctcttgagtcaggcggcctaagtgtgatcctaagtcctcccattgctggagtcacctgggcaagtgactgacgccctctgagccctggtgtcctcgtctgaggatggagataagaatacctaactcgaaagttggttgtgaagatgaaagaaggctttcaaattgctaagttagttggttatgattgtaattaagggcccttggagatggatcattcatccattcattcatccattcagaagatttgtgtacagtgactactgtatgcaaccctgtgtgtccactgctgatgagagagacagcagcaaacacagcagtcaaatgcgtgtggcccccaggaccttatattttagtggtggaagctagacaaccaccaaacatgtaatataccagatggtggtacgttctatggaggaaagaaaggacgaggggcagggagtcctgggctggtgggacagggtgctatggctcagagggaactcagagatcacctaattcaggccctgacctggagggctcatgctttgcacactgtgctaagaatttggactttctttctccaagaataaggacaatgagagccagcaagcagggaagtggagcaaggatggtgccgtccggctgctcagctgctggctggaactcccggaggactctgtgaggatgcaggtagaaggtgtgtaagcatgtgactgcatggaagccctcggcatgtgatccactccgtgttccaaattgccatcctttctgcgtgctgttagggacttcccccagctctccctgcagagtgaggagtactctgagacagacgggtctaggatgaactgtgttgatggagaaatgaacattttttggagggaaggaagatttcggggtgtggggcataagttgaaggagtatggctctgaaagtccttgggcagtttgtagaggacagagaaggtggtaatgtcagtttctgcccctctcccacctccacctctggccttctcagtggtcctatggctccctaccttcagtcatcttgttctcaagcctgaagtgctggatccactcagctgcaacccagctcaacacctctgtggaagctttgcccatcaatcaggagaagctgagatccagagactgatgcccacgttctgtctttgcagagggaagcccaccagagccctcttctctctggggaggagctggctccctgaatctccaagacaaacccagacagccctggggaccttgaatgtgagcaaggggagcagaaaggaggctccagcccacccagggcccctgcagggtctgcacacacaattacaggtcctcatttccctctcctaatgatgccccaaaacattaagggaagttaaatcaaaccaccaggtgtccagcatgaacagctgaaataataaattcacgagatttgaatccaaataactgatgatttgttccatgaatgccagagctggaagggatggggttggcagaagagacaagactggaccatggacctggtggttctgtgcagaggccaaagctactctccttcccacctggccctgtgctgggcctaacctggagccccctctatcctctgcctcattcttctccgggtcaaggtccagcatgaactccatgtcctccaggaagccctggtggacttgggcagacctggggacacgtccagcctcctggcaagatgggggtaacaggagtgtgtataaaggggaaggcaagaatgtgcccttggtggagcagtgaaaagaagccctcatgtgacaagtgttttgctcctaacccacctcctctggtgacatcttctgggttaactgctcttgctgatctctgcacataaaccaagctaactgtgagaggcctttcatttctagtttaaagcaaggagaccacagttccttctgaacactcacccccaaggagataaggagggcgtcccatgagcaacactgtgtgttaaagatgtacacgagcactgggacctgaccaaggacaaacacgtctccagccccctcagacccttgctgctgctcagatgtccgctgtcatcggtcacatcctaacctcaaccccctctctcctcccacataaaaggaggctgaaattcatagtaacttcagatggttctttaggacactggcccaccaccttctcggttgctggctctccaaaacaaagccccctcccttgacccaattccttgtttcttgacgtactggctgttgtgcagtgcatggtaccggcttgaactcggttatgttggcatggcctctggcggtgctcagtttgtgtggatgagtattttacagctactgtcctatttccagtccccttcctctggacggctatgggatgtgctgtggatgccctctcttaggctggaataaaccaccctaccttctcctctgccttgtctccaccaaataaactccttaaggcagggatagagtcttgcactccacgaagaagtattgctgcatcctcagctgtgtaagagtgaccgggcttcttctattccacctgtaatggaactttaggcacgcagagagagatggcaaatttgtgctggctgaaggggtcagcaaatgcatataaggcttcttgtgctccagagagagaatggagtgcagtcagtgagaccctgaggggagaaggaaccaaaagcctgggcagaagggatcgtggaggtgcccagggtcaggagggatgggaagggtgaggaacacaagagatcacctggaggcattagaggagaaggcaggcactggggatggtgccgctgatccaggtggagcaacatcctaggacccgagtgctgggcaggtgcatccgtggagggaagcttctctcctctctcggctcctgctgagagaggcaatcattcccctggcttgccctgcaagagacaggagctctaggtagatctctgctatctagggaatagaatgtgaatatttgaaagttctagaggtcaagtcttaggttccctctcagctcagatcccaaatggtacactctaccctaacccccttttcttgtagctttgctacatggagaggaaaataccttgccagacaccaacagtcccttctcagcacttttgtgtgaagacaactcagaccctaagagaatggggtctaatttgcaggtgccactggaaggcagaggtcacgggagccctggacttcagacaaggtagagggatcctggagacagcacatctggccctggagccctgcccacccggggagtgagggcagctctcctgctctcctaggaggcctgcccgaggacccccatgtcctctatgtgtgggattctgcagtttgcactcacaacccagagccttttacccaactaccctgtttgtaggaatgtgtccaaaataagcatcagacaagtacatgaagatgaatgtgcaaagacgttcataacaggattgtttataatcatgaaaaatgatctgcagatttcctgtctgctgtgcaggatgagttagacggggatgcatccataaaatcactttgccctcatttaaaattatatcatagatctatgtttaatgacatagtaaacggtactcaatgcattaagtgaaaaaagcatatacatatcaggatgtatatgatcaagtttttgttaaatggatgcatgtatgcatgtcagtaactgtctgtgtttgcaaacaaaacgtctagcaagacgtgcatcaaatattaacaatcattatctttggattctggatttattgacttctatttttgactttgccctttgtttttctatgttatctgacacttttacactgagtttatattattttt

SEQ ID NO: 561 - DNA, 8304 bp, Homo sapiens
caagtagctagggtcacaggcgccagccaccactccccgctaattttgtatttttagtagagacagggtttgccatgttggtcaggctggtctcgaactcctgacctcaagtgatccacccgccttcacctcccaaagtgctggaggttcaggatctctaaatgagaggtaaacaaactgaagcaggaggccagatcaaggagatgcccaccatgatgtcaggaggtgagttgggaaagggcctcaggagatagggattcttgcgtggcccccaaagggggtagtggggtagggaataagcttcctcctaccctaagcaccaataaattcaaaactttatttatgtatttatctatttatggtaaaaatataacataaaactcactatcttaaagtgtacagtagtgttaagtatatttgcatcatcatgccacagatctccagaagttttcatcttgcaaatggaaactctgtactcatcaaacaactccccattttcctctctccatatccccccactaactgccattctactttctgtttctatcagtttaactactttagatacctcgtatacgtggaatcataaagcatttatctgcattattttacttagcttaatgtcctccagtttcattcatgttatagtgtatgataggattttcttattttgaaggactgaataatattccattgtatgtatatatcacatttgctttatcattttttccatcactgaacatttaggttccatccacctcttggctattgtgaataatactgcaagcgacatagatgtgcaaatatctctgtgagatcttgttttcagttcttttggatatatatcaaggaatgggattgctggtcatatagttgctggtaattctatttttaattttttgaggaacctccattctgttttccatgggctctaccattttacattccacaaacagtgcacaagtgttttaatttctttatgtctttaccagcaagcacttgttatacagtctcccttctttcttttcatagtgggcatcctaatgggagtgaggtgatatctccttgtggttttcagttgcatttttctgatgattagtaatgcgaacatcttttcatgtgcttgttggccatttgtatatcacttttggagacatgtctgttcaagtactttgcccgttttttaattgggttatttgatttttgttgttgagttgagggaattctttatatattctagatattagtcccttctcagatgtattatatgagcatattttcttcaattccataagttgccttttcactatattgattgtatcttttggtgcacaaaagtttttaagtttgatataattccatttgtctacttttgctttttgttgcctatgcatttagtgtcataccaagaaatcattggaaatatgttttttcatttgtttaagcctgtaggaggaaatacggtttgagtgaactttaacatcttggaaaagtaagccttggtcaagcttacagacaagagactaggctggttattcatcctgtgaaacagccctacaaatttacctacaccatggaatccaagatcccactgataatgtgaacttactcctttttgtttgtcttctcccttctaatgttaatttttttaactgcaggaaaaataacaaaataacagaattcttcttttataagatagatttgggagcatgtactgatcttttgagtgaggtggagaggtcaaaataaaaatactaaaatgtgaataaaactttgagacttagatggagacctagttaaaccttttcttcaaatgccatcaatgccaaagagcagcagttgttttactaattcattcaccaaaagtgattatcaaacgtctactatgttctgggcactaactagccaaggcaatataggtgtgtataagaggcaagtctctgctgtctgtgagtctatgcagaatctcgtcttccgttagaagcatcaacaaacatgtattgcctgccctccctctgctagaagtttggggagacatgttatggactaaatgtttgtgtcccccaaaatgtacatgttgaagccttaacgcccaatgtgatggtatttggaagtgaggcttttgggaggtaattagatataaatgaggtcatgaaggtgtggtccccatgatgggattagtggccttataagaaaagagacaagagaggttcttctctttttctgccacatgaggacacagtaagaaggcagctatctacaagccaagaagagggtcctcactaggaactgaagcctgctggaccttgattttgaaatttccaggcttcagagctgggattcctgtgtttaagccaccacccagtctatggtattttgtatggcagccgaaacagactaatacaaggcataagggacagtgagatgctgttcatcctctcaagggttcgtgaacttgttaccgtggcctccgcagtccctgtgttcacttatctttgctaagggcaaatcactgatgagatggacgcattttataactggagaataaaagggatgaggccctacaggctgagggttacaaccaggtgtctgaaggagtcagtgtcccaaagagtgagaatagtggagtgtgtaagtggagaataaccaggtaggtgcttaaaagtgaacctgtgttgactgtattcacttatttcataagacaacttttggaggccagacacaccacctttaaaaagtaattgtataagtgtcctagtgctgtgcatgaagtcccataaactgggtgctttttaaacacccagttgtttttacaatagaagtttattttcccacagttctggaggctggaagtccaaaatcaaggtgtcatcaagcctatgcttcatttgaaaactagaggggagaatcctttcttgcctcttttagcttctggtgtttggtggtaatccttggtgtttcttggcttgtagatgcttcactcccatccctgcctccaaagtcatatcgtcatcctctccctgtgtgtttctccttccttttttcttttttttttttctttttttgagacaggatagcacgctgttgctcaggctggagtgcagtggcatgatcatagctcactgcaaccttgacttcctgggctcaggtgatcctcctgcctcagcctcccaagtagctgggactacaggcatgcaccaccatgcctggcaaattaaaaaaagattttttttttttggtagagacggggtcttgttatgttgcccaggctggtctcgaactgctgggctcaatcagtcctcctgccttggcctcccaaagtgctgagattactggtgtgagccaccatgccttgcctctgcttcctcttataaggacatcagtcataccaggttaaaggctcactctactccactgtgacctcatctcaaataaactaattacatctgcaacaacatgatttccaagtaaggtcacattctgtggtactgggtattaggactttgttgtagtcagggttctccagagaaacagagccaataggatggttccgtctctatagatagaaataaatttattataaggagttggctcacatgattatggaggctggaaagtcccaagatctgcatagtgaatcaacaagctggagacccagtggtttagttccaggctatgtccaaagacctgagatccaggagagctaatggtatagtttcagtctgaagtccagcaggcttgagacccagggagagctgatgtttcagttcaagtacaaagacaggaaaaaattaatgtcccagctcaaaggcagtcaaggagaaactctctcttactcaagggagaatgagctttttattctatttagaccttcaatgattggatgagggccacccacattagggagggtaatctggtttactctgtctaccaatataagtgttactctcatccaaaaacactctcacacaaacccccaggataatgtttgattaaatatctgggcaccccatgacccagttaagttgacacgtaaaattaaccatcacactttaaaatatctttttgggaagcacaattcaacccataaaagtaataatcatgcctagagaacttttttagttgaagagatagaaagtttaattcaaatctgtacctgttgctttgtactgttatttgataggggtcttaccccactcctatccatcaaggctggcagaggctattttccaggattttagggttgctggcagctgggcagtgactcaggagagttgtgagtggggacagaaaggaaggaagtatgccaaacagtgctaaaaaatatccaaagctaagaaatgtgtaattagccctgacctcctttgcccttcctccttactaaagcagagtgggtgaaatggctcatgggttattaattgccctctgctggtcactttacaggcatggcttcccatttgcttactttattttctagggatgtcagcaaattaccacaaacttgatgacttaaagcaacagtaatatattgtctcatagttctggaagttagaagtctaaaatcaaggtgtcacagggtccatgctccatctgaagttgtccagggactgaagtgtccaatccttccttgcctatccctagtttctggtggttcctggcaatcctggtgttccttggcttgcagctggctccccacaatatctgcctccattttacatggccttccctctgtttctctgtgtgccctctcttataaaaacagcagtcattggatttaaggtccaccataatccagcatgactttattttaagttaattacatttgcagaaaccctgtttccaaacatgtcacattctaaagttctggatagacatgcattttgagggagatgctattcaaccccctatactaaaactctttttctgtggaagagaaagaggcagggagagtaacttgtccagatcactgttaagtggttgagctgagctttcatgtgtactcattagccaaagtgtcttccttcttcccctctgccctcttccctctttcctttcatcgcctattttcttatccaaggatgccctggatattagtttaccttcatttgaatggagaaaaatgcccattgttaactgttaactgttggggtgaggggatgggaaggtgttcagtggaaggtctctcaatctccttgagagttagtttactttttttgcaaaaatggagaaaatgaaacttgtctcatttggtggttgcatgtattattaaatcacatacaaccgatcacaaaatcaatgtgtaagaaagtgtctgggaaaatcttccaaggcatacagccctgagggacttttgtagaaaatcatttagaaagtaaggcatccattactcacctagggtattaattaatttgtattcttgaaattctttttttttttttttgagatggagtcttgctctgttgcttaggctggagtgcagtggcgcgatcttggctcactgcaacttccgtgccctgggctcaaccaattctcctgcctcagcctcccaagtaactgggactacaggcacatgccaccacacctggctaatttttgtatttttagtagagacggtttcaccatgttgcctaggctggtctcgaactcctgacctcaactgatctggccttggcttcccaacgtgctgggattataggcatgagccaccatgcccggcctgtatttttgaatttctacattgttgacatgccttgaagtcttagacgatgagcaagaaacagaaatcatgtagcacatatattcaacattcccacgtaattttaggtttctatttggtctctttcaagcggtaagtaatttactttgatcttctctgctaggttataacaaaagttgacattgtagctctgccactcactagaaatatcatcttgtttatgttatttaactttatgacctctaattgtgaaggttaaaggaaagagcacatataaaagctcctggtacattatggttagtcaggaagtaaaagttttttttttaaattgcattgttattattattactgttattattaatatcattggtatgcaagacactgagttatacatatttgacttgtgaacatatttgttattttaaaaattgaaataatttgtcttaaaaaagttacaaaaatagtacagacaattcccatatatttcgtcacccagcttcccctactgtttaacatcttacataagcacagtatgatgatcaacactgggaaattaacattgctacaatactattaagtaaactatagatttgacttgaatttgcaggttttcccattaacggttttttctgatccaggatccaaaccttgatctccaattgaacttagttatgagaaggagacaaacttagtcttttataacttagtttttccttgtctttcatgattttgacacttctgaggaaagctggtcagtaaccttgtagaatgccctccaatttggctttgtctgtattttctctgattaaattgagataatacaattttggcaagaatacctcagaagtaatgttgtgtcctttctcatacaccatatccagaagtacacaatgctagtatatattattactggtgaaattaacattgatctctgggttaaagtggtgtcttccaggtttctccactaaattaccatttttccctcagtgactaacagatatcttggggaaatactttaaaactacgcaaatattgccaggcgtggtggcgtatgcctgtaatcctagcactgtgggaggccaaggtgggcggatcacttgaggtcaggagttcgagaccagcctggccaacatggtgaaaccttgtctctaccaaaaagtggtggtgtgcgcctataatcccagctacttgggaggctgaggcaggagaatagcttgaacccaggaggaggaggttgcagtgagccgagatcctgccattgcactctagcctgggggataagagcaaaactctgtctcaaaacaaaaacaaaaacaaaactatgcaaatatcctgtttcttgtaccttcacccactagttttagcatctatggatgattcttgcctgccacaattattactatggcatttgcctattagtgattttctgtttccttcatttcttctctattaataggaattcttctctaagagagagttattctcctccctcatttatttttttatatcaatatgggctgatgaatatttattttattttatgggttataatcgaacactgtcattatttattttgttgctccagtggttccagctctgggcattaggagcttaaacaggttggctcctgtatcctttcaacatgcctcattatttttagtgctttcttgctttttgatgcttactttttaatctaggctcatcttgtactttctttgccccaaccatggaattgatcttttctccaaagaactctgattccttttattggaaaatggacttaggaaccaagatcttggcattgagtagtctcattgctactggggtttcattgcttctgcgtcctctcagtggacagagtttggaaatatatgcaggtatgctaacacacatacatatgtttatatttgtaaattataaaattgtataattttaaatttctgtattataaaattatacatatgttataaatctatgtttatttcaacatatatctgtataactattaaggaccacaatgaatacattcaaaggtaaatgtgtgaatatctctaaggcatacttctacttatctcctaataataaagagagtaggtccattacactattgcagagtcattagtacttgtttactttcaagttttatgttgtaattcagatagctgaggttgtcagagaagagacctagccttatgtaattctggaaccagaaaaagaaatcatggaactatccaattcatgtttcctaaactggtgttccatggaatactattttaggagttgttaatagcattatcctgatcaaagggttttgcggttccataagtttgggaaacagcattgtagatcctccacacttgtgtgacactgccaatggattattttatttatatgtttatttatttttagggatggggtcttgccaggttgcccaggctggcctcaaactcctgggcccaagcagtcctcccacttcagtctcctgagttgcgagattacaggtgtgagacaccatgcccagcatgcctatggattattaaaggagtttttaaaaatttgttttccaggctgggtgcagtggctcacag

SEQ ID NO: 562 - DNA, 27380 bp, Homo sapiens
gctctccctcagacacactggagggaaaggtcaaactaaaggcgagggagcagagagaccggagggagccgctgccgccgccgcgcgccatgacggacgcggcggaggctgctttctcagtgcggacgccgccgatccccagctctcgccgcgccccctgccccccgcccctcgcgcgcccctcaccctggcgctggcgcgtccccgcgccctctcccccggccgctccaggcgcgcctcgggctcggggcgcggggcgctgggagcgggagggtgggggccgcggcgggccggcggcctcctcgcccgacccccgaccccgggccaggtgagtgccttggggcgggagagggcgtccggagcggagaggacaccgggcgctcagccccccgcctgacccccttccggggcgctgacaggctctcgggacacggcctctggggggcgtcgtggggtcacttgtgtcggggggtgcttttttggcgcccccgtccctcagggtcgggcgtccgagtcgtggggggctcggggccgggaagtgggcgctgcggtgcggccctggagtgcagccgcggcgacagggtatggggcgggcggcgggaggcaggtgggcccctccccggggctcgtgaagtggggggaccgggcgtgggggccgcgggaagctttcgggaaatgtttatccggcagttgcaagaaactctgccctcgggacgaggcgccttgctttttgccggggccagcgaaagtggcggatttcacagcaaaactcgggtgaagccaggctggaccggccgggagtgagagaggccgggagcacccgtctggatggggaccagagatgaacgaatccgcctgtgtgtagcaccagggcatgatgtgtgcacgttgctatgccagtgtttaatgtttgttgcttatggttattttaggactaaatgataaaaaagttacttgggagagagggaactgcttgatttgacatgagttcttcacttgtgcatgcaggaaatacattaatcctgtacacacacaactgaatttatgtccagtggactttacaaataatatacacaaaattctaaagccccgaagcaaggtgatgtgtgtctgaagagtttcaggtgtcaggctccgtgttccgtgggaacaaaataggaggacaccgaagtacttgatatgcccaagcagtcatctttttgtaataagctttggataccatcaaagtggagtttagttgtaactgccagggttaagtaatcgcattgacccggtgccacccaccagtttggagcttctctgaaagtaatttacgagacagtcctgtgctgattgtgaataaccagtgcttttgctgatttttttcctgtttaattttacactgtcatcatgtatgtgtatgctacctgtttaccaaacgttagaatgaattatccatagttaaactctccactaaatcactaaatcaggtactagctgtggcatgtctttaaaaatatatatatttgaatgttacctggaaattaccgatataatggtttcaagctgatagggattttttgaacttaagtctagcataaacattatcccaagtggatgtgttttaaaatttaaatctcatctaagaaaacttcctggtttgtgaaaggtgcaggattgtgatgatagctgaggaaatgccagagagaatttttggtagagaataagagaacaacctgtgaatttggtgttaaccagcagtctcggcatatactcacttgctccttacctaagcatttctgatatgtgggtgctttttctgttgattatgtatctttggttatttgtcattttcaaaaagtttcctcaacagaggaccctcactttgaaattgagtccttgtggcatgtagccgggataccaaaagttttcagtaccagatgcagagagagatcagtccgtttgggatcttgttaattctttctgtgcagctacttttgtgctgtgaggtctcttttacatcttgctcctattggccatagctgacatatgtctgtatacagtcctgtagtggggtacttaattgttacaacctgaaaagattatttcttgtaatatataaataaatttttatgtttttctctcttctctctttttcaagggaactgtagaattggacaaatcaacacttagcatgtccccctcctgtaggtcttgttgaccttggtggcatcgtggaggtcatatgttcatggagataaacagttcttgaacggtttactccaggtggtaaaaacacatgggaaagtgatttgggctgtgcgtatcttggttttttaaaaaatcatttttatcgagcgtttattgtgatcatggccaaaaataaaataattctttgactttttttgaaatactatacacacatttctatattacatttttaagaattgcttatttttcaatttttctagtatttcttgtatattctaccacaggtgaacaactcattttttgggtgacatttttagagcttgcttgaggggcactagaaagaagggcagtaatgtgatgtgaatgtttcagcttatgaaaacagctgtgctctactttaagaaatttgacatttaaaagtgtaagattgcaaaacaaattaattactagttggttatattatgtgagaattttaaaaaagggattcactaaaagttgttttcaaatacttaatccctttaaatggtatttatctaatgtgatttgatttgtgaataatcagttggcatacaacaatttaggaacagatttttggcatatgtaagggttatcagtgtgttctttgagttctctctttaccaaaagtatttggggacaaagttaaattcagtgttgttccacttatatgccacctataatggtttaactgagtgggaaaattgtcatctgatttatcccatatcatttaaggcagcggtgtccaatcttttggcctccccgggccacgttggaagaagaagaattgtcttgggccacacatcaaatgcattaacaataactaatgagcttaaaaaattgcaacaaaaatttcatatttttagaaagtttacacatttgtgttgggcctcattcaaagctgtcctgggccatgggttggacaagcctgatttaaggagtacattgaagcctaattaaaatgcttttcaccattgagtaaaactttatgatcaggtttgtcaggaacctcatccaaggtagtttagttagtggagtatcaaaagcaccttgttgtcagacactctcactaggacagtggtcccccagcagaggccaacaagcagttatacccaaacttcagcaaaatcaaaataagtagatttggtctaaagtccacaagcagtaaaaaccgttaccttgaaattttctgtaggtgcaaattattcttcagaattaaaggcttgattttcctaagctgtaattctgtttgagtcacttgtgaaaaatgctattttggtaaaagaacaactatgtattctttcaaaggagttttttccctttgtgttaatgcatttgcgtttatttggaattgcaggagatgatgaatgaagtacttgggaagtttaattcagaaatcattttgctttgcttatgtagaaaaaaaaggaatgtgagttaataggagaacttatttgtgggttagttcgtacttcatgtggggataaggaggaaagggaggaagtagctgcaaactttattaaggataactaatcaagtttcatttgatttatactgttcatgcctggcttgggtaacagtgacgccttcaccttttcctagttttcgagaaattttattcttagagaaggggtttgaaggataagagctaagcatcagggcatacaagaagtaaaaaatatcttcagaatgcttaatagtattttgttttgtttttatacattagaaagcaagaaattattttaatactgaatatgggtcaaaagcccaacttcgggatactgggcacggtttcatacctcttagcataattgaatattataaaaatggaaggaacagcttgaatggtgccattgatttttttagtacaggctcttagttcctcaattgaacaaatgagtaaaaatgaagattaaagaagagatgatattaaaagaagtgttttccattttttaaaaaatcccaagggactgtctcaaatgactgttaatttcagaacatagattaaaaagtacattacattggatttatgattaatgaggacacaattacaatttttaaaaaatacatgtaaaaaaggtgagtatactactgcagtttacaaatatttgtgccaagatacgtgaggctagtggtaatgattagaaattataattggaagtgaagactgatttatgttctcaatttcattatttaagccaatgtcacttttaaaatgtcacttaatttttctattcccaatgttcttttcaataaaatgcagtcattagtgcaccatactttatgtaaactggggtttcaaaataatattaactagaatttttttttttttttttttagacagagtctcactctgtcacccaggctggagtgcagtggcgcgattttggctcaatgcaacctccgcctcccgggttcaagcaattctcctgcctcagcctcccaagtagctgagattacaggcacccaccaccacgcctgtctaatttttgtattttcagtagagacgggatttcaccatgttggccaggctggtctcaaactcctgacctcaggtgatccgccctcctgggccccccaaagtgctgggattacaggtgttagcccgtgcccagccaatttactagatttcttaagcataaaatattatctaataatatgtatatgtatgtccactacatgggatttttaaaaagtttagattttgtgatctgcagaactgtaggcaacagttcttaaaaataagaaaggctgagttcaggccaggcgtggtggctcatgcttgtaatcccagcactttgggaggccgagatgggcagattgcctgagctcaggaattcaagaccagcctggtgaaaccctgtctctacaaaaataacaaaacagttagctggatgtggtggcacacgcctgtagtcccagctacttgtggggctaaggtgggaggatcgcttgagcccaggaggttgaggctgcagtgagccgagatcacgccactacactccagtctgggatgacaaagcaagaccctgtctccctctccggacacccctaaaaaagaaaggctgagttcagagttttagtcatgggtgaccctataaattgcaatttctttttctccctaaagggttttctttcactattacatgtttgtgttttcctgattccactcatgctactgttaggtgttggatcatcttacctatagcgtcaatacaaagttcatttgtaaaaactgttccgtttattttctcccagctgtttcatctgagaattttgtttgaatttcagttgccaaatgtagtttaatcggttactctaaatagaaaggttattgcaattttcacaaactaggggaaatataaatttatcttaagtttatgaacatttttatattcctgtggggacaactaagcacagtatgtataatttaatatctctgttggcatttgttctaagttaaatttatttgctgtattgttaaaatcaatgtagtaaggtgtacagtcttttaaaaacaaatctgtttctctgtggaatatttttcaaaaggacctgaaaaacatgctcttaaatagatggagtggaaattttactattaaagtgaatgtatagttaaatgtgtgatactggtattgttttgattgtttttattttacatgtgaggattttttacatgtttctgtggaactacttttaagtaggttttaattttgatttataaacaagcttctctaaaagaaaaaagttgttttgttcttcgtgattatatggtagtcctcagacttttgtagttgaaagaagtagaaatgagtgatttattaagctgtttatgtaaaatgactagttggagcaggtgatgtaatttatttttactataatgtgcagagatgtctttatcccaaacaaatttatagctgaatcgtttgctattttttgcaaatttagggaatctggaatgtgcccagaaatgaactgattgccaagtgttcgattgagtaaatatcatatggaaatggttttttgcttgtaatgacatattgttactgattaaggaccatttcttttctttttttttttttttgagacagagtctcgctctgtcgcccaggctggagtgcagtggcgcaatctcggctcactgcaagctccgcctctcgggttcacgccattctcctgcctcagcctcctgagtagctgggactacaggcgcccgccaccacgcccggctaatttttttgtatttttagtagagaaggggtttcgccatgttagccaggatagtcttgatctcctgacctcgtgatccgcccgcctcgtcctcccaaagtgctgggattacaggcatgagccaccgcgcccagcctgaggaccatttcttaagtatgcctgtaagtaaatatactacacatattggtcaaatgatgtattgacagctttaatttgtagcgtatgcttctctcactcctttttccttttagtaattgtcaatagtttgtcttcagccgtattctgtgagtgaacttctaatgcgctgatagagtgctccagggttgttgttttctaatgttttatctgatggagtaaagaaataactatctgagatccttgtgtaactcttattgtgtgttaaacattgttttgaacatttcttttcaatctgttaattataaagcagatgattctttaaaaattcttaagactgagtgattgtgttccccacaaatgttagtactgggagggaagggggtaaaggtaaagagaaagatcatagggattagtttagattgtataaagtaagtgtaattgtttcgttctaaaacatgttgagctaatcattgtatgccttttccctgggattataaccttgatttttaattcacgcttctcactgtgaagagtcaggagtagtgaattgtaagagaggcatatgtacctctttaaccagttttacatgttattgctgggaatattagatggcaataaggaagacaaacagtttcacaatgatgatcatttttagtaatcacatttagatttccaaattttataaggtggaagaatagacaccatagttatagatggagaagggcttttagacagaaggtcattgttaggaaaattcaagtttaccaatcttggaaaaaaaattacacttatgccagttacattctatgccttacagcactgcactgtaccagttttgaatattctgtgtccataaatacactagtatttgtccaaccatgaattctgacttttaggttagaaaatgtgttcatttaaatgatagttttaacttgagtgaaaaagctggtaatttttatcttcttttttctgtattataattttttgtcattaattttgaagatctcatgctatatgattagttctgtatatgactacttctgtaattgatgaacaactactagaatgaattattgtacttgagcacttagaatcatgtcaggagaggcatgaagtaagtagaacatatttgtgtagagataataattttactttctaaagcagtgattttgaaactcttgctgagagtgtgctggaggaagtcaagcatttcatcccggtttcaaccagtgctgttttattttgattaattttaagcgtggaagtttgcatagtatttcagttgagcaaggttctgttgtttaaaaatacgatagcctctattgttaccatatttgctcttatcacttgcctgcttaaatccttgctatttttttattgttattacgactgataagacttttctttccctagctccaactttattctttatctctgatcactttttcctttccatgtaaaccctgcattctaattctacttaaattgtttgatgttccctgagaggaaaatgttatttttacatctgcatgccttcgcacatggaactgccaccattctcacttgagctaggcagcactcaattcccttggaaccttggtcatctttccataaaagcagttattacattgttttgtaaccgtggcctcccttgagagcagagaccatctaatttatcttgtattcatactacttggtgtttattcagtattcaaatgtctgttgaattattgcatttagaatttgagaagtagtaaaattactttaataaacactaatgtgaataaaatatcccagatctagttctgtgcaaaagagttttagtgacagtgtccgacattatgctaaatatataaaaggcacccatttgcacttatcatgaagtataataaatccaaaatatttttttaaattatattagattctaatggcttaagtgatatcttagattcagtgatctgatcttaaaagttgattgtgaaagcattttaataattctatacagccttggctgcctgtgataatatttcatatgcgattaaagctgatagacttaaaggggccttcaagtgtcaagatatgtaatacagcaataccaactctaaaggtagaatgaaacctggagctatcctgcctgaattcctatcactctcctgtctctcagtagctgtgttgtcttaggcaagttacttaaccattctatacctcctttttctcatcagtaaaatgaacacaatgataatattactttatatggctgtggggaagagtagccaggaattaatgtatataagcacttaaaagaatgcctgacatacagaaaatactcaatacatgttaactgtaattaatttgaagtggcttcttaaatcaatatttattgtgcatcattttcatcttttaaagataattgctttaatacttgagtatctaattttttttaaacttaagatttttagttagttactgtgttttagactggcaactgtttcagtactttccaaaactgctatctctactgaggtattgtcctgtctcccagtgaaatgtaggctgttcccgttggatggattgacatgggagatttgaaactagttctcctgatttctgagcttatcattgagttcccatgaccaggtgttggtagtgtccacaacagagcaggaagagaaatagtacagaattccagtggcaagttcttaagccttaacctgtactttaagtcagtcctaaactttcatattccttagtagagaacagatgttcccctttttttcccccacattttccttttttggcttgggggaatagattttttaaaaatctgaatttatattccaaaaaggcatgtgcaagttaattttcctaagtcaatgaagccgctttttaatcttactttgtaagatgcatacctgcagtgagagaagtaggtagggctttagtaatttgtgtcagggaccatgtcctattaaatcctgtgaaaatatgcacatgtagtacacaaagaaaaatttaagggaagaagagttttttccaagttattttataaagtattctttataaaagtatatttcttgtaataatcccccatctgtccttctagcccacctttactttctcacacttatgctctcataacaattaaaatataatcaaagttacttgggtaacttaaaaaattttcattataggaaggaaatgtgttttgaaaatcagaaatttttcaaattttaataaattttagtgttttttatgcaagctgtgagttgaagatgaggggctgggatataaagctaaatcgggtacttatctttattacttatgacctactagggtgtccagagtatgcagagaacatatgggaatttggaagctgggaatggagactggaaaagtgctggattttgaatagtgccaggaaataaaggaagacttagcaagggatcatttttcaatgccagtgacatgctgtgtaatagtctaccatgggaaatttgaatgcttatacgattggtcagtatactaatattgtcttgtaatttgaacactaactcttaatattaacaaatttttttctcaacagccatcgtaggaacttttaaaataggttttgcatttcccctgaaaatggtgagttaggtcatattaggaaaaataaattctagaataaatacaattttgattaaaccggttttctctataaaaacccaagacgctgtatctatctttaatgttatctattgttaaaatttcatttccctcaacagcatgcatttccatgtttattagaccaaacaacttcttgttttacttcttacctttgtttttccttgttgttgttatttaattagaaaagaaatgctgtttgggccttttcatatgcctcaaaaatgtttggttacacagaggagtgagttagatttataggactcacacccaatttgatctcctcaagtgcatttctaaccatgttttcatccacttttccttgttttaggtttctcatagaaacagcttttcattgagctaaatgtatttcctctcttactcgttcttggaaatctaggactatgtatgtgaaacttcttattcttgtacacaataactcttaagtatttgaaaatgactgttctacttcagtcttcttttttgccaaactgagggaaaaaattcttttttttttttttaaaccgcatgcatgtgacatggtttacagacctttccccatctatatcgctctactcatgacaaagtttttgtcagtttacctctgaaaatacagtggccagaactgaactgactacttccgatgtggtctgaccattgctgaatacagtgaagctattatctaggatactgtgtttctattaatgtagtctgaaatttgcattgcatttttttggcagccacattaccctttgatcacattcagcttataatcaactaaaaccttgtctttttttcatgtgaattactttaagtctaatctttgtcactctttacttgccagttgatgctttgaaagtaaatgtaggatattatgtattgcattactataaaactttaaatgaatttatatatctgaagatatcaccatttgtataaaatagcacagttttcatggtgttttcacatctatttaatcttcacaacaaccatctgagaatcagaaaaactgactttccactaagtctagaattggcacatgtagaacttcattgcaagctttttgattccagatctcatgctcatctcatcattattcattcacttaatatgcatttagtgtgtccattcatatatggtaggcaccatgtggtgctggtgtgtcaggggcgagacacattacagtctctatccttgtgtttatgatctggtgtataaatactaccaattactaggcacttttcataaggaaggcactgtggtagactattatttcaaaaatatttattgcttctctctatcagggttctttctgtagtcggattatacttcttattctgttgacatcaggtttgaccatttggctttccttgaccaataaaatgttaaagtgacatgtcccatgtttgagcagatatttttcatcctgtggttctgccagtggcccttgaccctctgtcatggaaccagcatgacttagctatggctggtcccagaataatggagcagagctgaagccaatctgtgataagcatataagtgtgagataaatactgtgctgtaaggcaccatgattttggacatttgttaccatagcagaatatagttcaagcgatgatactggcatcactcaaggtgctgtatgatgatgataagacttgggcattgtcctaaaggagcttacagtcttggtagatgtattacatttccacaggttattgggagttgaggaaaaggagagtaatattacataaggatctttgaagttgaggatctttcctgacctccatctcatccctaggctgaatcagtcaatatgttttaaaccctgggtttgtgatccactactcactgtcacaacctcttattgtccaaaatttgataggcatattttctatgccctcattcaaatcaccttttttaaaacaaacatttaagaggatgaacttctacagaattgtgattataagcttccttcataaatctattaatcagcatttaatagcaagctaagaatatacccagttaaactgtttctctattatccagaaagatatcatgatgtcctagattctatgtgaattttatttgtgagcatttaaatttcccattgtcatgtctatgtgtgcttctcactctgcatgggattttaaagaaacaaaaccttggctgggattccaaaaggaatctttttttttttcttccccccgtgagaagctaaggaatacatacatggccaaggttcagaagagttttgaaacctttgaaataattacatgtaaaattttatgtaaatatacattgttctggtccctagctttcatcatattatcaaaggaaatcaaaaactcccctggaaggttgtaaaccctgttgaagagtgagactagaagtagaacaaggatctgaagagcaccaatatttaagggacaagtggaataggagcccagaaagaagtcagagaaggtgtagttaattagaatattggaggagcgggagcaaatgtaatgtcagagaaaccagttccttattaatcagagcttttgtggtgtgttggggggcggggggggggggtggtaaatccggcagttctcatggcgtttcattgtgattccttggaaattaccaaatctgcagatacatttaatgtcttgggataatatttttcttgacctataaacatgaattaaaagtgattacttttcttttgctgtctccttcctatcttggactttgatttttcttttaatccgtatccttcacagattaaaagatcattcttttttttccttttttttttccttcacccccttcctcttccccttcccactcccagaccgattcaaggcaggagtaaaacaattatgtaggttatctgttagcagttttattgcaagtaagtaacctggcttttgtttgttgttgttgagaatgtatttaagtctttttattgtccttaacactttcggcaagtctctatttttattgaaacaattttattgacatatagttgttatacaataaatggcatatattacaatgtgcagtttgttaagttttgacgtgtttatccatgagaccatcaccacagtcaagacactaaacatatacccccaaaagttttctgatgtcccttgataaccctcccctgcattctctaggcaaccattatctgttttcttttactttacattggcatgcatgtcttagaatacaatatgcactccttttgtctggctactttcacccagcattatttggagattcatccgtgttgtaccatgcaccaatagttactctttcttattggtaagtagtattccattgtatggatataccacattttgtgtatccattcaccttttgataatctatttgggttgattccagtgtttgacttttaaagtaaagcttctatgaatatgtatgtacatgtctttgtatggacataaacttttcatttctctgggcatacacctaggagtagaatgactgaatcatatggtagctatatgttctatacctacctagtttcttcttaaactgccagtggttttccaaagtggcagtaccattttacattcccaccagcattatgctatcatttggtgcagtcagtctttttaattattgccattctaattagtgagtagtggtggttttaatttgcatttctctaatgactgctgatggttagcatccttgcatatgtttatttgccatccctttctcttttgggaagcatctgttcaaatcttttacccgttaaaaaaatctggttggttgttttcttactgcattctgagggttcttatgtataaatcctttatcagatttatgatttgcaaatatttttccagtctatggtttgtctcttcattctcttaacaatgtcttttgaagggcaaaggttttaattttgatatctaatttatcagttcttttatggattgtacttttggtactgtatctaaaaatgttttttttgcgtaattcaaggtcaacaaaggttttctcctgtgctttctccctgtagttttaggttttctatctaaatatagtgatccattttgagttaagttttgagtatagaaaacttttctatctggatgttcttaagacaccatttgttgaaaatttatcctttttctattgaattcccttttccccctgtgaataatcagttgactttatatatgtagtagttctattttggactcgattttgttccattgaggtatttgttgatcttgacaccagtgctgcactgcgttgattattcagtgttgaaatcatgtagtcttccaattttctttttttcaaagttatttttgctagtctaggtattttacatttccttatgaattttagaataagtgtcagtttttttaaaaagcttgcttgacgttttgattggaattgcagtgaatctgtaggtcaatttggaaagaattgacattttaaaattattgagtcttctgacccatgaacatggtatagcacttggtttagggcttcattaatttctctcagtaatgtttggtagtttataggatgcaagtcttttatattttggtctcgtatatgcctctgtaagttgggttctgcagagaaacaatcaataagggtgcgttgtgtgtgtgtgtgtgtgtgtgtgtgtgtgtgtgtgtgtgtgtagagagagagagacagagagattgattttaagaaattggctcgtgattgtggtgggtggcaagtccaaaattcatagaattggcaggcaggatggaaccttaggcaggatttctcttacagtcttgagatagaattccttcttccttaggttatctggttttgctctgaaggcctcatttgattggatgaggcccacccatgttatggaggagagctctttttcttaatgtcaactgattgttatcgttaatcacatctacagaatagcaatagctagactagtgtttgatcaactgggcagcatagcctagccaagttgacacattaaattaactattaatatcattgcaatccctgaatatttcatattttaaaatacttttgtaaatggtatactttttttttttttttttgagatggagtcttactctgtcacccaggcaggagtgcggtggcatgatctctgctcactgcaacctccgcctcccgggttcaagccattctcctgcctcggccttctgagtagctgggattataggcatgcaccaccatgcccagttaatttttgtatttttggtagagactgggttccaccatattggccaggctggtctcgaactcctgacctcctgatccacccactttggcctctcagtgttgggattacaggcgtgagccaccgtgcctggccagtggtatgcatttttaagctcagtttctgattgatgctagttcactattgctttttaaaaaatactttagccttcttttcattattaaactcatatgactagcagccttttcatttgaaattaggattaccctctatttttagacgtatcctttaaaaatacgaattttttaaagaaaagtcctaatgttgttacttaatctctcacttttttttttttctttttactggaatcatctgacagaaatggcaatttcatttcaagagtcttgtcttatttttctgggccatgttctggttgtttttttcatcacaggattgtaacagtccttaaatattttagagattaaaattctaggtcaatttagagcataattggcaaaatagacatgttaccaaaaacagagatataggaagtttgggagagaagttaaggttcatattttaggtatgacctttatgctagtctctttctttgataaagtcatttaatttctttgagtcctagttcctcatctgtaaagtagagtaatatccacctcctgtggaattgtcatgaagttaaatgagatgctttgtgtaaagagcctggactagtgctgctaaatagatgcagctccctttactatatttttatttattcagtaaatatttgacactcactatatgccagacactgttccagactctggaattagaggagtgaaaagataggcaacattcctattcttacagagcctctatgttggctgttctgacagaagaggaagataaacaaggaaaggaataaactaaacaatttcagattgtagtaagaagtgtaaagaaaatcaaagagtgcgtggtaataaagaattgctgtggtgaaagcccacttcagactaagtagtcagggaagacctctttaaaaaggtgacatttgagtagaaatgcccttaggattttggagaaactaggcatgtgaagatctgagtgaaaaagtttcctggcagagagaagagatagtgcaaagcctctaaagtgagaaaaatgtgacaaattgagagaattgaatgaagcctagaggtgctgattgcaagtagtggagaagtcagagaggaccagctagtgtagggtcttacaagccacaataagaagaatggattttattctaggtgcagagagaagccactggagggttttaaaacagaggtgttgtgatcattagatggaaatgttgctgtggactttcagaaatgtgaacttagctgtgaaacgttagcaaactaaatactagcaacttggatttctagttggccaagaaacatgagggtaaacaatttattttccctgattaaaaaaaatcccagcaagtctctagcaaaagcaagtctaggttatctagagcaaataccattttatatctttttaattttactaagacttgttatgcaattatagatgttacagatgttttcaaaaatagtgctttgtggattgttttccttttatgagtccatgtggcaattgactagcatagcagtaaaaagtacaactctggtttcagatacgagcatgatgattgatcacatagaagcattaagttaatattaacaaggatctattgccagaatatatttcattataggattttgaaattatttagctgaatggaccttaagagttggtcttttttcctttatagaagagggaacttagattcaaaggggttaagtgattcacattatttaaacatttaaaaaataaacctggattttactattcttctagttgtaggatgacaggttcttgaggcaaaatgtggaatgagagaagatagtgacatctgtttgctttgtatctgctgccttctctgttgctcatttattttacatctatgctgtttcacacttatctttggacttagggtattgggatgtgtcaaacagttgctcccttagtgtggaaacagacaagtaaacacagttgctacacaagttgcaggcatcatatgataaaggcaagcttagtgtgttgtggagggcatgatgggtgtgtctgttaagtgtccctgtttagagtctgtttacatacagagttgaatgtccttggcttctcatttcaatttaatatatattatattgccttggctgttaggcctttcttgcacttgtttgcctcccagccataagccagtttgaaggccatgatccatcaggtctagtgggttaatccatgtctgaccagtaagacctacctatcttgacagtcaccatgatgacagcatgtcttattttaaatagaaacctggttagagactaatataagaatagttggtcttgaatagatgtattccttctcttaagcgaggtaggttttattaagcgttgtattttgaaaaatcctgaaaggaaattgagaaacagctatcattttgttaattttggctccttttactgtattttattttgaagtatagccattcctaagaacgctagcacatgagttcattgttgatgttataacatattctgaatcttaaaacaaggtaccaaaaatacattcatagaacaagtagataaagtagcactactataattagggaaaaatggtagttttcttgtaagccctttctctttcaagagcttataattttctgtaaaaaccaaacattatcctttgggcacgtgtgttttattctttctcttgattctgtgttataaagtttgattaaaaaggaaagatattaactttttgtctcccacacaaagaatgttcataattgtaatttttgggtatgacttgttgccatacccttgagcctccctttgtttaaagagtaataatatatatattttttaatctataaagaagtatctttgacgtgtgtgtgtgtgtgtgtgtgtgtgtgtgtgtgtgtgtataaaatcaaaacggcatacctttttgagaatatttagtgattcctgaagactatattatagttgtataaagaattagatggcaggccaggcacggtggctcacgcctctaatcccagcactttgggaggcggctgaggcaggtggatcaactgaggtcaggagttggagaccagcctggccaacatggtgaaaccccgtctctactaaaaatacaaaaacattagctgggcgtggtggcccacacctgtaatcctagctacctgggaggctgaggcaggagaatcacttgaacggggaagcggaggttgcagtgaactgagattgcgccattgcactgcagcctaggcaacaacagtgaaactctgtttcaaaaaaaagaattagatggcaatagctttagcaatctaatgtggtaggtgatctggtattatctgtctctttggtcacatgaggataaggctgcccatctcggttatccatgtcctgggccttaggaagaaggcagccagaatcttagaaatttgaactgagaaaattgaacacaagttagcagcctaaaatataaaactgatataaaaatacaaccagattgtgtatgaattattgttttctcatctttattttgtgcagatcaagaaactgaactttgcaagtattttctgtgaaagggtgaataagctatccaaagtgagtgattttagcctgtgtagaaaacatctccagctgtgttaaatataaagctgtcagttctttgaatatctccttgcaataattaatcatccttctcagttaacagcacagacagtacagcacaggtaagagagtaggctctgaagccagtctaccaatgctcttgtgactctgggtacattgctttctgtctctcatttctcatttacaaaaagaggatagataacactagtacctacctaatagtgttgttatggggattaaattagttaatatatataaaacacttagaacattgcctcagagatagtaagcaccatgtatttactgtttgttgctgcatatctataatacgattgattgactgattgattgagacagagtcttgctctgttgcccaggctggagtacagtggcataatcttggctcactgcaacctctgcctctaggggttcaaatgattctcctgcctcagtcacctgagtatctgggattacaggtatgtgccaccatgcccaattaatttttgtatttttagtagagacagggtttcaccatgttggccaggcaggctggtctcgaactcctggactcaagtgatttgcccgccttggcctcccaaagtgctgggattacaggcatgagccactgcgcctggctgtataatacattttaagtggctggttttattagttaagttctctcagagagtttggcatttgaactggtccttgaaggataaataggatttgtaaaagtgaaacataaagaattaaaaatggtaaaagctatgtgaattaagttgttaagaggaagtaaagaatctttgtttccatttattgcatactagctatgtgcctgcctctgagcttagcatttgatgatcattacattatcttattcaatcctcataataaccctccaagataggtattttattttatttattttattttattttattgatacagagtcttgctcttgtcgcccaggctgcagtgcagtggtgcgatctcggctcactgcaacctctgcctcccaggttcaggctattctcctgtgtcagcttctcgagtagctgggattacaggcgcctgccatgatgcccagctaatttttgtatttttagtagagacagagtttcaccatgttggccagcctggtctcgaactcctgacctcaggtgatccacccgcctcagcctcccgaagtgctaggatcacaggcaagataggtattttaaattgtcatttaacagatggcaaatagccacagaaaagtaaagccactttttcaaactcacaaagtcaaatgtttggcctagttctgtcagactgtaaagcccatgcttttaattggtatctaatactgctttcctatcagtagactatcagattatcattcctaaagatatttaaaagaatgggtgctctagggttggagttcaaaacattaatagaattatactattaaggttgcatgtgatcactttgctgctgtgagagactctggatgctgtgtttgctggtcatttcaaaggctgaagagaaacagacatgcctgtccttgccaaatacattgtttcccctatcattctgtcactatggaagtacttgttttttctgacctgggaataatggtattgtggttattggcgtttttgttacctttcttactagaaattatgcagatatccccaattatatccagatgcacaccttatattccaaattttgttgcctgggattgactgagtacccttttgagttccctgcatcagagacgtgtttacagttgtgcttcccagtcttcagcatttatggtttcatgtttgtcaaatttgtttgaagtataaaaacgataatcttaattctgttactgatcattccttcattctctagctatttgtcacatcatctttcttttgaaacgtttagggaattaagaaattaataattttatactcattctttttccactcacatatctcactggctttgttcagaattaaattgtttttggtccctgtgtactatttccttctattaattaactgacggttgtttctctcttctgtgtttttgatgcttttttttttcttttactgtttaaaactttttcagaagatgtagcgagtgactcaggtgctagctagtgttactgatttcccccccatgttagttaataccatgtcaaatataactgaagaactctgttgtactcacagattatgcccctcatggtcagcagactattcagatacagactttcagggggaaggttttcaaaaaagtgtggctgcaatctgtaaatgcttttaacatctgcacattgcattactgttttcaaatgtttttgtaccacataattttatttaatattcacaactattctgtgagagctttattcttttatgttgtagggttttcttattttacagattgggaaactggtgtggagcggttaaatgacttactcaagattacatagctagttataagtggaaggacaaggatttgaaggaacaggtgtggcctcttccaggaaacagtataaatagtcagactttatgaaggataaattggtaggagagtcatttatctcacttgtctgtaaagaggattctttttctcaagtagagcgtgaagtagattatttactagaaaagcttgaaaatgcatttcagaaaattaaaactgctttgaaattaggtgcataataagaattgcttcagagcctggcatccgttggacattatacacatattctctgtcaatgaggtttacagttaaggtctcttcaatccttattttctgaaatctctttttgcttatatattgagactgaagttagcaattttcctccaggtgtggactttgaaaattaaatatacttattgaaacgtaggttgcgtttatatagtgctaccctccaggattcttggaaatttaaatgtattattgtatgtatgaatcatggaacgcactatagaatctatagtggttatcagttttgttttgggtgtagttcatggtgtttagttaagtctctaaagcagagtttaggatctctgcctttcagttatctgagtgctgtggggctacatacccactcagattctcttgttctaagtggtcttaacactcagttagctctatgtgttggtggtgacaaattttactatatttatgacctaggtctttgagtgggcactgtttcaagaatctaggaaggtactggctactattcaactcactgtcggtttcaattatggtcagagaattttgaaaacaaaaattctgaatgccctatagtttaataaaaagtagttgatccttttgttcaaagcactgtcccacttcacctcccctctaggtttgaagcattcctatgcagacagtttaccgacatgataaacaaaattatccattcatgcatcctaggattttaatgttaccatcgccctccactcaaaatgcaatatgcatttagtctgtaatagcatcactccattttaagtgaatagttgtttcagctttgatttgtaatcacaattaaggtaaattatccttgtttgcctaggactgtcctggttttaaaactcaaaatctcttgtccaaggaaccctcacagtcccggacaaaccagaacaatttcttaaaatactatttaggaaaactggtcacccgaacggcaaggctgtgttgttgattaggctttaggcatgttattgagactatagactaagctcagatcaatggttttgaagattctgtatgggtcaggattacctggagtacttgttaaacagactgctggctcccatccccctagtttggatggagtaggtctgtggtgggggtctgagaattactttagtaacagttgcctaagccatgctgacgctgctggttaggagagtgcattgagaaccactggcctagatcaggctgtgtgctgtgtgagtatatgatgatgcttggttcagaattgtggagaaaggggagctgtgtttctctgcctcacaggtctaagcaccaataacaccaaagggtatttgtatctgaactgtgctcatacagcacaagaagagacgtgctcctgttagaggtgacagaagtaggggaaggattaaaaacagtctagctgtcaaatccttcacagtatggatatattttgattgtttatagtatcttaggcaaactttgatttgataattaatttgagtcttatagtcacaacatctgaaatggatacttcagaaagcagatattcattattatagcagaactgattatagctgggtttagcagggataatggtacccatcttgcctacttctcagttatcactgtaaaaatctagttacataaaaggtgtgagcatgcggtacaaataagatgtcatggtgatgattaaagtgtactttgttgttggacagtatgtttcacagtgctttcatcttcatgttccatttggttgttttcaggtgtcttcagaattcggcaaagtagatgggactgcagacgttaccattccctgtgactcttgctacgatcttacagacttcattgtgctgggcttagatgtcttcagagtcaccaggtacttggttgttcctagatagtgggcctgcctgatcaggatttggtatttttcccactgaattaaaattgttttgcctaagcctcattttgtgtgtcaagaaaataaaggcaaaagagtaagtgctgtgctcctaatccacagctagctggtagtcagcagcctgggaggctgagtctctggtctcctagtctcaaccttctaggcagtgagcattgttaatcacagaacaggccctccttggactccttggcttgctcgtctttgtttctcccagggcctagcgttcacatccacacacatactacatacgtttctgcatgtgtgcatgtgcatgtcagggaaaccacaatttgttctcagctccttactcatgtgagcttagcgaaatcgtttctccaatctgtaccttcttcttcatctgtaaaatagaattatcatctgctctgctactacccttaaaagtagttactgcataaggatgagaaaatgtataaaaacactttgaagcttttgttacaaagggcagttagtaataatgagtaaatgataaataagccttatagaacaggaagccttttcatctttctgtcctaaacacccttctattttataaatttttcaagtagattaagtttattaatttagataatgttttctttttctttttgtctctgctctatttatttaacattggatatatagagaatggtaattattattgaatggattgaaaacaagaatagagtctctttgggagtatctgtgttttttgtttttttttttttccatgtaattgggggcattttctgctccatggtcggtttctggtggtttgtgaattcttgccttctgccaagtgttttctccctgtcaccaccctgctactactctttgtgtttaccttcccagctgccctgccttatttcagagttcagagtcaaattgtagccaaccatttctgacagccttcctagacatcactgaatttcagctaattaatagatttaagggatgcgaaatctaggccaattcagaattttacttcatttgagggttttttttccagaatatttatcttaagttacaaaatgttgtttcctgttaattgttttcttatgtattctggtaaaattttataaacccagtaaaactctcttacaacaatactcttgggagataatggcttgtattcgttctggattgtcacataggaagagatgtgtttaggtatctaacttggtttcagcattgtacttgagacatctgtggtaggacagaatctgtggcaaatgtggcatggcatacattatatatggatattcataaactgcttttgatagattgacaaacatttccagttactgaaccagtagcactgttccagtcagtagctcagtaatatccatttttttgtctgtacagcagattgtatgtatgcatgtgtgttttgcccatttttataaaaatgtgttaaaagtaaaatgctaatgctgatagaaaattgacccgcaaatatgtaatgtttttgacaaagatggaaatcataaagcatgccaaaaatggtaaacctttagcttcagctatcccctcattagactttaccttcttactgtgtattattacaaagattgtgtctagaagatactttataatgatagaaggtattttataatagggtttcttatcacatatacttaatattcaacttctgtacatttaattttcatgtttcctcaagaatatattatacaaagtcatagcatttgacaaaattccttcataactctgaagaaaatattctatgtattgtttgtgtgagttaaatacagtggctctgataaaaatgtcttttgatcagtctttaaaaaaattaaactgaggacaggaaggtaaattaaaggggagatttggagacttgtggtaactggtttattgcaacttaatgtgcagcatcctcattagtcaagtatcatgtgcctacctaggcatgaaatagctatttttttcctgatttaaatctggaaagtttcagttgtagtacagtttgaatagttgttgttgtaaatagccactggactttttaaaaaagtatttttcttcaaaaacagtgaaggtcatcttgtatccatagagaccacatgtactttcctcattatttccagcattatttatataatgggtagagttatttacaacattaaacaaaaagtatttcagagagcaaccgttaaatattatcacagggtaaatatcagcaactgaaatccttttctcatagtttctcaaaaaatttggtattaggaaattaatagtctctcagaatttgtatattggttttcttcagtagttattctgtagagtgtgtgtgtacatatgcatgctcatgtatgtatgtatgttcatttcttaaatcatttcataaatcactgtgacttaattgtggactttaattgttttcatagtttttttccccaaaagaaggttactttacatattttattttatttttatttttattttttttgagacagggtctcactctgtcgcccaggctgcagtgcagtggcatgagctcagctcactgcagcctccacctcccaagctcagggatcctcttacctcagcctcccgaatagctgggaccgcatgcaccaccacacccagctaatatgttgtatgtttttagaggtagggttttgccacttagcccaaggctggtcttgaactccgggactcaagcgatctacccatccacctgcctcggcctcccaaagtgctgtgattatagacatgagccactgtgcctggcaattttacatattttaaattaaagcaaatcttggtttttgatggaatgcagatttacttatatttcacttagtctttttcctttctttcagaaaagtggtgtggaaacaaaatggttttagtatattgccttataaacaaatttaagatcatgagtttcttttattatcctctttgttttgctcatttccttgaactgtacatccctaacctaaatcagctggagacaggggaagaaagtgttagattcttactcagtttagatcctctgccaggaaaacccactctattcattgtcaactaaattaacgcttttttaaataaaaggagtcatttttaacaataacgtcagggcagcaggcatccatgaaatgtatggtcactgatcattagggttatcattctaatgtgtttactattttgaaactctagggagaagaaaacttatttttgcatatgttggaaaaatgtatcctcatgtaggatatcagggtaatatctttaatgtttcatacttaccaagataaatttgtaatgcgtattttcttttaaaattagatttatttaggagaaattgcacttggtgaaccactttctctttaattattagcattaactttatcatttttgtttcaagatgtcacagctattgttcagcactagaaattatataaattattagctgaagatgatgactggcaacatttatgtctgttcctcctcttaaatttcttgttcagaaagtctgttgttgtaaacatcc

SEQ ID NO: 563 - DNA, 4383 bp, Homo sapiens
agcaaagacgaccagccgaggatggctggcggaggcgtggggcaggccgcaggaccctcgaaggatcgtgtgagaccccgggcagcctcttgggaggccatttcgaggagaaaaccttgatttctgcctcaggaccctgggcctcagttttcctatctgagaagaagggcgaagagctgtgcccccgaccacacccgtcggtgatggggcaaaccgagggcaagcagaggagcgcttcacttttggtcatcccttgggccaccagggccttcccgtctccgtcttcccatcgcaggtcctggcctccttcacaccactccaggataccgcagcatctcccccagcgcagcagacggagggcgcttcacatgcccccggacctaagcccactctccccttcaagatctggactccacttttttgcaacactcttaacttctttggaagctgggaagcctcctactcccttgggcctctccaccctgccctcagctaactcgtcggcaagccccagcctagacattgcctgttttgtgaagacatctagatgctgggctgtctgttgagtgccccaccctgtgtttgagcagcaccctctacttcccctgttctacttgcatgtttatgtgctcgtcttcctcattataagatccacaggggaggggccatgtctatattattcatacttacagtccagtgtctagtatctggcacgtagtaggcactcactagctattgagatataaatatagatatttgttgaattgaaaatgaattgggccgggcgtggtggctcacgcctgtaatcccagaactttgggaggccgaggcaggtggatcactaggtcaggagttcgagacaagtctgaccaaaatggtgaaacccagtctctactaaaaatacaaaaattagctgggcgtggtggcacgtgcctgtaatcccagctattcaggaggctgaggcgggagaatcgcttgaaccccgggaggtggaggttgcagtgagtcgagattgcaccactacactccagcctggacaacagagtgagaccctgtctcaaaaaaaaaaaaaaaaaaagagaaaaagaataaaattaaaaaaaagaaaataaaggaacctcattcacatacacctccaaaactctgatttcctaaagttgggcatttctcattgctggaggtgttcagttagaggcatgccgcccccttgaagaaatgtttatttcatttgtacagtgggttgggattttacctgaatgctttgagtacccttttaatcctatgatgctagagattgatagacccatgcctattattcctgtcagttctccctgaaatgtcatcagttcttcatgttccgctatttctagctgttggccctactcgtttctgtgcctaaatgccctacctcccactccttttctgagaaagatcttctgccctgtcagttatgaagtaaagatgtcctaagattcctgctctttcttttttctttctttctttctctctcttttttttttttttcgacggagtttcgctcttgttgcctggagtgcaatggctggagtgcaatggcgcgatctcagctcactgcagcctctgccacctaggcccaccttggtctccccaagtgctggcattacaggtgtgagccactgtgcccggcctcctgctcttctttcaaccctctgctcagcatcttaggcctcattggtgatgtcccaccttgctaggtagcatctttcctgaatatttctccactaaacattctgatgttggctagatggcctagttaatctacacatttcattttatcaccttctccagatgtttttttgtgtatgtcagctgatacactctggggagaatgccttaatatatgggaataattaactcatggccaagaaggaaataaccaaggggacttttactctggacctaattcaaaccaaagagacagagcctgagagaaagcagctctgtcatccttgagttagtaacatccaggaagggaaggctagggtgggggagtgagtaaaacagatggcatttagggaagaaccaacaggactttaagaggcatggcagaggggctttgatcctggctaaaccatcagggaaggcaattggagctgggtgaacagatggggtcttattactgaagagaaaacggtaaggaggcagggggaaatgggacgtgtgctaaagcagagtgcctcattcagtggatgcagtgagagcagaggctgttggaaaagtggatcagggaggaccatgccaccaggtgggcatcagcagagtatcacccgagtattgcagagggataccaaataagtccacctgaagccagagctgaaaccctgtggaggtccgtttaccccttcagaagtagtgtaccaccatccatctaccactggaatccaatttcagttttggcaaattgttataaataggaaaaagtcagggttccacaattctggcagcacccagagactataacagcatctgcacagccaagtagagttaggaaacctggatcctaatcctgactttgcctctgattagatgtgtgatcctgggctggagctgttttttcagttgtaaaatgctgtttattggtgttaggtagcagctaataaggctggaggtggggctgggtgtagtggctcacacatgtaatctcagcagtttgacaggccaaggcaggaggattgctggaggccagggatttgagaccagcttgggctacatagtgagactctgcctgtactaaaaattaaaaaaaaaaaaaataactcagtgcagtggcgcatgcctgtagtcccagctactcaggaggttggggtgggagggttgcttgagcccaggagtttgaggctgcagtgaactatgatcaatcacaccactgcattctagtagcctgagtgacagagcaagacctgtctctaaaaaaaaagaaattttttttaagggtggaggtagggaaattcaaagctacttactagctgtgtgaccttgcctaaactacctccttggatttgcagtctgtttatttgaaaatgtcataagggataaatgagattccttatgtaaagtactttataaatattaagcacttaccaaatgttagtctgttttcacattattcttcttggattaccagaaattggtttgaccatgaataaacaggagataatttcttgggtaatctgagtttgaatcccctttctctctcttactaattgtatgactttgattaggttatttaatatttaattgttctgggtctcagttttctcatttgtgaaattaaaatgtgttcttcagaattgtgagggttaaatgtgataaaaggcctgactcatatgagaaaatgctcaatatatttgttttgtcatttttaaggggtggttttagggcacagaaccctaaaggaatgaatggaattctaaatacttcgaagctagagtagtgaaagattccaggggaacacagtgctggccttctcccttcttcttggggaagaaaagatctcagtgaagttccatgggtcttctcacaatgttgggagtcttcctggagtgagtcaccatgcattccacaaacaaggcagaaatgacagtggtgttattgccccacagttgggtggactcccccaagatccaggtgtgatcagccctggtcctagtgatagaccagcccttctcctactacccacggaagctgcctcatcattgccaccatccgctttctcaacaggagagacttgatacagaaggcatagtccctgctctcaaagaacctgggacaagttggggaggtgcagctgagttggtaaagaacccctgggtagcataggagagtgaattcatagattctatagacaaaccccatacccatacttggaagagttgaggagtgactggttgtccccctagggccaagagctgctgcctccctcccctcctccttcttttgcacagctttattgagcataattgatatacagtaaactgcacactttgatggatttttgacatacgtctgcccctgtgaaaccaccaccacaatcaacaatgaccatctccatcactcattgccttgtacccatggaaatccccccttgctgccctcctgccccactcccagtcaaccactgacctgctgtcagtgactatggattagttcacatattctagaattgtacacatgtagaatcatacagtatgtgcacttttttgggtctgtcttctttcactcagtgtcattgttttaaggctcatctacgtcattgtataaacagtttgttcctttctattgctgagtagtattccattatatgaatatactacaatttgtttatccattcgtcaatggactttg

SEQ ID NO: 564 - DNA, 4410 bp, Homo sapiens
cgctaatgtgtttggtataatttcatatattagctttttaaattatattcatctaagtccagtaagttggataatatgttattttaatttttttcagctgtttcttctcatttcacccaagacctcttgccagagcatggtataaaagattcatttcaaaaagtgatactgagaagatatggaagctatggcattgagaatttacaattaaagaaagattgggaaagtgtgggtgaatctaaggtgcagaaagaatgttgtaatggacttaaccaatctttatcaactacacataccaaaatctttcaatttaataaatgtgtgaaagtctttagtaaatcgtcaaatctaaatagacataagataagacatactggagagatatcttccaactgtaaagaatgtgacaattccttttacatatcctcagttctaactccacttcagagaatccacactgcagagaaatcctacaagtgtaaacaatgtgggaaagcctttaggcactgctcatgctttcttgaacatgagacaattcataatgaagagaaacattacaaatgtaaagaatgtggaaaagtctttaaatccttcacaagcctttctaatcacattataattcatactggaaagaaactctataaatgtgaagaatgtggcaaagcttttaaccacagttcaaaccatgccaaacataagaaaattcacactggacagaaaccccataaatgtgaagaatgtggcaaagcctttaactggttctcatacctaactctacataaaagaattcatactggagagaaaccctacaaatgtgatgaatgtggcaaagcttttaaccagtgttcaaacctcactaaacataagagaattcatactggagagaaaccctacaaatgtgaagaatgtggcaaagcttttaaccggtgctcacaccttactgaacataaaagaattcatactggagagaagccctataaatgtgaagaatgtggtaaagtctttatatcttgttcaagcctttcaaaccataagagaattcatacaagagagaaatgctacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccagagttcatattgaactaaagaattataaatataatgactgtcacaacacctttcacagaaaaaaataattttaccacagattaatttgttcattaatggaactttaattctgtggttttttttttttttttttggtctacataaatctgtccttatgccagtactatattgtttaattactgtaacattgtagtaagaatttatatcaggagtgtaagttactgaattttgttatttttcagaattcttgtgtgtttgattttctttatatgtttatatggattttaggaagagcttgtcaatttatattaaagaaaagctacattggaatttgcattgaatctgtagataaatttgttgggtattttgatcttcatattcagtattgctatatttgaatattgagtatatctcagtttattcagctctttgatttctttcagcattttaaataattttcagtgtatagtatgtgcagttattttgttaagttcatttctaatttttttttctaggatactattaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcaataaaagactattccacttcttttctaatctggagattgtattgatttttctagtgtaattttctggctcatacctccagtacaatggtgaatagtggtataagtagaaattctcgtcctgttttcaaacttgcagataaagcccctagtcattcaccattaagtatattagcttttggtgtggagtttttcatcttggctcactgcagcctcaacctcttaagctcaagtgatcctcccaccttaactgcctgagtagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtattttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcaccattctgtgcaattgatcactaaatcttatttctcctaagtgaaacttggtacactttgaagaacatttcccctctttttattcaccccatctcctagcctctgtcacattttcattcatactaggtaacattaagatcattatggaaattaactttttggtgccccacaactaaatgaacataaataatgttaactttgttaggaagttatagtaattacgcataggaacaaacggcagctatttttgccagtaaacaaaggatgcgcattattttcaaatattagatataagtattttaggtggtaaagtcttaggcctaaaatacgtcattgagtttattaccccagaaacccagcaggtcatattttctgaacattgtaaataacaatagaaattatatactaaaatgttaccagcaagtactatctcaccacatgaaaattgcattgaaattttttaatctgtggttcaaatggaagactcaaagagattcttttatggattcagg

SEQ ID NO: 565 - DNA, 2032 bp, Homo sapiens
aaatgtactactggtagtcatgtgctcactatctctgccttactcttgattcctgcctccagtgaacccaggatgaaggagtgtttcgactcatctgactcattatgccttctttgccctggatcttacacagaaatgctctccataccttgccactgctgctgggaaggaacaggggaggagtgacattgagattcaagactatttttcctacctcttcagtgcctctttcagccatatgaagttaaaaccaggtaatgggagaagaggagagtaaaagtgaagaagaaagaggcaaaacaagtgactagaccacacgctgaacaagttgtagctctcatttacttttcagagaatgtaaaatgttacaactgctttggataacagtttggcaatttctttaaaagttaagcatatatatatatatatatatatatatataatcatataatctagccatttcacacatcagaatttaccctcatccccaaataaaagcacaaagatgtgaatgcccatagcagctgcatgtgtaataactcaaaactataaaaaactcaaacactcatcaacagtgaataattaaacaaattgtttacattgcaaaaacattatcagttgaaaggaatgagctactggtagcagcaacaaggtacacaaatctagaaataattatgctgaggaagagaagccagaaaaatataatatatattatattatctcatatatattaaagaatagagaatgcaaactaatctatagtgacagaaaacaaatcagtggcaatctgggaatgagggtaaggggtaagaggaagggattaaaatggggcatgagtaaaattttggaagtgataagtatatttattatcttgactggttatggttttacagatacatacttaacggtgaaaactggcagattgtacattttaatatgcatagtttatgaaatgtcaattatatctcaataaatattaagattatataagaataatctagagaaataaaacatttttaaaaaaattatagtaagagttgttctctaaccattgtagttaatcagttttactaaagaataaccacatataaaaccttgttcccttatttacagaaagtttctcccgtacagtttgtacactgtctattcatgtgagctaatgctttaaaaattaacatattaattttcctatattatatgaacctagtgttttatcccaataaattaatcatcacattttctttataggtgtttttttgtggaaaaaatttaatcaacccatatcatttttgtgtgcgatctttccttagtgaacattaaatctaatcatttgttatttgcatttgaagtaattattttaacatgggctctttcctaagcactttgaaaattagtcctctaaagccttttgttgtatataactttctctcttgtgttttgtataattattattatatagtagtataatttaaaggggaaatgtgcaataaacccatatgctttattattaaaagtaggtactgtaagttttactcctatgccaattggatggaagatcaagagttgtgatgatcgggaggctgaggcaggagaatggcatgaaccaggggggcagagcttgcggtgagccgagatcgcaccactgcactccagcctgggtgacagagcgagactgtgtctcaaaaaattaaaaaataataataaaataaaataataaaaaaagagttgtgatgatcattttcagtttttagtttaactgaagataacagaaacagtccagaatggtcaaactttgacatttattaaaacatttagagacactaaaacatacaaacaatttttggtggttaagaccatgtgctctggaataagaaattggtatttaaattctttctatttactgttacatttaaggctttgtttaaatgtttatgtgtaaaaagatcaaaagcactttcatatatttctttaaataatgtatgccattcaatttttgccgaaagagataataaatcagagcagacaatgaaga

SEQ ID NO: 566 - DNA, 3923 bp, Homo sapiens
aggttttcagtttcagtttcccagaaaggaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccagccttgtttcccatatgagtagactctcccttagctgggaaagcctgacgaacgccatctggccccttgatttacaagacattaagggctacttacccaacccccttcctcaaagagttaacctgcgtaagcagatcctcagcatttcaaaggagcccaattagctgataaggtactggaacaaacaatgtacgaagttcccaggattttgctcaaaagcataacaacataaagccttgagtctgtgtctggcatagcatccatatctaactcttatgaaggatttagagcccggcacctggttccgttgctttttttgtaaccatttgtcttttaaattgtttatttctctgtaaccatttgttttttgattcttgcatgtttttacttctgtagaattattgcatttgagctccgctccccttccgaaccaaggtataaaagtaaatcaagccccttcctcggggccgagagaattttggaaagtcaagccttctcttggctgccggcttaaataaaggactcttaattcgtctcgaagtgtggcgttttctctaactcgcttgggtataacactttgagcctgcgaggcagagtttgcagtgagccgagatcacgccactgcactccagcctcggcaacaagagtgaaactccgtttcaaaaaacaaaaacaaaacaaaacaaaagaaccctcacaatcttcctgcacccaactgatgaaatcaccattgcaaaagttatatcagtgagaacattagaacagtaagctaagctaacccaaaccccaccttacttttcccttaattattcctgggctactgggtcgagctaactttggaagacatttaggctatggtttaaataacaggccttgccaaaaactcaaccacttatttttttgagacggagtcttgctctgtcgcccaggctggagtgcagtggtgtgatctgggctcactgcaatctctgcctctgggttcaagcaattctcctgcctcaacctcctgagtagctgggattacaggcgcatgccactgagtagctgggattacaggcgcatgccaccaagcctggctaatttttgtatttttagtagagacagggtttcaccatgttggtcagactggtctcgaactcctgaccttgtgatccacccacctcagcctcccaaagtgctgggattacaggcttgagccaccgtgcccagcctgctttttttttttttttttccttgagacagagtctcattctgtcacccaggctggagtgcagaggcaccatttctgctcactgaaacctccacttctggggctcaagcaattctcctctctcagcctcaggagtagctgggattacaggcgcctgccaccaagcctggctaattgttttgtatttttagtagagatggggtttcacccatgttggccaggctggtctccaactcctgacctcaagtgatccgtccaccttggcctcccaaagtgctggggtgacactgtgcctggtctcaaccaccctttttttttttttcctctgtcacccaagctggagtgcagtggcatgatcttggctcactgcaacttccgccttctgagttcaagcaattctcctgcctcagtgtccggagtagctgagacgacaggtgtgcaccaccaccccctgctaatgttttgtatttttagtagagatggggtttcaccatgttggccaggctggtttcgaactcctgacctccacccgccttggcctcccaaagtgctgggattacaggagtgagccatcactcctggcatagaaagtttttctcatccattgtcctcctcctcttctttcttcatcttcctcttccacttttttccaggcaactttagcaggaccctttgcaccgtcaaactttcctttcaacttacagtcagcaacctcttcctcatatttcttcttcagctttgccgccttagtgacgtcaacctgcttttcactgtcacttcagctattccacatctcacccagagctttttttttttttttttttttttttgccacatctccaatagagatgccagggtttgcggatttgatcttggggtggaattctgaacagaacatgaagaatccagacagttggttgggtgtgatggctcatgcttgtaatgccagcactttgggaagccaaggcaggtggatcacctgaggtcaggagtttgaggccagcttggccaacatggtgaaaccccatctctactaaaaatacaaaaattagccagacgtggtggtacgcgcctgtggtcccagctaatctggaggctgaggcaggagaatagcttgaacctgggaggcggggcttgcagtgagccgagattgcgccactgcactccagcctgggcaacagagcgagactccgtctcaaaaaaataaataaataaataaataaattttaaaaaataaaataaataaattaaataaaataaaaaataagagtccagacggtggccttttggggacattaggctctttcttcttgcttcccctttagctgctctataatccttcatttcccgatcctagtgtactttatccgcctttgccatttcatcaaatttggacttctctttcactgacactgtcttccaactctcagaatatttcttggaaaattctgcaaaattgacagggacctctgggtttttcttcttcttcttcctttttttttttttgagatggagtttcactctgtcgcccaggctggagtgcagtggcacgatctccgctcactgcaactttctcctcccaggttcaagcgattctcctgcctcaggctcccgagtagctgggactataggcgcctgccaccatgcccagataatttttgtatttttagtagagacggggtttcaccatgttggccaggatggtctcaatttattgacctcatgatccgcctgccttggcctcccaaagtgctgggattacaggcgtgagtcactgtgccaggccggtttttcttcttatgttcttctctgtacatctgcacaaaaaaactataagcagacattttgccctttggtttcttggggtcaccattagccatcctgactgtattgtttgctagtctgggcagcgcaggacacttgttcgctatttttctaaacttttcccccaatgggtgtaaaaaagcatattattattattattattattattattattattgagacgagtttcgctcttgttgcctaagctggagtgcaatggcgcgatctcagctcattgcaacctccacctcccgggttccagtgattctcctgcctcagcccccttagtagctgggattccagacgcgcaccaccacgcctggatagttttttgtacttttagtagaaacggggtttcaccatgttaggctggtctcaaactcctgacctcagatgatccgcccgcctcggcctcccaaagtgctgggattacaggtgtgaaccactgtgcccggcttaaaagcatattattatagtaaatactttttttccctttctttctttcattttaaacactggggtctccttatgttgtccaggctagattcaaactcctggactcaagcgatcctcccacctcagcctccctgttaccctgttgccatgacagccctgataaaataactgggaaagttctct

SEQ ID NO: 567 - DNA, 2031 bp, Homo sapiens
aaatgccttggaagagacctcagaggataccagtccgggtttaggatgcatttgctgattattacttaagtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaagtgactacatcctgcctgctttcagctccagtggaaaatgcattaatcccagagtctccgtgaggtttcctgtttgatgacataatcagaaaatcctcctcacattgcccttggggttgctgtctggatgttatgttgtcttggtgggtgtaactcagccatcaaaaaaatcagcacaggccataaactcaggacctgaaatgcattaatataatgttaaacgaaataacgctgtgggtatgtctgcagcactggtagggaatttcattaaactgcagattctccctggcatcagatgcattggctggtgactccggtacatatggcatgagctgctgcaatgccactagcaggaggtatttgaactgctccagtgtaagctgttagactacatctcgtggaaaaataacacacacccttgactaccagagtttggtagtgttgatttaagtagttcttcccttccattcccctctggggcagcctgtttacctaataacgttttgcctttggtgttgatcacaggaagctgcaaaaaagaaaactagtgggaagagtcagaaatagaagatgaggatacactttaaaatgagaaaagcaaaagatggcatctgacatgtagagtgggttttaaaagttttaaagataagatattgtgaggcagaaacttcagtagctgtgaatatagttggaaagaagaaaccttgatataaaagtagaaccaagagtaggatatttagataccaaagggcacgtacaattttacaagtttagaagatattggcataggaaattgagcatatgcttaaatatggatttcctttgctatttggagaattttttatattttttttattgttttggtaggctgccataaccctccatttggttgtcttggatggaatatctcttgccttggatcttggaaatccaagcttgattggcacttggtcaggatgagaacaaggaatgggcctcttaggatgttttacaagttctagaagttacctccatgatcctccctcctgttgttgtaccaaactctttcttgcatgtgtcttcctgggggtggagagaggtggtgagggagctggtgggagaagcaggcaagatacagcttgatagagcttcactggagagaagttaaagaggaaggagaggtctaagctctagccagttgaaagcctggggtgatgtcaccattcctacctccttatatcagaaatattcttgggttttccataatgtattccaagcagcgggacacctttcacagatgcttctcctgtgttaggggaatctggactaatataacactaggagggagaaaattgtgtttctttatcgctactgtgaacgttgttgttttttaaaatttacagctgactactgaataaactctaaaacttggagttctggatttcaggttctgtgatctgttttcttgtatagctctgtgatggttacgtgaccaagctgtgagcatttactctcaaaacagcttcatttaaaccatcctatgccttgtactagaataatgctaccccagagcgggaagggctctgaaagatcacatctaatgggtgaacctctttacccaggtgtgttgtgacaagagtgggggagactatgatcctttttattctagatatgtagcgcaggttggttgtgttagtgaatgtaccatctcacacatcatattgagctgaat

SEQ ID NO: 568 - DNA, 3955 bp, Homo sapiens
gaccgcgtccgaagaccgccgaggcctcccgcagctccgcggtgacacccgggtcaggggcgcggggccgggcgccggggattgtgggaggcgcgggggggcgcgccggccgccttcggagccccccaactcgcgtcctgcaaaggccgccgggccctgtcgagaagacccgaccgcagatggcggggaggatgctcccggcggcgtgggaaccgggtctgactcccgagccaccgccgcttccgcaggggcgccggccccgggaaagtcaagtcataaatccctgaatctaaaactccattctcagagaaaaggcctccaaggacgggcgccgtgcgcggcaactgcctgcagttttgaagccctttgactatttcataacaaagacaaggccgggcggcttggacgcttaggaaaatcctggggctttgcaaaaacaacaggttaatctagtcgtgtgggatgatcaccaaaacaagacaggaaagaagaacaccgtgtcaatgctgaaaagccagcccctgtgagccccaaagtgcacgttttccacagtcccaaggaacacgtgactgtgtgtttccacacttgagaagtcaggataagaccccttggataatggaacaggggatgggggtgggagcaagcaccctacctggtcacctgcttaacttagaaaccagcttttaaaacctgtaactgcagtatgagctacgatcaaatttgtcttaacgtattttttttaatgtttttaatacccagaacacagggcttctactccagggtttcctcgccagggaaccccaaacacacaggacctggagaagccgggtagagctggctcctggccctgcgcttgggtggtcggctgccttaagaagaactgcaccccagagacaggctcgcagctgccgaccttatccactcgccctttctgctggagcccaggcccagtgctccagcaaggaggctgagaaaatgctgaagactgatgcccacgggggacagcttgggctaaggataacgtttgcaaaacaaacctttaaaaacccatagcaacctgtttcctagagcacactcttcatctctccacccccaaactagtcccgactcggatcctccttttcctatcctctttctcttgctctcccgtctcctattcacttttcttctcctttcctcttgattattataaacaaatgctttccaagtcttaccgccatcatatgtgtacatatgcaacccttactgttaccaatttgttgaagtcaagacaggaggaggcaaagtttaaaaatcagaagtattgcaggaaatgaaaatggagtgagtgttgcctgggtatcataattttttttttttttttaacagttcctctacttggctctcctccaaaggtacgcggccacagcaggcaggggcttggcagtgtgggaggagacaccacagaagacagggaagaactaccaggccttggttcatctccacactggcgagagaggacgtgcagttacctgctacctgttcgactcagtcttttacgttggagtaacttaacacattgctgcccttaactttgacttacttgcttttaaagatgatgaagctggccaggcgccgtgactcatacctataatcccagcattttgggaggcccaggcaggtggatcacgaggtcagcagttcaagaccagcctggccaacatggtgaaaccctgtctctaccaaaaatacaaaaattagctgggcgtggtggcgcgtgcctataatcccagctactcaggaggctgaggcaggagaatcacttgaacccgggaggcagaggttgcagggagccgagatcgcaccactgcactccagcctgggcaatagagcaagtctccatctagggaacaacaacaacaaaaagattatgaagccttaggaagaacagggatattcacctgctgctgagcccccctccgctttgatcttgtgagtctgcactctcctgctcccctgtctcagtctcctctagctcctgttccttctcctaccttgtgttctctgccaatgatatgactggggctactttcttttttccttctcacactctcttcttgctaatttcaaccaatttccctgcatcatctccacctgcaagctggtcctttacagcagagcttggggccctgctgcccagtagcactctggacaccctcacatcatcatcatcatcctatttttatttattttttggaaacagggtcttgctctgtcgcccacactggagtgtagtagtgcagtagtgcgatcacggctcactgcagccccgatgtccctgggctcagatgttcctcccgcctcagcctctggaataactgggaccatagatcccttccactgtgcctaatttttgttttttgtttttgtttttgttttgagacggagtctcactcttcttgcccaggctggagtgcagtggcatgatctcgactctctgcaaactctgcctcccgggttcaagtgatctcctgccccaccctcccgagtaactgggattacaggcacgcactactgtgcccagctaatttttgtatttttagtagagacagggtttcaccatgttggccaggctggtctcaaactcctgacctcaagtgatccgcccacctcggcctcccaaagtgctgggattacaggcatgagccaccacgcccggcctaatttttgttttgttttgtttttttgtagagacggggtttcaaccatgttgaccaggctggtctcaaattcctgagcttaagcaatcagcctgtcttggcctcccaaagtgctaggatacaggcgtgagccaccacgcggggccttcatcaccctattaatatatactttctgatacttaattgccaggcaataagctaaacccttttattcactgtctcactttaatccttacagggaagtatcggctgccagatagggagctgagacttcaagaagctaaataaggtgtccaacaccacagagcatggagcaaaggacacgggactgcaaatcttcctaactcgtgtgctcatctggctatctcaccagggccttaaatttaatatatcccaaactgaactcatctttaccccttcccactttgcactcctcaaatgtccttgtttaaaatagttacctttatctttcctaacccagaaactcaaaacctggcatcatctttgacttctctctttaccttcacattcaacagtttccaagacttaaaggctttatttgtaggatctctaccactgatcctctacagtttcacacctacatcccattctcgttcccaaatccccataactcctctcctggcccatcccttaacactgaaatcctggcttggaaaatatggtcacattcacagcagctgtccccaagaaggaagccaaggcaacagtatgcacaatgaaatcactctgggagaaactcactgccatgttgtgacaacactatggagacgcccaggtgagggactgaggcttcctgccaacagccacatgaataagattgggaacagatcctccagccccagtcaagccttcagatgactgcagtctcatgaaagaccctgtgccaaaaccacccagcttgatgaaataatctgtacaacaaacccccatgacacaagtttactacaacaaacctgcacatgtacccctgaacttaaaagttaaaacaaaaccaccaccaccaccaccaccacccagaaaaaacacccagctaagccacttctgaattcctaacctacagaaactatgaaataataaatatttgtattttcaaaattagctgggtgtggtgccatgtgcttataatcccagctacttgagaggctgaggcatgagaatcacttgaacctgagaggcagaggttgcagtgagccaagattgtgccactgcaatccagcctgggcagcagagcgaga

SEQ ID NO: 569 - DNA, 2170 bp, Homo sapiens
gggcaatgaggggcacagaggacagtgtgtggctatctctgggtctctgttctcccaggtggaccagtgggggttgtggcgatgctgtccagggtgaggtccagctacggttgccgtcctgtctgtcagcaccagcacccagcacatctgtagggcctgggccccggacccagcctgagggttatgaggaggtttcctgaaggagaaaagccagagtggagtctggaatggagcaggggggaccatggcctgccctcagtctgctaggtggggctggaacctggggttttgcttgggtgtgaagaaggaagaggctggggatgcagctaggtgctggttcctcatagaccgagtcatgatttatggggaccctcaattatatccccttagcaggggccacaaagtctcaaatctgcccagaaatccacacctcggagctcaggtgaggtcttcttcaggttctccctctgcagtgcagatactgtcagaaagagcaagctacaaatggagaagtcaacaacactctagtgagaattaccctgccaattaattttctcagaaatcggggactcagggaccgcttgctgccgaggctgccacctcagctgcctgtctgtgaaatgggtccatgtgtccccatgccttggcccgtctcctcttccctacaacaggctgctgtgcagcctggggccctttccaggccaccttctccatctgctcactgaggagggacccctgagtcagcgaggctccagcttggctgcacccagctgaaaggttatcctgctgataccccaccacttatggaatgatggaccttttccccactggattagaatgtcctttttgtgtatcatcgaccctgaacaacccaagtttgagccgtgtgggtgcacttctacgtggattttcttcctcctctgtcacccgagacagtaagagccacccctcctcctccccagctgactcaacgtgaagatgacgaggatgaagacctttacaatgatctgcttatgctgaatgaatatcttttctcttccttactttactttattgtaatacatgaagcatacaaaatgtgttaaaacccgggaggcagagcttgcagtgagctgagattgcgccactgcactccagcctgggcgacagagcgagactccgtctcaaaaaaaaaaaaaaaaaaaaaaaaaaaagctggaactgtgtagtcccagttcctctgtgtagccccccaagtctgctctatttcaatcttctcttaagggaactccttccctccgtttttcttttcctccatttgatacatcacacttatagatagggcatcttccctaattactggcttcatcctcaattcccgggacccataccttcactggcttcctaaatttatttaataattctcatatacctttgagaagtttctaatgataggcaacaaatgaatattgactacctttcttattttcctttattcaccaaaatgatttttaggatgtagacaatctgtatgcttcaacatacaccaaacttaccatttttgaaatattttacaatctacttgaaaagacttctttagaccctatattcatgtattgtaatatttatcctcttttatggctatactcaaatgccacatcactatagtgccttccctcatcactgatagtataaaaggcaatatttccatttattatcatctgtgcttttcaaagaaactctgtgagtccaacagggcgataatagaagcaactgccctttctctccccctttaaatgcaacccaatgtcaaagtccgtagcatccccaaatgagtgtattaaaggtgagaaattcccaaagtcaaactcagtagcatccttataattgtttatagtagtatgttatgattttttaacttctgtggtatcagttgtaatgtctcttctttcacttctgagtttgttttcttttttcttagtctatgtaagaatttgttaattttgtttatcttttcaaaaaacaattcttatttttattgaaattttcagtttctattatattatttctgctctgatctttgttatttgtttccttctgctatctttgggcttgtattgttctctaattttctcgctcctttaggcataatattaggttgcttatttgagatcttttttttcttttttga

SEQ ID NO: 570 - DNA, 1770 bp, Homo sapiens
aaaatttttagttcttcctggcaattgcatgtatatttttttctgcatgttatttggatgtgaggagctgtcattattattttaggaacaaatatgaaacaatctctggaaaatggaatttgattttgattcaacaacaggagaattctactgtttttctccagcagctccacgataaaagggaaccctgagcagaacacatgcacaaactcatgccataccctaagggacaaggttccccacatctacttggaaatctttgggatgctcaatggagaaaaacaaggagagaaaaatctaaacccagcagaagagaaagtttaagaaagcggtcgtcgccaataccaaaattagctatgatattcaggaagaaaaaaatggaaacacgataaccacagtcaataaagaccaaggccacattccattgaccagagctcagccacgcgccacacctggctaaagagactctggctgaagaattccctgaatattttaatgtagctctaggttataacacagaacaaccacaaggtggcagaagaactccattcttgtaaatctcttagttgcttctttatttcatcttccctattccatctaatgttccctgaattttactattttgttggtttgaaaatatgtgtgacttacgtcctttaaaggatttggttcgtaaggttttgaatagactggaatataaaacatttatagaaaagaaaaatacctacagtatgatgttagtgaactattaataatccaattaaataaaatatatttgctttggattaatacatattttgttttgatgtttgctaaataaaactaagcattaggaggccaaatagccacaatgaacattttcatattatttaataagccagtttcaaggcatacatgctaaatttgttcttaaggaaaagttgaatttttgctttcatttttacacgtgtaaatccaatgtgttctgaagtttaaagtgtcaaaggctgttggatttaaacagatcttgtatgactctctgtttcatctcttcagaggttgatagtaagcaactttggcagcaactcacagcttctgctgtaacatgaggctaataatgacgactttataaggttgttgcaaagagtcagggatgccacaagcaacgttctttatatatgcagaattttaaaaataaagtaaataaaaatattccttcctctattccccatttttctaacattatttgcaactggtgttttaatgcaagaccaaaggctaaaatatacatgtagctagcagaatcaaaacctagatcagatgttcaaaagcatcatgctgctaaaagatttcagagtctaaaacctgtgctcactcttctgaaacatctttccacttcctgtttaaaaaaaaacgtgatattctttgaagctcattttttgggcttcatgtgttgtaattatacatttgttatatagggtatatgatgacttacgctctaaggtattattcagtacattgtagaaaaaggagaataaagaatgttgtttgtcagtaggcagctctgtcctctttatccttgactgtaatttactaaagagctgacaaaattacagcacaggcagcaattcaccatattaccctgcagacagccaagagactgacattgagatgatgcgttttaacttgggtccatgtaaggaacctgatggggttatatgaattcttttctgtactatgaaaaaatgaagttgctaataagaaggaggtacaaaagtgtgtactctgcgc

SEQ ID NO: 571 - DNA, 2541 bp, Homo sapiens
agacggccctatccctgtctcccttggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggtaagtggcctctttttactctcttctccaacctccctcactatccctcaacctctttctcctttctatcttggcgccacacttcaatctctcccttctcttaatttcaattcctttcattttctggtagagacaaaggagacacattttatccgtggacccaaaactccggcgccagtcacggactcggggaggcagccttcccttggtgtttaataattgcgggggtgcctctctgattattcacccacgaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagagctgcatcttgtcccactggatggtcttcagagacaataatacataatggagctgtcatctcctatgataacaatgccttcttctggatacctcctgaaggacctgcctgaggctctttcactgttagtttttttttaataagtagaaggattacactctaaaataataagtgtagtatagtaaatgtataaaccagtaacataatggtttattatcattatcaagtattacatactgtacaaaattatatgtgctacaattttatgtgactggcagcacagtaggtttgtttataccagcatcaccacaaacacgtgagtaatatgacacaccatgatattctgacaaccatgacatcactaggccagggaattttttaggtccattatcatcataggcgaccacagttgtatatgtgatgtggtctgtcattgactaaaatctcattatgactgtacttagtctctaaaccttattctatttctttcttttcttatggctttttcctctataagaactcaaagggggagagaaaaagacgaaaaatatcttcaaagaggagaacaaatctgatctttctctacgtctgcttagttggcgtaactttaggatgtccataagttgtagctttcctgggaaaatttgattttacactggttatcccaacataatattaatggtatcctcttagactctcaatagtgtccggtttggatgacaaattctgtggtctttttagccaactgctactgaagtggtcagatttattgcacaaaatatatttttaaaaataagtagcacaagatgaaatatggcctcaaatttcttggttagtttccactagaaagttttaaacattaaaaagtacaaaattcattacatttattgaatgataaagtataacattgtatgaagttgatgactattaaaactatttgagtgtttaagttttgtcaggttctctttggtgatgtcagttaagtgtctttcattaattcttatatgcctcacttttcctgtaaataacttattaaccacccactactttttttctgactgattaaatggtataaatgtcgagaaaaacaacatgaatgacataaatgccaagaatcagttgaaatgtaaaaatatatttaatacagaggttctgtttatgactccttaaaacatacttaaggaagcacacagttaactaataacagcaattaactaggattggtagaaaacctttattttcttattctatagtccatttgtgaggagcttaatataagaaagttagtaggtcaaactaataatagggcaaagtactgttccaagaacttgtctaatgatgttccagtgccaaaaatgctctgaaaaattgagataattgaagtctttgatcagaagggtgtaaaataatgttggaaataatcaagtgaagatgtaaagctatgactcggtttcccatgctgagcatgttaacattcttcactgtttcttcttgcatgctgtacatggccgacatttttcaaagtaatgagaaacactatttggtgaagttcttttcatctttgctgtccacatgtatcactcccatccaaaagttgcagttgcatttagcagttgcaaaggaaaggattttctcacgtaggcatggatacttgaaggggctg

SEQ ID NO: 572 - DNA, 3084 bp, Homo sapiens
tgttcctctccaccgtggaatggtgtgctggtggatctgcacagaccttgggtcatctcacttttgagggagccccagaacaaaaggctctggcagtttaatggcccctggggctgaggagaggagaaggagggcaggggataagtccctctgtgggtccgctttctccttctgtgaattatggatcatattttccacttcatgtgaaaatatcaaagcagttaacacacgtgcagtgatttttacaagcgttcgcgggaaatcttccatgggctttggccatcagcagtagtcatcttagcaatgctagggcatggtggcagacaccagatactcaaggggcttaggtgggaggaattcaaggctgcagtgaggtatgacagcattgcactccagcctgggcaagagagtaagaccctgtctgcgggggggaaaaacctattaagaatttcaagatggcaacagcagagtgttaaaccaagtgtgagtccctactccaatgtcacttccttggctgaaggaaaaatcagtcctcattgattccattctgtccacagaaccattcatcaatttatattatctttcctagataaaatactttaacaagtccaattactaagctgctgaaaggacatacataaatgtttgtaaataaatagaggtttggaagatacaagatgattgtgacaaatgtctgtccctgaaagatgataatcattgaaaagcattacatttattttgaggaaactggtttttttctcaacagaaaaaaacatatttgtagcagctggaataagaggtaggcatagtatgagaataatacctaatttcatagcaagtccgttttatttcttatgatttgctgttccattgtgattacagtttgttgactagtggccccttcaacctttttatgatttgttcttacaaccaatcattcttctctttcttctacagtgttgattcctcttcctcatgatagcatctcattttgatctagttatctgtttgagctttgctctactattttcttagcattttctcttaacatttctttgttcttacatcagctgttttgcatacatcttaaatgtggttaggtaaataaatgcacagagacctgtcagttttttgccaacagccaggcacctgttcatgtcagcaattgtcaactaatgtactgtattttttgttttttgagacaggttcttgctttgttgctggaatgcagtggcgtgatcatggctcactgcagccttgacctcctgggcttaagccatcctcctgcctcagcctcctgagtagctgggaccacagatgcctgcctgccacacacgggctaaatttttatgttttgtagatacaagatctcattatgtttcctaggttggtcccaaactcctgggctcaagtgatcctcccgcttcaacattccaaagtgctgggattacaggaatgagccactgcatccagcccactgtaattttcacatactcaccaatgctggctctcattgatcatatgaaattatgaaatcacgtgaaaacaatgcctagttcagtccaagggaagcagataccactgttttatagaaagagataatagtaaacctataatcatgtccaaggaagtgatgtacacagtattagctagatgagtgttttctgttacaggtaccatttctggatttgacgggtatattagtcatgcgaaatagtctttgctccagatataaaggaaagaatagaaggcaacatgatgcggtagaaaataatgagctatggaaacagataggcgtgaatttaaatttctgctttacttcttcctactattaagattggacccactgagcttcaatatttttacctgtaatatgaagataatgaaacaaatgtcacagagtattacatactagtttctaacttttttcttccttcgaatcaaaaaagaaaccacatgtgtttaaaatatgcaccactcaacattctaagatggaaatagcttaaagtaccaaatttgagattgatgtatattgggggatggagattattaaatttccttgttcagatgaaacataattaacataatcagtttggaacttttttcatgcctaattcactttctagtccaaaaataatgctgtgcaaattattggcacgttgtttcattttcatgcctaatttaaaaaaaaaaatcttttccttgtgctcaaatgcctatttagttccatttgggccattttctttgaactaaatgcaaatgagggaggttgcatgtatttcataatctccctttaatcaagatcactatgaagcatcagccccctgggtgacgggtgacataaatcatattaacttaattctgtgtgtttcattaaaggatttagtatttttatgaaccagaatatctgggtcactgccatagaagcttcaatcaagctgcagatcttatggagtcaatgatgtgttgcttatttgatgagatgaagatgaagtgcctactcccatctcatactggcctcattaacacatggttgctttaagagttcatgagttttggccaggtgcggtggctcatgcctgtaatcccagcattttgggaggctgaggcaggcagatcacaaggtcaggagatcgagaccatcctggctaaaaaatacccccccaccaaaaaaaaaaaaaattagccaggcatggtggcaggctcctgtagtcccagctactcaggaggctgaggcaggagaatggcgtgaacccgggaggtggagctagcagtgagccgagattgcgccagtgcactccagcctgggcaacagagtgagactccatctcaaaaaaaaaaaaaaagttcacgagtttagaagagacagttgggtcctggcctcaggaaacaaagaagaaatccagatcttatacaatgtgctggacataaaagtataacaatttttgattctcttccccttcaccattgaaatctatggtttctctatatgactgttttctcaacaatccaaaaaggcaaggttggcagcatgcaatctgctgaagaatcctgcctaaatacccttttccacttcacactatc

SEQ ID NO: 573 - DNA, 9203 bp, Homo sapiens
actccctctattgcctctccagacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcacgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttagccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccagggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaagagttcaagaccagcctggccaacgcgacgaaaccctgactctactaaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaacacaagctcaggttagtaagtcattcaacaaacatttactgagcgcttatcaaatactgcatgctggagtggacactggagaaaaaggtgaggagaaggccgggcgcagtggctcgtgactgtaattccagcactttgaggggcagaggcaggtggattacctgaggtcaggagtttgagaccagcctggccaacatggcaaaaccccgtctctactaaaaatacaaatattagccaggcatggtggtgcatatctgtagtcccagctactcaggaggctgagcaggagaatcacttgaactcaggaggtggagcgtgcagtgggccgagattgcacctctgcactccagcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaagcaaaggccggacgtggtggctcacgcctgtaatcccagcactttgggaggccgagacgggcggatcatgaggtcaggagattgagaccatcctggctaacacggtgaaaccctgtctctactaaaaatacaaaaaaattagctgggcgtggtggcgggcgtctgtagttccagctactcgggaggctgaggcaggaggatggcgtgaacccaggagcacaggttgcagtgagccgagatggcgccactgcactccagcctgggcgacagagcgagactctgtctcaaaaaaaaaaaaaaaaaaggaagcaaagtgcccagctgggatggtggtttcagaggccacagtgggagcttcccagagaagggatgattgagctaagtctaagcaaaaggggtggtcagggcagcagctgctccaaaacaggggctgggggcttatgtggagagagaagacatggagagaccatgcccagaaggaggcggcggcttcagtgaacagtgcaggggagcaggtccgaggaggccgcctaccaggggaaggagtctcatctccatcctagacaaaaaaaggatcttttgagatgcattaagcaggggagtcacagattggatttgtgttttgagaatctcctgcttacctagagaagaagggcatctcctgggccctcactgttgccttaaatgatttttattgtgtattacttaaacatgtgcaagcataaaatgagatataaactccttgtagctcttatacaagcatcagaccaagacaaattgacccatcacgtacaaaatcgattcaaatcagattaattttatgtgacatgttattatgccttttgtctgaaaccctgccaccacccacagtgcaattatggcccaaccactgtggtgttctgaatttgtgggacagagaatattggccttttaaacacgtgcatgcatgcatttgcgtgtgcgcacacacacacatcccaaatgattttttcccactatatatgaagaactcctacaaaccaaaaagaaaaaggcagacaattcaagagaaaaatgggggagggcttgcattaaagtacttcataacaagagtacttaggaggccaacaaatacacgaaaagctgctagcttcatgactcatgggggtggcttggtcagttcaggatactgtaacaaaataccttagactgggaaatttataaacaacggaatttattgctcacagttctggaggctgggaagtccaagatcaaggcagcagtagatccggtgcctgagcccgttccctgcttcaaacatggcaccttcttgctgtatcctcacatggtggaagggggaagacagttctctggggcctcttttataagggcagttatccaattcacaaggatagagccctcatgacctaatcacctttcaaagatccccatcttctaacaccttctaacaccatcaccttggtgattaggtctttttgttgttgttgttgttgagatggactctcactctgttgcctaggctggagtgcagtggcgtaatcttggttcactgcaacctctgcctcccgggctgaagtgattatcctgtctcagcctcccaagtggctgggattacaggcgtgtgccaccatgcccggctaattttcatatttttagtagagacagggtttcaccatgttggtcaggctggtctcgaactcctgacctcatgatccgcccacttcgtcctcccaaaatgctgggattacaggcatgagccactgcacccagccgattaagtcttaacgtatgagtttttgggagaaactcaaacattcggacaatagcaaggagaatacaaaaccacagtgagctaccgcttcagacaccagagaagtttaagtgaaaaagactggcaataccaagtgctgatgaggatatggagcaaccagaactctcagacattgctgatgggaatctaaattagtataaccaccacgaaagcatccgtaaggtttaattgtgttgaacacaccctgccctctgaccaagcatttccactcctgggcatacaggcaaaagaaatgcatccacgtgttcatcaaaagatgtaacctgtgccaggtgaggtggttcatgcctgtaatcccagcacatcgggaggccaaggagggaggattgcttgagcccagaagttcgagagcagcctaggcaacaaggcaaaacctcgtctctactaaaaagtagccaggcatgatggtatatgcctgtagtcccagctactcaggaggccaaggcatgcagattgattgaacccggaaggtggaggctacagtgaattgtgatctcgccactgcactccagcctgggtgacagagcaagatcttgtctcaattaaaaaaaaaggaagaaagaaagacataacctggaatattcacaccaacactattcaggatagccctaaactggaaagaatctgaatatcctccggctttagaacagagagaaattatagactattcattcatacaggggatgattgatcagctttaagaataaacaaaccgtacacaacaatatagatgaatctacaaccttaatgtgcaaaatagttcacatatataaaggacaaaaacaggcaaaactactccatggtgttagaaataggggtagaggttaccctcatgcggcaggagggttagtgataggggatttggaagaggaggagcccaatggactgaacagctgagctggaaacagcaatttgttccttaaagttctgaacccaactgttatccagcatggagtctgtctggagaggccagatgtggggcctctcacaggggaatgagaagtgcctctcagggtcccacccatgatccccctttccttgcccacacaaccaccaactggcaagtagtaacccaggacctgtagcccccactggcttgacacagagcataatgcaagcttttcctgctccaggtcctggacaccactttgccctttgccccacacgtacagccccctgaccaaaagctgggtactctggcttgactagagggagctagactccaggaataagtaaggagctgggcttccacgctagagaacaagagcttctctggggaaaggggcttcccatgaagccctggggcactgggagattaatgggcagacctctggcctcagcttccagggaaggggagggtgtgggccaacatgcggtggctacactgaccacaagccgatgaccccagccagcctcaggatgtctcagctctaggcatggtttttcgttttgttttgtcgtgttttgtttttgagatggaacctcgctctgtcgcctaggctggagtgaagtggcaccatctcgtctccctgcaacctccacctcctgggttcaagcgattctcctgcctcagcctcctgagtagctgagattacatgtgcgtgccaccttgcccagctaatttttgtatttttagtagagatagggtttcatcatgttagctaggctggtctcaaactcctgacctcaagtgatctgcctgcctcagcctcccaaagtgcaaggattacaggcatgagccaccatgcccggcataggcatggttttgacaatctgtctctttgtgccctggctccttctccaactcctctttggaggaggcacaggaggaggggtcatttcactgttcctgaaaagtagacatataacctacatgcaactgccaggtgataagggccccatctgtctggcatgacgttggaggtccacaaaggctgattagatgaatgctcagctctggggcctccccacagagctcacagacaggcgtgaaggaaagcaggactcttattagaatatgttcagagttttcactgaagaagcctcctgtgtgggccaggcactgtgctcagtgctttgattcacagtctcatttaattctcaccatttacagacaagaattcagctaagatccttttcaatcaagtctggcaatatctgcctttcaatggcagtgcctagtcctttcatatgtaatatacttatcattatgggtgggtttaagttttatcatcttgctatttgttatctatttgtcccccctcttttgttcctcctttactgccttctatttggttgagacttaataaaatattttattccatcttctctacttactttttagctatgcctccttatatttttggttgctggagtgttacaatatgcattcttcaatatccagtctactttccaataatattacaccacttcatgtataacgtaagaacgttacaaaaatataatgccagggctgggcgcagtggctcacgcctgtaatcccagcactttgggaggtcgaggcgggcagctcacctgaggtcaggagttcgagaccagcctgaccaacatggaggaaccccatctctactaaaaatacaaaattagccgggcatggtggctcatgcctgtaatcccagctactcaggaggctgaggcaggagagttgcttgaaccggggaggtggaagttgcaatgagccaagattgcgccgttgcaccccacactgggcaacaagagcgaaactccgtctcaataaataaataaattaaataaacaaatatatatatatatatatatgtaatgccatcacatcttctccggcctttggtgttattgtggtcatatactttatttttgtatgtcttatagatcccagaatgcattgttatttttactttaaaaggtggattaatttttaaagaatttaagaaaagaaaaacagtctttggactgctggccacaaattctctgttttatttatccccaaatagttttatttttccattttgagagagattttcactgataccattcggagttaacagatttattctttcatcacttttcagatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataatttttttcctgtcttcttctctctcttttctcctctgaaatgccaattaaatatatgttagactgctttatcctgccccacaacttactgaggcgaaatttttcaatcacttctctttgtgcttctgatgacactggtggcccatctggagtggccgctgccatcacaccagctgcagggggaggtgcagccaggctgcacattccatggagccagcaggaactgcagacaggtgggagccccacctcttctgagctagtggggcaggagctccctggatgcagccgcagccacccaagttatgcctgtggacccgggcctcccactgcatgaagcaggcagaaaccccaccccactaggcacagctgccacccaagttgtggctgcagacccagggctccctgggctcctgctaggggcaggagcaggcagaagccctgcc

SEQ ID NO: 574 - DNA, 1714 bp, Homo sapiens
gagccgccgcgggctccgaggagtcggccgagctgctcccgcgccctggccggctgggtcttcatcctcattgtactcccttggcatctcatggtgacgtgacttagaaggtggtgcagagacgtttgaaactattgctttgctgaaaacatctgactgccaggctaggatgtgacacttaagggaccagggatcatttacatactgtggtcttgcattactgcgatgaaatcttccaccactcccaccacccactacaagagatggaattaattgaaactacagccttcaagagacatttggagcaatactcttccagttctttcttccacattttatttgtgggtacagcgtctcccaggatgtagtgtgctgtaattattcttccacccttttattttctgggagtttctctatctgaatagcacagaaatattagtggataggaagggaatataatattctatccatctgaaaattaacacccatgttgaacagaatcccttttcagtttcctgtttactacagggtccaaatctctgagctgagctgtgcagcagataataggagaagaaaaaaagatacctgctcctctttcaaggacgtggacttttctgttttgtgaagtgatacttggataggctactggatattttctcattcttgactcatcaaccttataattggtctaagtttttcccaaatttgtagctctggatttcctgtcactcctagttttctgtgttaaagttttccattttgatatgtatgatattgacaactgggagaggcagtgcccaggggatggtagccagatgccattttgtaccagaagtcttttattatctacatttaatggttataaataatgaatgcctttgttgggagtactttcatttactcattccaacaaactcttagaccaattttccttgagatcaattaaattcaatccctcctgtatgccagactttaaaaaaatgcccaatactaagtagaataaaaaatgtcttttgcttcagagtagtatgattaggactataacagagttgggttgaaaggtctatagtacaccagagtcaagactacgtttgtccttgggaaattggaaaggctactggagaatatgaaacttcagtgaatcttggggtatcactggatatttagaagctgggttgaggggccaggggatccttggcagaaagaaaagcatagtgacatgagagtgcatcatgagatcaggaagtcatgataggttgtaggcaattaagctgaagaggtttatgaggcccttatttgtgtggatagtggacaggtgctgggaatgatggatggcaggaagatctgatactagagcagttaaaattatctaggcaagtgagatggggaaatgaagtcaaacagcagcagcagggatggagggaaagtgacaagtttatgagtctaaactggagagagagaggatgagggaagaagaatgtagaatttgaagattgtttggttcttctggtcttccaattatgttcaagtatatgtgagatgcaatggtcaaagtaataggtacataataaataaaccatttctgttttcagcatctgtagatcaaactttagcttgccttagtttatcattcgtgtgtttagactatgatcaaataaatatattcattttcacactctatttttagtggtactaatatattttttgtgacgca

SEQ ID NO: 575 - DNA, 2824 bp, Homo sapiens
atacgcccccggcgctgctgcggcggctggcttgggagggggtcgagggagcgggagcttggggtgggcttcgggagcgcagggaacggcgggagccgggaggtgacggctagcagcgtgagaaggccgctggctcctgagaaatccccctcctccaggtggttttgtccttttggaccaattatctaacctgggcctggactccatctaccactgtcctgcctggttcactgcagctcacttcatcttcctgtgccttctctgaaagggcccctccaaaagtttcctgggtatgtcccctcaagaaactctcaaacaactgagaaggtgcctcgacatctgatttgccccaaacctctatacactggacatcttctgaataaggctgtgttgtatgttgggacaagcaaagggatggaaatcaagaattctgggttttagtcctgactgtcactacatggctgtgttacttctgctttctaccaccctcgtgcttttgggagggcctgattcagatgaagagtctcctgagagcatggattgtctcagatgaagagtctcctgagagcatgaactgtctcaggtatccgtgtgttcctcagtgtctggcttggtgactggcacacaatcttgcactagatactggcttttgaattaatgcacgccgtgaaagagaacccagaaagtctgcacagctagagcttctcctcaccctgggttctttgtgatttgacttgctggtgatttctatttatcctgctaaactcaactcaggggagccctggaagcccctcctagtacgctgacactggggagatatgatcctccttatcacaaggtatccccagtacctgtccccccaggtggttctccccactctgagtgtctacatctcattcattcctccagtcccagtccttggcacagtgcttggtacagaataggtgccagtgactatttaatgtgtgaatgaggggctgaagctagtgcaaacaggagcttaaagttcaggaaagattggagaaagcgacacttaacaagctccttctgtatgccaggtatatgaaggacagcgcagaacacggcaccccaaaatatgctactttggcataggattattttgagctgacaaccattgagaagaagcagatacatgaaaggctctctgcttgccctctatttgcccaaaagcaagacacaaattttttttttttttttttttgagatggagtttcactcttgttgcccactctttttactcccaggctggagtgcaatggtgtgatctcggctcactgcaacctctgcctcccaggttcaaacatttccgctgcctcagccttgtgagtgtctgggactacaggcatgcaccaccacacccggctaatttttgtattattagtagagacaaagtttcaccatgttggccaggctggtctcgaactcctgacctcaggtgatccgcatgccttggcctcccaaagtgttgggattacagacatgagctgtggcgcctggcccaggacaccaatttgtaaaggtttctcctcctctcctctctaccaagaaggacagaagttaatcactggcgagaagtctagacctttataaacccagagagggcaccagaggaatacgtacgtacgtgtgatgcacatgttaatctatttttcgtcagttgaatttacagggccccagctggaaaatttaggagagtagagggaaaaagattttcttcccctacgcattgtacaaagtccttgcatactttctctcttttaatttttacaaccccttgaggtaaattctactattcccattttacagaggaggaactgaagatcagagctgttaagtaacttactcaaagtcacacagctcatcaaaggagggcctcctattagcgtccaaatataacgttgtgccttctactgcacagtgatgtagggtgggctggagtcagaacactcaattgtagcccatgagacactgctgggtataaggacccctttctttgcctgctgcttgcctgcaacattaccaccttcaccccttgaagccagtttgtctgcatattgatttgatttaggcttacaggacttcagggtctatttccattgtgcttctcaaggaacattttgcaatatttgtttcattcacttcaagttcttaagacttatgttttcccatttatgggtacatggaccaagaagctgatggaatcagtaagtgtattttgctgaaactcttgaccagtgtgtcttacagtgaaaactaagactaaaatcctaagcccccagtcaactgcatggacccactcttggtcaaggggaacccccgagacagccgaaaaacagactacctggccataatgggaaggagggtcagaccagcctcattatacccactcccttttggagtttaggcacaactggccagccttaatgttaaaatagagatcacaagactgacaaaacagattctttgtggcactaagattccagattttaaaccatgcgaggccagggtgaagtcatgcctgcaggccatcaattttgctatgtagcatccttatcttaatttaaaacattcttttttgctgacgccaaattttagacagagccttactcctttaaccaactgtaaattaaagaatatctgaatccacttataacctgtaagccctccacgtcaagatatcccgcctttttgggtcataccaatatataccttccatgtattgatttatgtgtttgcctgtaactcttgcctctctaaaatgtataaaagcaaactaatctgactgcctttggcacactttttt

SEQ ID NO: 576 - DNA, 1695 bp, Homo sapiens
attctttgggatgaattttgcctaaaaaggcattacatattttctatagttctcaggtttcggtttgtgatgtttttgagaaatacttaaattctgaaactcttacagccctcttctgactagccttggggcaacttcagtagtaggaacattctagatgtaaattaaaacattttagcaaggtaaagctattcaaaataatgactcagtttggcagtcagaaagtaattctcctggaagcattcacactggggtattcaccagcaaatgagaaacacttaactagaagattgaaagggaagaatgaaatcattgtttccaattctcagcagctttcacttctattcttccttaactagtcagttcacaaattgttgtgagagaatatagtttaggttaaatcttcaagtcttacctgtagtgttatttaagtgatcttggtatatgtaataaacacacaattgagcagctaattgttgcagcataactccaatccaattgcacattcactttcaggtgccacagggtcttctaagccctggtgaatgctgtaaagcaaatacatctcatttatctctttgcatattccacaaattttaccatataacctatatgtaggaactctcattccatacttatctttagtctgtgtatagagacagaatattgaccgagaatagaaaaataaggctggttagattacctttgtcaagcttatgctacaccctaatggggttcaggacacactatcccaaaatgtagctagacaatgagttctctgagagcaggatccacctatttggttgtaatagttttgtttctataaatgttgaatgagtggatcgatttatcaaaatagagtttatgaacataaaaaattgccttatgcaaccaagtttgataataacaacatgaccttgatattaaactgaaaaaaggcatcttccagtctctactattaccacctctccccaactattatagccattcaaatctctaaccaggctgaatattaaataaaatggtttaccatctgatgttaaggtataaagataagatttttttttttctgaattaaaaaaaatagtccaaagaagaaggaagaagaaaggggatataatgagaatgtaagtatccaagaaatattgactgttttgatttatgtaatgaaattaaaaagtcgaaagccagttttaaagcatttcaaagtaatatcacagaaattaatttgaaggatacatttaatgttttgaatcataacctgtcaagcctggcatgcattttaactgagttttaaaaaaaagcattctgacgctattgtatggacattagagttttaaatacaacagaactacctaagaaataatgatacaatagaaatcagtttcctggctgtaataaagtatttcagttgaaatcatgataaatgttaaaggaaatattttgattatttaaataacaaaattggctgtttgtaaaacctggttaaacctgataacttctagaacaatatttctgattttaactccattctgctttccttaattttgtacagacacacacatgcacataagtttattaaattttcacaaactgaacacccctgtgcaaccaatacctggatctaaaaagagaacattttcaacccaccaaaagcccctgcgcccaggtgaaataaacagccttgttgctcac

SEQ ID NO: 577 - DNA, 5760 bp, Homo sapiens
agtctcttttggagagctgtgaacgtgaccagacctattaattacttaactgaggtgctgaactttgaaaatgaaagttccggtggggagttctgtcctttccagcctggggagctctgtcagggctctcctgagcgtctctttcagcttatcaagctcgctcggggaccgtctctggtgatgtagggagaaggtggagccaacactcagcccactgcccatcagcagtaaggccaaaggaagaggaaattcctcacctattaacatggacaatgagaccatggggaggacagttcaagggtcttctggctttgcaaagggtcagatctggatcaccgaatacatgttggaagatggaatactgctttcctgttaagtccatgtatatggctctcatgcaccattcctgacaagggcagaccagtttttcttcagctaccacagtttccacctgagtggattcttcatagttgtactggaagaaatcttgaagagcattgagttcagggttcccttctgccccactatcagactggggttcctagataaacttgcccctctccaaattttcatctcagagaatggccatttcatgcttctagttgtttaggccccaaaccgtatttttctaatgcaccatatgatatggtttggatttgtgtccctgcccaaatcttatgtcatatcataatcaccagtgttggaggaggggcctggtagaaggtgacttggatcatgggggcggacgtcccccttgctgttctcgtgatagcgagttctcatgagatctgtttttttgttgttgttgttgtttgttttgttttgttttgttttgagacaaggtctcactctgtcatccaggctgaagtgcagtgtggtgtgatagctcattgcaacctcaacctccttggctcaagtgatcctcccacctcagcctcccaagtagctgggaccgcaggcatctgccaccatgcctggctaacttatttttgcatctttttttttttttttttttttttcgtagagatgagttttgccatgttgccagactgagatctggttgtttaaaagtgtgtagcacctcctccttttccccttccccctcctcccagcatgtaagacgtgcctacttcctcttcaccttccagcacaactgtaagttttctgaggtctccctagccatgcttcctgtgtagcctgcagaactgtgagtcaattaaacctcttttctttataaattacccaggcttaggtagttctttacagcaatgtgagaatgaactaatacaccatatctaatccaacagcacatcctgttggatctactttcagaatagattcagaatccaacaacttcttacctctgccactgcaataatctcttacatggaggtcccagtgggtgaatgggaactgaaacccaaccctgctccactggctgagctgtgtacctttctccaaggctgcacccacctggaagaaggggcacccttttctatatataccaagatgccctctacaggcatctagcaacttcccagtagttcgtgttacctctctgctcaaaaccctctcactcagaagaaacgccaaaatctcacaatggcagcactatggaacttggcccaggtacctctgtgatgccatgtccttcagccacactggcctccggcgagctccgcctttacactcactattccttttacctaaattggctaactttcccacatccttccagtttcttcacagggggcccttccctggattgtagcaccccaaccctggtgtgtccatctctttggccctccatagccacatcctcatctactgtgcctaaaattgtgtcccctaaaagttatattcaagacttaacgcctaagacctgtggatgtgaccttgtttggaaataaggtgtttccagatagaatcaagatgaggtcatacaatcaagatgaatcaagatggattcaggtgggcctaatccaaggactggcatcctgatctggaggctgggatgtccaaggcacttgtgggtttggtgtctaacaggagctcggtctttgtttccaagatgatgcctcgttgctaccagagaggatggatgctgtgtcttacgtggtggaaggggcaaaagggtaaaaatgggcctggctggttccctccagccctttgtaagacactaatcccattcatgagggctccaacctcatgacggaaccacctcctaaaggccccacttctgtgactactgccaggttggtgattacgtttcaacataggaattttgggggacacatttaaactgtagcagcaaggagcacaaaggattgcagaatccaccagaaatggagaaggagaaagacctggaacaaattctccctcagatccttcagaaggaatccaccctgctgacaccttgatcttagacttctggccaccgtaactgtgagacaatacatttctgttgttttaagccaccaagtttgtggttctttgttatattagccctagaggaaacaattaccccgtccaccatacaatatgttacttattaatttgcttagggtctgcctccccattaggagggagaggattctgtctgtgtttattgccacgtctcctgtggctggcatggggcctggcacagagtagatgccacaaatacttcctggaaaaatgaataaaagttcactcagctgaacctggtatgtgggtctcccagcacctcctgtggccatttctgatgcatcctccgccactcccacctgcagcgggtgactgactcttcagtgacagaggagctgcacacaggtggcgaaacgcatctcatgtggacgtctgaacctagtgcctgcccaggctgctagatacctgagactgtgatatggtttggctgtaatcccacccaactgtcatctcgaattgtagctcccataattcctacatgttgtgggaggaacctggtgggagataattgaatcatgggggacggtttcccccatactgtccttgtggtagtgaataagtctcacaagatctgacggttttataaggggttccccctttcacttggctctcattttctctcttgcagccgccatgtaggaagtgcctttagccttctgccatgattgtgaggcctccccagccatgtgcaactactgggaaagtgaggtgcagaggtattttgcaacgtgcccacagaaccccagcgagcccgtgttggagttacaactgtgcctcagggagcattctcaggcagcattctcttatgcttcaccgtctcacagatgataaggtttcattcaaggacttacaacagcaacccggagggagcattctcagtggctggtagatgccatttgtactgagcaggacaattaagcccaattctggaaaaattctgctttctctattcaatgcattttataaatgtcttcactcagcacatttaccctactaattatattttgctttgtgatcatggtatgtcatttgcattccttcagcacacactgactgatggggaagagatgttgggtgacccaggcaagccaaacaggattaaagcctgctgtctcaccaggtggataatccactttgaacacttgagaggggagtgttgagatcacaccccttcccatgggacatttttctgggaaataaaatcggtgacaaacaccacgcttgaacactcacattgactctagggtgcaggctgagctcatctggtgcaggggagtaatgcagaggcgaggcctgagtcagcgccaggcacaggaaggggatgcaggatgcaccacagcccatgcctcttaggagaaaatctgggccttctccatggctgtgtctctattaatttgctaaggctgcccaaataaagcaccacacatgggcagcttacataacaggaatttattctcagttctggaggccggcagtctgagatcaaggtgtcagcacagctggttccttctgaggactgtgcaggagaatctgttccaggcctctccctgaacttctgggggtcactggccatatttggcattccttggcttatagaagcaataccccaatttctgccttcatccgcatgtggcattctccctgtgtgcgtgtttctgtgtccacatttttcctttttataaggataccagtcatgttggaggtctaccctactccttgatgaccttatcttaactagttatatctgcaacaaacctatttccaaattaggtcacattctgaggtcctgggggttaggactttaacatatgaattttaagaggacacagtccaacccataatagtaactttgtccctctctctcttttgacacaataatgaccctatgcagggatatttctaggtggctactgtctgtgtgtgtgtggtagggggacttctagtactgttttggattactgttgacagacagcagcctgaggctaggaagcactttggggccatgacttagagcaaagctagtaagttttctcaggaatttgaacccagaatttcatccccatggcactttaatccagtacatttaatggctcagatgaccctggccttatcagcctggtgctctaagcagctgacctaacagtgtgtgcatgcgtgtatgcacatgtgtatgttatgtgcatatataagtgcatacacataatgttggacacagaaatatctctgagaactgtccctttatcacccttcagataaaattattctcagcttgcttagttgcagtgtttcttactttgcatctcctaacactttcatacatttctcccgaagtgcataggcaaggagcttcaacggaattcaatgtcaacctggtcatcttaccatgatttctaggaaaaaatgtgtgtaattggttcatgccctccttctgtacagattacaattctccttttttggcatgaaaacctccatctgtcttttgaaagcacatgtcacttatttattaaagtcctccccaacttgttcaggttgagtttcactagtacctttctggagtattttatacctatgttatagccccatatgttatactttggatgtctgtttacctgtctgtaagactgtctgcataattcatgggccttgtacaaaataagaattcagggactcttgttacaagaaactattaagaatttcaagatgggtcaggcgcggtggctcacgcctgtaatcccaacactttgggaggctgaggcgggcagatcacgaggtcaggagttcgagaccagcctggccaacatggcgaaaccctgtctctactaaaaatacaaaaatgagctgggcgtggtggtgtctgcctgtaattccagctactcaggaggctgaggcaggagaatcacttgaacctgggaggtggaggttgcagtgagccaagatcgcacggttgcacttcagcctgggaaatggaatgagactccatctcaaaaaaaaaaaaaaaaattaagatggagatagcagaaccatataggaagtgtggggtccttgtaagagtgtggtccataaacttggctttgtctgtctgcctggttcatggattgtgactatcctcagttccccagtgcccatcattcaacaaatgttagatgaataaatgaatcaatatgtgaatgactgtaagaataagcttttgatgaaaggcagccattttgtaagcaagacattgctgcttttaattgtccgcagaaagcctcacagaatcactgcggtgagaggaaaaaaagtgtctgcatgcaa

SEQ ID NO: 578 - DNA, 1997 bp, Homo sapiens
ggaagcgtggtaggagaagatgcctgtgcatgccgctcatgtttccagcagggcaatgtagatgcatgtcaggaaagatgattagatagtttagaaccagatccttgtctgagatggaaactgcagctgctaattaagaagagtagagctcgaggaagccgccagctgccagcctggtgctgcctctcctgcaagtgtgaagtgtggctgcatccagaagcactgaaaataattgattagaaagagaaagagactgaaaatgtcataaatgaggagataattggagaaaatcattgtgaagaggtatgaatggatggcaacacaaatggagtaagacttaaagagatataagcctaccaaatgctgacatgatttttgtgagttgtgaagatttaaagaaatctgtttgaataacaatttttgaggctacctataaatttgtgttcattacttccactaagcaaggttcttttgattattctttgatcattgaaatgttttatattttatttaatttacagcaacaaaaataactcttgagaagaaataaatgtgaacctatggagataattatttagtaatgtttgaaatatatgatttagaacatttcattgcacttattaatgagtataagaatattatgaaaacagaaaaataatgagccttgtaagagttcacacaattattttatgtaattggtattctatattcaaggagagcttgaatgcagaaattaaagaagcatatgctcatttgaaaagagacaaatctagtagtgtaattaaagcttgtgccttataacacaataaaaatattcagaaggattttatccttaattgtgacataaaatgatttctaacctttattttttgagtcagaaaaaacggaggaagcatgggttcttctttgctatatgaaatcaaagtaactttacaaatttgaagtgcttagttatctaaaatcatatcatggaaagatatatatttatattttgattgttttatgtatgtaactttttaaagatcagagtgatctgggcaagaaaccagtgctatcagccagtattgcattttgtttacatgtaatagaaatccaactaaacaaggattttattttcatcatgttacagaaagttaggatataggaagtccttccttgtagttgctcaaggaaatcatgaaggaccaagtttattctagcttcctgctctgccacctttagcaagtggacagtccccctacctctcataggcaatgaacttcttcatatccaagcatgtgcttagggcagaagaaagggattggtgagaacaaaaatcacatgccagtgaagtctgttcatcttatattaggaaataatagctcctgcaaatgtcttacttgataggcttctaccactggaactgcctcacatgactaccactagatagaatggaatctggcttgatgagtatttttaagtggatacatttacttcctaaacaaaaccaatattctattaataaaagagaaaggaagaaagattcttgtaaggcagctaatatttctgtcacacagagaaaaacaaattgataatgcagtacaaggttgatattttaaggtagagatttttagcttgagcatttagcatccatttgttcttttaatgtaaatgtcaaacaaaatacaaaaatcgtatgtataattaccaaaaactatttaaaagtaaatttataattcactcaatagagtaatatagattaaataatttttgtaaaatttaacgtgtttttgctttcaaaaaatacaaaagataaaaaaagaatatacagctaaacagtctatatggaaaaaaccataaaagtgtcaaaagtaagatgatggcttatgaaaattacatttttacatttatggatgtgacctgaatgtaaatgtaagtaaattgtaaatgtattataaatgaatgtaaaaaccaaaataaagttgtttattggcaagattgatttaaaaaaaagaaaa

SEQ ID NO: 579 - DNA, 3547 bp, Homo sapiens
atactgagactaaggtagaaaaagacacttccaaagggtgtcaatgacaagagagaaatagacatagagtggtcacttcatttaccaaccctggaaccgcagacctctgggcttcctgataaagaaaatgggtacggccaagaccatagacctagtgattgtcagatgaacaattagacccacagaaccatccaagctacagaggacgcattctgccttcccttggatcctgtggtttgaggatggaggtctaggaccgtggcaggctttttgtcccatgagggaaggccatggagctgaggaaggggaagaacacacacacctaatggaatctcgagagaaagttcagacatcaaaagacagaagcgacagagacccagatggagtctcacccagcctggagtacagtagtatgatctgcaacctttgcctcccaggttcaggcgattctcctgtctcagcctccggagtatctgggattacaggcacgtgccaccacgcccggctaattttttgtatttttagtagagatgggtttcaccgtgttagccaggatggtctcgaactcctgacctcgtgatctacccgccttggcctcccaaagtgctgggattacaggcatgagctaccgtgctcggccatgcctggctaatttatatatacatatatatatatatatatatttttttttttttttttttttttttgagacagagtcttgctctgtcacccaggttggagtgcagtggcatgatctcggctcactgcaagctcgcctcccaggttcacgccattctcctgcctcagcctcctgagtagctgggactacaggcgcccgcatgacgcccggctaattttttgtatttttagtagagacggggtttcactgtgttagccaggatggtctcgatctcctgacctcgtgatctgcccacctcagcctccgaaagtgctgggattacagacatgagccaccgcacccagccttatatatatattttttattagtgaagaggtttcgccatattggccagactggtctcgaactcctgacctcaggtgatccacccacctcggcctcccaaagtgctgggattacaggtgggagccaccgcaccctgcctaaaatgcaaaagattttgaatggcgagaatggcgacatgatgccacaagtggaaaattccacacctggctgcatgtaatgggttgaagtcaaaatgcagtcaaaaactttgtttcatgtacaaaattattaaaaacattgtataaaatcaccttcagactatgtgtatgtgaaacctaagtgaatttaatggctagacttcagttgcattcccaagatctctcattatgtatatgcaaatattttgaaattcaacctggttccacacattttagataagggatactcaagctgtaattaacaaataaacttttcacagtccaagcagccaaaggcccactgtccctgttccctcagctcacgcccccttccgtgcacagccttatctaatccttctacccttcgttgtgtttggacttcagactctttttttttaagacaaagtcccgctctgttgcccaggctggagtgcagtggcgcgatctcagctcaacctctgcccccaggttcaagcaattctcatgtctcagcctcccgagtagctgggattacagacacccgtcaccacggctggctaatttttgtatttttaatggagacggggtttcaccatgttggccaggctggtctcaaactcctgacctcaggtgatccgcccccatcagcctcccagggttttgggattacaggcgtgagccactgcgttcggtctggacttcagattcttgagctggctgcaagactccaggtcccctgtgaaccacactcaataatccctccctaatcgctggtccccagcagctcagattggctgctgtttgtccagtgaggaggtgggcaagggtgcccttggtttatgcccatgataaaaagaaaagcagctatggtgcagtagatgctcagaactccagcgcgcatcagcctctagagaggggcctggcctctgcttgaacagtgtatttctttctctccttcctggacatactgcaatcaaagcattttctaagagtcgggtgggactccacagatggtcttgtccaatagcctcactttgcaggtgagaacaatgcatccaggccaagcgttttttcattttactgcccgctactctccaagtgcagtctcttaacagtttctgagtctgaatgcaactcttgttaactgctcagtaaaggaattctgtcaggaaagctgcagtttacatcagtggttctcagccttgatgacacattgaaatcatctggggagatttacaagctactgacacctgggtcctgctcctagcggttctgatttatttttgtttgtttgtttgtttttggagtttcactcttgttgcccaggctggagtgcaatggtgccatctcggctcactgcaacctccgcttcccgggttcaagcgattctcttgcctcagcctcctgagtagctgggattacaggcgcccaccaccatgcctggctaagtttttgtatttttagtagagacagggtttcaccatgttggcctggctggccaggccagtctcgaactcctgaactcaggtgatccacccgcctgagcttcccaaagtgctaggattacaggcatgagccaccgcaccaaggctactgatttattttaattagggtgcagcatgagcactgggatttttttactccccaggtattcccaatatgcagccataattgagaaccactagtcaatatggagtgtgtgtgtgtgtgtgtgtgtgtgtgtgtgtgtgtgtgtgtacatttctaggtatgggtgatatttgcatgcagcacgtatctgtgcacatagacacatacacacacggaaatctggacttcccaatacacagagtaatacatgctgaggtcaccagcaaagcaggacaataaagaaagtgagaaaaaattttgagagccagacacggtggctcatgcctgtaatcccagctttcagggaggcagaggcaggaagatagcttgatcccaggagttcaagatctacctgggcgatatagcgagaccccgttctccacaaaaaggaaaaaaaaacaaagaaaaagtttttagaacatgatatttaagaaacaaaaaagtcatcatggagaaaataacattttttttttttttttgagacagagtctcactctgttgcccaggctggagtgcagtgacgcgatctcggctcactgcaacctctgcctcccgggttcaagtgattctcctgcttcagcctctcgagtagctgggattacaggcacgtgccaccatgcctagctaatttttgtattttcagtagatggggtttcaccatgttggctgggctgatctcgaactgctgacctcaagtgatctgcctgcctcaccctcccaaatgttgggattacaggtgtgagccactgtgcccggctaaaaatcacattctttattg

SEQ ID NO: 580 - DNA, 1728 bp, Homo sapiens
aggtgggcagcagggcccttcctttccccacaggcagggaacacttgtgtttcctttgtttacttctttagcttatgtcttccgcgatgaaacggtaacttcctgaacgctctgcagttcatcgctacactcttcctccatatctagaacgtggcctggcacatattagatgctcaatcatcattttaaaataaacgagtagtgatccattcaagtaacgtggataaacatcaacaacaacagctgctttcaggaaaaaagggcagactctgaattatgaagaatgtgagaaacttagatcagtatcatgaagattgtgtacttttactttttagggcagctttattgagggacaaatcacccattttattttttagttttactgaggtatgattgatataaaaaatggcacacatttaaggtatacatcatcatgagttaagacatatgcatgcgcccatgatgccatcgccataaccaaaggttaaatatatccattaaatatatccatatctccagaaattgccttgtgctattttgtaaatcatccatttaaaatttataattcaggctgggtgcagtggcttacacctgtaatctctccactgagttcgaggcaggagggtcacttgagcccaggagtttgagaccagcttgcacaacatgataagactgtctctacaaaaaatttaaaaattagccaggcatggtggcgcacacctgcagtctcagctattcaggaagctgaggtgggaggatagcttgagccagggaggtcaaggctgcagtgagccctgatcataacactgctgtccagcctgggtgatagagggaaacccccatctcaaaaaaaaaaaaagtgctaatttctactagacttctcgttagttactgtatcagaagacatgtaaaaattatagggcagatcatgagtgttgaaactttgaataattgtatttccccaagtgtttatttttgcaatctcttgttataatttgcaccacttccttcccccagattatgtttgtgcttgtttgtactggagagcatggaagagctcacaggagaaattgtgcctccttcgccatccaggggatgttgtataggaatcaagagcttggtagacagaagtcttagaggcggagctgcctagattcaaattctgactctaccacttcctagctgtggcaagtgactaaacctcctacctaagagtcacgcgggctggagtacagtgtcatgatcacagctcactgcagcctcaacctcccaggctcaagcaatcttcccacctcagcctctcaagtagctgggaccacagttctgtgcattctgtggcaagacaacaaatagatgggatgatttctgtggaagtctacaggtgacatttaatcatggctacagtatttcatgtgagcacaaagaacaagccaagactcatttggggaaaaaattaatcattcatctaataaatgtcttttgaatgcctgtcataaccaggaacagagccaggtacgtgatgaacaaataggctggtccctgccctgatgaaagttataggctagtgtggtcacagactatgaacgaataaacaaatacatatagacaagtcatcatccctcatcaattattttgatatcacaaagactctgaaaagtatttttttaacccctttagcagtaaaacctaatttgtattaaaataaagcattatttatttgtctatcca

SEQ ID NO: 581 - DNA, 8508 bp, Homo sapiens
aaacccccctgtgcaagttaccttatctgtgcctgttggctattctttggtttgaaagaattcttccaaggatccaccctaactgcctgcctgactcgtttcttcctttcccctctcagtaagggagatgtttcctattatccttgataatgtgccatgaacatatgaaaaaacatagaaacatgaagaaaacaagaagacaaaaatcactaacatctggttggctgtatagaaacaaagctgattctggtctcgctctataccccaggttggagtgcagtggtaagatcacagctcactgctgccttgacttcctgggctcaagtgattctcctgcctcagtctcctcagtagctcggactacagcttgcaaatggatcttacagacgttgtcacagagacaagaaaagcatataaaaaaataaataaagatgagctcctttcaaggtgactgactagaagcagctggtgtgtgctgctctcacaaagagaagaaagagtggtgagtggaccatccaggtggacacattgggattcatcaaggaaacaatacacagaaaacagaagaatgagacaggacaatcattcacccagaagtggcatagagccgggagatggccctcaccatggttagtaagtgagagtccccagggagtcacatttctgccacagacctttgcaaccctgggcccaggcgatcccccatgacacccgtgccccaccagggcctctggactgacatagacagctacatggagtgtgggcagaactgccactcaggcactcatgaaatccttggagcttttcatccccaggcaccctggtaccaatggctgcagctgcggcaatgggggaggacaggctctcttgcatgtcctcagaataggaacacaatccatggggctaagcagtgggtggactgtggggctcttctacacagcccgttgccagactggcctgggatcctagcatggtcacaaaagtcccacctgggctcttgaggaacagatctgtacttccctggcatggaactcctggaggggatgggcaggctgctgtttttgctgctccacagccctcactcctgttgccctcagtcttgggagtgagcacagtgattggggactaacatagacccccagcacagtgtacagacttgcagaaaagcagccagactcttttccacatgggtcctcacccctgctactcttcactgggcagcacctcttgaccttggcccccagcacaaccaacccgcccccacatgaacgctttgtcagtgatggctctgtgtttctctgaggagaaaaatccaaaagacaatccataagccttctgctattgcagctgcagtggtatggcccttactaccttcaggctggggaaagaacgaaggacttggtccttacactggcccctccagcacaccatcgccaccatatggagaagagcccagtctctcttccccgtaagcccccactcaccactgttcaccaggcaaggcccctagttggggacagcagagcagctgtcctacccccggatgagaattcccactgctattggctctatattttcctgaggtgggcctcccagaagcaattgacatcccctctgtcactgtcatggcagcagttctgcccttactgcactcagactggggaaagaacaaacagcctgaggtcttcactcacactcctagcacaacacagtcatgatatggagaggagcccagttgttcctcctggtgagcccttgacctcctacttttcatcaagtgaagcctccagcttgggctagcagcgtagccaccccacccactggctgaacattctcagtagcaatggcttgcgtttctctgaagtagggctcccagggacaacggaaagcacctctcccactgccactgcagcggtactgccttgctgcccttggactggggaaggggcagagaccttgagtgcttaacccacatgtccaggaagtgacagctgccctaaggagaggaggccagtctgtctcctctgtgagacccctgccacccttgcgcatcaccaggcagggcctccaggcatgggttcacaatgtagctgccccaatcccaagcccatctctccaattagtagtggctctgcatttctctagggtggagccccaagagacaagtgaaaggccctctgccacagcaactgccaaggtcccttcccctgttgccttcaagctggggagggaaaataaagccttagctcgcccctagcagcagtgtgcagcccaggagtgccaaggccagaccttaagccagcactggagtgggaaagggagcccacactttcagagcactgagagggagcatggctgcaatcatgaagaaatacagaggagccacgtggtggagcaagagcccacctactggccattacacttcagtgccatctactggatcatagcccaaactccaactccaaaaatgcttgctaatatacccccctctgtgaaaacaacgacaagatttcaacaacaaagaccctgcacaaaacctcggccctcaaaaaacattcaaaaaaggagtctgcactcaattacaccacagttaaaggagcatcagcccacacagatgagaaaaaactggtgcaagagctctaacaactaaactacagtgttttctttcctccaaataactgtactagttcccaaggaagggttcttaaccaggcagaaagggtggaaatgacagagagagaattcaaaatatggataggaataaaggtcatcaagattcaggagaaagtcaaaacccaatccaaggaatctaacaattacaataaaacaatacaggagttgaaagacaaaatggccattataagaaagaaccaaactgatctgatagagctaaaaaacacactaaagaattccttaatgtaattgcaagtattaacagcagaatagaccaagctgaagaaagaatctcagagctcacaggcaacatctctgaactcagtcagacaaaaataagaataaagaagaatgaacaaaacctccgagaaatatgggattatgtagagaccaaatctatgactcactggcatccttgaaagagaggaggagaaagcaagcaacttggaaaacatatttcaggatatcatctatgaagacttccccaacatcgctatggagaacaacattcaaaatcaggaaatgcagaaaatccctgtgagattctatataagaagaccatccacgagccacatggtcgtcagattcttcaaggccaaaacaaaagaaaaaatgttaaaggaagctagagagaagaggcagatcacctacaaaggaaacctcattaggctaacagcagatcattcagcagaaatcccacaagccagaagagattaggagtgtgtattcagcattattaaggaaaagaaatttcaaccaagaatctcatatctagccaaacttagtttcattagcgaaggagaaataagatcctattcagacaagcaaatgctaagggaattcagtaccaccagacatgctctataagagatcctgaagcaagtgccaaatatagaacagaaagactgttactgaccactgcaaaagcacactaaaaacgtagaccattgacactgtaaagcaaccacacaaataaagctgcataataaccagctaacagcacaatgacaggatcaaatcagcaaataccaatattaaccttgaaagtgaaggggctaagtgccccaatgaaaagtcacagagtggcaagttggataaagagcaagaccctggccaggcaggtgactcatgcctgtaatctcagcactttgggaagctgacacaggtgaatcaagaattcaagaccagtctggccaacatggtgaaaccccatctctattaaaatacaaaaattagccctggacatggtggtgctcatctatagtcccaggtactagggaggctgaggcgggcggatcagttgaacccaggaggcagaggttgcagtgagctgagatcatgccactgcgcttcagcctaaaaaaaaaaaaaaaaaaaaaaaaaaaaagcatgatccaactgtatgctgtcttcaacagacatatctcacatggatccataggcttaaagtaaagggatgaagaaaaatctaccaagccaatggaaaacagaaaatagctggggttgacagtcgaatttcagtcaaaacagactttaaaccaacaatgatcaagaaagacaaaggaagacattacagaatagtaaagggttcaatacaacagaaagatgttactattgtaaatatatatgcatccaacacaggagaatccagattcataaagcaagttcttagagacctatgaagagatgtagataactggacaataatagtagtagacttcaacaccccacagacagtatattacacagatcactgaggcagaaaactcacaaaaatatccaggattcaaactcaacattgaccaaatggactcaatacacatctgtagaactctccaccaaacaacaccagaatatatattctactcatctgcacagagcacacactgcaaaagagaaaacacaattagccataaaataatcctcaggaaatcaaaaacaaacaaacaaaaacaaaatcatacaaatcacactctcaaaccacagcacaataaaaatagaaattattacttaaaaaaccctcaaaaccataaaattacatggaaatttttaaaagccctgcttttgaatgacctttgtataaacaataaagtcaaagcagaaatcaagaaattttttgaagttaagaagaataaagatacaacataccagaatctctgagacacagtaaaaacagcattaagaggggtgtttatactgctaaatgccacatcaaaaagttagaaagacctccaattaataatctcacagcacacttagaagaactagagaaatcagagcaagcaacctcaaagctagcagaagacaaggattaacaaaaatcaaagctgaatggaaggatattgagaagcagaaaactgtacaaaagttcaacaaatataagaattgatcctttgaaggaatagattagatagatagacccctagtcagaataataaagaaaaaagggggaagatccaaataaacaaaatcagaaatgacaaaggtgaacactaccactaaccctacaaaaatacaaaaagcccctagaaactactgtgaacacctaaatgcacacgacatagaaaacctagaagaaactgataaattcctgaaaacatacaacctcccaatattgcaccaagaagaaattaaaaccctgaacagaccaataatgagttctgaaatttaatcagtaataaaaagcctaccaaccagaaaaatcccaggaccagatggattcacagatgaattctaccagacatattaagaagacctggtataatccctactgtgaatattccaaaacatttaggaggaagaattcctctctaattcattctatgagcccagcatccttctgataccaaaacttggcagacaaacaacaataaagaaaactacaagccaatattcctgatgaacaaagatgtaaaaatcctcaacaaaatattagcaaactgaattcagcagcacattgaaaagctaaatgaccacaatctcttaagctttattcttgggaggcaagaattggttccatagaggcaaatcaatcaatgtaattcattatataaacaaaactagaaacaaaaatcacatgatcatctcaatagatgcagaaagggcttttgataaaattcaatgtcccttcatgttaaaaactctcaacaaagtaagcatcaaaggcacatactcaaataataagagccatttatgaaaaattcacagccaacatcatccagaatgggcaaaagctggaagcattccgcttgaaaactaaaacaagacaagaatgccctctcttattatttttattaaacatactactggaagtcctaagcagaataattggccaaaagaaaagaaaaaaaagcatccaaatgggataatagaaagtcaaataatccccttttgcagacgatatgattctatacctagaaaaccaaatagtccctacccaaaacctccttgatttgataaacaatttcagcaatgtttcagaattcaaaattagtgttcaaaaagtagcattcctatatagcaacaatatccaagctgagagccaaatcaagaacacaatcgcattcacaatggccataaaaacaataaaatacccaggaatatagctacgcagggaggtgaaacgtgtttacaatgagaattacaaaacactgctcaaataaatcagagatgatgcaaacaaatggaaaatccccccatgcttatggataagaagcatcaatattgttaaaatggccataatgtccagagcaatttacagactcaatgcttttcctatcaaactactaatgacatttttcacagaactagaaaaaaaaaactattttaaaattcatgtagaaccaaaaaagatcccaaatagcaggcaatagtaagcaaaaagaaaaatgctagaagcatcctgttacccaactttaaactatactacaaggctacagtaaccaaacatcatgggtttggtacaaaaatagaaatgtaaatcaatggaacagaatagagagctcagaaataatgccacacgcctacaaccatttagattacctttgacaaagctgacaaaaacaagcaatggggaacggagtccctatgcgataaatggtgtgggataactgactagccatatgcagaagattgaaactggatcccttccttacaccatatacacaaatcaattcaagatggattgaagacttaaatgtaaaacataagactattaagatgctggaagataatctaggaaatagcattctgggcataggccctagcaaagatttcatgacaaagatacaaaaagcaattgtaaaaacaacaacaaaaaacggacacatgagacctaattaaagagtttcagcacagcaaaagaaactaccaacagaatgatatgatttgactctgtgtccccacccaattctcatgtcaaattatagttttctcagtgttggaggaggggcctggtgggaggtgattggatcataggggcaaacatcccccttgctgttctcatgacagtgagttcttatgagatctggtggtttaaaagtgtgtggcacttaccccttcactctcttcttcctgcttctgtcatgtaagatgtgtcttcttcctcttcactttccaccatgattgtaagtttcctgagacctccccagccatgtttcctgtacagcctgcagaactataagtcaattaaacctcttttctttataaattactcagtctcaggtagttctttatagcaacacaaggatagacaaatacatagagtaaacacacaacctgtagaatggtgaaaaatatttgcaaactatgcattcaaaaaaggtgtaatatctagaatcaataagaaacttaaacaaattaacaagcaaaaaacaaccccattaaagagtgggcaaagacactactcaaaagaagacatacatgtgaccaacaagcatataaaaaattcttaatgtcactaatcattagagaaatgcaaatcaaaaccacagtgagataccatctcacacctgtcagaaggactattattaaaaagtcaaaaaataacagttgcagctaaggttgtggagaaaagggagcacttacacactgttgctgggaacataaattagtttagccattgcagaaagcagttcagagatctctcaaagaacttaacacagaatgaatgaccagttgatccaacaattccattattgggtatgtactgaaaggaatataaatcattccaccataaagacacatttatgcataagttcactgcagcactaattacaattgcaaagacatggaatcaacctagatgaccattaatagtgcactggataaagaaaaagtgataaatatacaccatggaatagtatgcagttataaaaaagcatgaaatcatgtctttttcagaaacatgtatgctgcaggagaccattatcttaagcaaactaaagtagaaacagagaacaaaataccacgttctcatttataaatggaagctaaccattcagaacacatggacacaaggaagagaatgttagacaccaaggcctacttaagtgacgacagtgagagtggggaaaggattgaaaaactgcctattgggtactatgcttattacctgggtgacaaaataatctatacctcaaaacttcatgacatgctatttacctagataacaaacctgttcatgtacccttgaacctaaaataaaagtttaaaataatcctgaaagtaggtaactaaagtttagagaaaaactataaaggagatcaagagataatctagttaatggaactgaaataaaaagtattcaaaataactccacttatatattataaaatt

SEQ ID NO: 582 - DNA, 17978 bp, Homo sapiens
agcggccggtcggattaaaagtaaccagactcgtccagaaaactgcgtccaggaaggaagtgacagaagacgaatgggaaaaggagaacagctcacagcgtttgaaacatcgcgtaaaaaagactgggggtggtgggggcgggggggattgaaggatactgggaggggaggcgggggtggtagggaagacggagcacgaatggttggggttctaagcagcacgtccgatgaaatgtcttttgcctccttttttccccctttatttaattttgtccttgcctttgcttcgcgctgcctttttctctccgtctctctctcccccacaatcccaaaccgttgactctttcctcgcgagctggagaaatcatcagtttcactcttgcaaaaggggggcgggactagacctcggagcattttaataaaacaaacatacagcagctccctcctcacccctccagtctcaactagattgataaattactccactacactactttaattatgtatatggtatgcagaataaatcactgaacatcagtacctcaatcaagcacttttaaatgataattgcatcttggtgaatcaatctttccattcctgacattttgctaattttagttttacggtggggtaatagcacatgccatacgcaaacctaatgacaattctttattgcacgaaatgaagacaacacggcgagctgcggctccctgctcctctcgcggcgcctctgcggaggacgctcggagagaacctagtctcccgctgcggcgcgctcgcttgctctccggggacgctgcgagccagccagcaggaaagtccttctaaagtcgggatctttcctctgaccaataggagcgcgaccctaatagttgctcttgtgacttttcccccttttggacacgcgttagccacttctctcttccaccggtcggtgcgctcctccgttactcacgcgtaaaaaccacggtccaggatgtctgcagcactcgattccagcgtgcttttcctgcacgcccagaagtcgcggttttcaccctgagaggttggagcgctagaaagcgagccgaaaggtttctctaatgttagtaatgtacgaaataataaaataattaccagtatttgagatctcgacttcatcgcggggccatgaactttctaatcagtttggaaatatttaccgaggaagcagcttcctcggagttccccccctccccccactctatcttttccacaccttactggacttcatccaggtcattaacatgtaaaccaaaccaacttcccaaatgcattaggctaccctagccgatagctgatgacttcacttatcctgaagagtttcagctgcacaggaagcagaaatagagactgataagggaggatacttatgttaaggttaaagcatgataaacacttttccttacaaaaaaaaaaaaaaaaggctttaatatttaggctactagagattgggcacctcccgccctaaccaactgttaatatataccatgcccaataaagccaaagataaaatacatcaactagtatagaatcatgaaaagacaagattgcatgccagtagaattatagattacataaaatgtttaaaccaaactattttttaaaaaatattgtgaaagcaagaagggaaaattaatagaacatggaatatatgagattagacaatagtatattgaaatatctagctaactaaagatttcctcactttagaaaattccttttagcactacgtttaacccaatgactagttgtatttcctgttaagttcagcaatatgcctccagatgactattttaatatatgaggacagtatggttcaaaaagcctcctgcttcaatgtaggaggtatttgatgtgagtagcttctctcagaagagtggcctcaacatttaggcaactgtcccaaggcttcacttgaaaggggaaggtttattttataggcaagtacaactagatctgaacaatcttcaagttccagctcatcattgtgactatcagcaaaactaagaccattccctcccttttattataggaatgcatcacaaactgtcacaaagcaaaaaccatctgaaatagtagtatttcttgcagattagtatttacaatgtattttgtttgccggtttttcaaatgttgagtttgccattaccatgaattcattttaataatatggcagagaacatctgtatcaggtttccattcaaagtacaacttctctgaaaatccaaaaatttaaagggcaaagatatttcgaatactaagatatgtctatatatggtggtaaaaataaaattaattttcttcaagattcacgaaggtcctgaaaaagcaaagcatttgaaggaccatctaagtttattgccataatacctaaaattaatgcagtgagttacaacagtctatttgacatgagcaaacacatagccaatacatgaatttcagccctgctgtttttaatgaattatagagggtatttctgtttaccacagtacacttcagttttagatgttctttcaaaaagaaattattttattttaccttttcatattttaaataattatttaataatacccattataacaaacccataattattaatgatactgcaagcattcaaaaataagtataaccccacactggataatttgaaaataatttggatctggaatgtatcacagttggccttttaaaatacaggattttcccctcagcagatttagcttcttaattatgtgtgacctaagttaatattaccattagttttcttcccatgagcctttacagttgaagcagaagagatatgaagaaatatacattagaaaatcacctgagatttaaaattattcatgagtaatccacaaagtagttaatccagagtgtgctttgtattctttaaatacttctggacttttggtttctgtttctgtttttgttttttctttaaaatcatcctgatccttgccatctaatgatacttggttaggatcagactattttctcatgtagggaggagcttgtactaggtgtcaggagacctggattctctatctagttcaaaatttgtgccttactaagggatttgtcctttctaggcttcagttcgcttatgtgttaaatgagttctgtaacctattccagttctatcattggaaaacagaaaatgtttctaccctttaaaccaattggaaggtagggtctatccagttaaataataggtgacaattcctttaaaagaaaattatgtctgggattgatgtactactgtaccagcttttatttttttctaatcaccaaatatttctcctacattaagttgtaaatgctttattgttaatgtaaatatagagtcacttgtttttccctcaaaagaattatgtttagcaatatatttaattaaagtgtcatagaagttacagagagcatgctcctcgggattttaactccagggaaagctaatattgcaatttctgttcagagctgcataccatcttactccaacctcctctcttcactacttccctacattaaagcagcggtccactaaagccctgtgcactgggtctgcctgcttttaagcctggcccacgctgggtgtagctcttgaagtgagctttaaaaattattttaaagtgaactggggcggttgccacagcaacccaccctgagatgaagaaaggctatagattaatgtaccccttaagattattcaactgtatagtatttgttcctcagccagaatacttttaacacaaacatgataagtgaacatggtggtttagaaaaatctaaaaagcagtgaaacacaaattccaatagcattacatattttaatctttgtctaattatagtattgatgatacacaggacttcccatgaaatagattaattttataagatacagtacttgcaaaagtaggccctgaaagatgacatgatctttaagcaaaatgatatgtcattgcttataatataaagtgtatggtggtcatttaactctttattattgttatacacgtctattctgtaaatacctaaggccaaggagtttggcagttttacctttatggtaactctgtggtaaatgataaaaacaaatgtgagcactcaccacatacacttctttactgccacaatcatttgccttccgttctttacttcatctcttcatagaagttacttcacagtttgcaactcttctttggcaccttcaaatgtggaagtgcaaaacagtatatagtattttgttaatgctgatatgaaaatactttcaaatagatttatttctaaaacttctaatctgaagtaacaatattctgattttaaaccaaagtgttttgaatataagacaactgaaattgtcatgcattgtgataataatctttaacataaatagtgccaaatatctaaatttcaaaaattcactaggtgcagcattaacccaagaagaatatacagcatgtggaatgtctgtgattgagaatttgcaatatacaaaggatttgttatttcaagacaaggtttacacatatctaaggattctatgtttatctgtatttctgtaccttcagttttatatctgatagagaattacagaagaatgtcaaatccattatatccgaagctaacacaatttgtcaaatcgggaaatgtttgcaatgcagttgaggttactgaaagggcttattttatgcattgcctaaaggccaatttaaaatactttgggattagtgatgtgtattcagtacggtttataaattctattaccaataataccttatttttccaagcagtgtttaactatactgagcacagacaaatgctcctgtgttctgatttctgttttagtctggctttccatgactttgtgcacacaaatgaacctttccttggcttcagactgaggctagtcccagaaagagaaccagccttgagacacatcagaccaggatggtcaatatctcttttcccatttgtaatagcaggaggactttgcatagtgaagaatcatttataaagcctctatatttgggttgacatctctgaggtttatttttaagttgcttcagagtcaaagagaaatgaaaaattttggccagttttactttatgggtgttagttgagtttaggtttttaggcttaggcccacagtgagtgagtccaaacttggtcttgtagtcactaccaagtgatttggtgagttctctttcttccagttgtgcttcattttacagtctattaagtgagaatcataatacacatctcccagggcctattcaccttatagaaatgcaatcttcatgaaataacatctgaaaggtatggtaaggttttttttttttttttaaacgacactacaaattatgatacatttctttcttttcctgtaatcagtatgtccaaataaggcttgatcagtaatttgcttgcaagtgtgtggctgattcaaaaataaccacatgcatgaataaatttaatgcgactttacctttacttacaaaattgttaaatgttgttcatcagaacattgattctatcccatttcttgaaatatcacagaaaccttcaattcaaggaatggattttcacacttccccttttaactgtttcttctagataccttactatgtgtgtgctttttcattttaaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgcgacgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttggctaggaaaaagccacaaagtaaagcaagaagtagggtattcaggataaaacacacactttaaagacaaaacagaaaacttcctttccccttgtaccccctttatttgttaacacaggggaacggttctgggatgtcttacaaaaatgctgtcactaaatgcagatatctgtgctgttctttgacctgtctggcattgtggaatactcaattacatcgaaggtgtaaaaacgtttatgttatcatgttcttgaaacatttagcggctaccaagatggtagctatttaaattaattaaaataagataaaataaaaataaattctgtccctcagttccactggccatatttcaagtgctcaatagccacatgtggctagtggctcccttactggacagcgacatgtcaaacgtttccatcactgcataaagttctgctggagaatactgctatagagttcaaaatgaatgctggttaaaaaaagaaagaaagaaagaaattactttatgactgataccagccacattttaggacactcttggagtttctgttacttggcactagtgtgagaagctttaaagtcagactttcagtatcttcctgctgaaagagaccttggggaacacttcacccagacacctaatttttttataggcaagagaaatcaggcccagagaagttaagtgatgcccccaaagttatgtcataaatttggaaagaagataaggtcccctaacagggtccagtatactttgtgccagacaaggacatctttctaggcaaattcatcttacagaaagtcaacttgactgaaaattttaggcaagagtacccttttacaagaaaaaatactgctaagtattcctccaggaagaaattccatttaacaaagaatgaggagcatggggaataatactatctcccaaactaaaaatgtattattggtagtgtcatagattcatataatgccttttctaagaggctaattgggataacactgtgcttcattctactttaaaaattctgaggaaatgggattatcctcttaaagagctaaaaagcattcttaaggtcagggaggaaaggtgtcacctaaagtgaaaatttttagcaaagcataatctttctcaaatttgataaagatatcggagacattgattatgatataactaggatggaattggctcagaaatgttaataaccaaccaaccttttttttttttttttttttttgagacgcagtctcgctctgtcgcccaggcttgagtgcagtggtgcgatcttggctcggctcactgaaagctccacctcctgggttcatgccattctcctgcctcagcctcccgagtagctgggactacaggcgtccaccaccacgcccagctaatattttctttttttgtatttttagtagagacggggtttcaccatgttagccaggatggtctcgatctcctgacctcgtgatctgcctgtctcggccacccaaagtactgggattacaggcgtgaaccactgcacccggcccaaacaaaacattattacaaattacactatctgaaacatataaggcaacagaatacatcataaagatttagacaaagcataagctttcttattagttttattgttttgttttgttctgtcttttgggtttgttttgtttttaatgccatgtttgtattctatatatcttattgttaattaggagtgaactgttggtattaattctgctcttttatagtagttaccttttaacttaacacttagttaaggatccccgaagtgtccaaataagagtacttatgaatattaaataattttaaattaataacaataaattattttaaaagtgtagatttacatttttatttgaattattgtctttattgctcttcttaatttaccatttgcgtgtggttcagcattcttcccattctccctaaaatccagtatccttagagaaaatgtttcacttcttcaggtgcttgtagacatggaagaaggcctcaccttctccatggctgacaaccgagaaggctggtctgacttggaagaagctgtgtggccaacagccaattggctgtatcacatggtaactgtttgattatgcatatggtttaaatctccctttgcctcagtttcctcatttgtaaaatgtggaacaaaatgtgctatcctcaaaactttgtttaaggattaaatgagctattcagcataaagcacagggctggaaaagtgacaaactgcggtaaaaattagccattcttaatctaatgcaaagaatttccacttctataccattaagttctttattcacctatactggggttatcacagcagaaagaagtaggtcatccgagaggtgggaattggttcaggatgagatttaccttggaagaggtaaaatgttttaaaataccatgacttaagtgtacaggttgccttatttccctttcactgacatcatgcctctaggatattttttcttttttggggggatgctttattatacttgttagccacttggttgctgaaaaggcactgaaaactcagagtctatcctcttttcaccctggttgacctttggaatgctattgtcagccaagatgacattgatatcttcagtctccccctagcttgaattctttaggtcagagtccgctcagattgtctcctgatgtcattccaagtgtctgatggccgtctatggcaactgggttgggcaaaagcctgctgggaaggggtagcccacagaatgcctaatggagcgttctgttcaagaggacctagaagtagttctgttagacatatgatcaacactacagctgtgttaggggactgtaccatttcttgaaaaacagaagcatagtcattttgcatttttggttctaataaagtcccacctgagatgtttatgatttatactgattttatgattaagtatgtattacagaaaaaaacagacttagagaatgtcaataaaaattttatatctgatattcacgctaacactagttattaagtgaagaccccaagttaagacagaagagtttagaaaagaaggaaaagagctaccgcatggcaaaatgtacattattctatctttctaggtatttttctttttctttcttttcttttttttttttatggagtcttgctctgttgcccaggctggagtgcagtggtgtgatcttggctcactgcaacctctgcctcccatagagatggggtttcaacatgttggccaggttggtcttgaactcctgacctgaggtaatccgcccactttggcctcccaaagtgctgggattacaggcttgagctactgtaccaagccatttctaggtaattttttaaatgactatgttctacttatctggatcttacaaaattatttataaaatattttatttataatcctaaattttaaaccaagcaatataatagaaaatgttatgttttcaagaaggtaagatcatgcatagatctatatgctttcaatacgtaattttatagaaattgtggaacaaggaggcacataattatatcaatattctaatttcttaggaagaaacagaattttcactgggaggagtttctaaattattttgtaatatggtgagaattaaaagtaaaactcaataaaacttttaaatttaagtgagtgattaaaaccagtttgtttcaccaaagtactgattgagtcaaagactcaaacaaaaggccagatttcctacggactattacttatttattcatttatactaaatgtgtagttaaatcttttaaatcagtaatgttcttagtcataatacaatgatatctggagtatatatgcaaaaataatactatcttattagaatgtgggttgaaatgaatatttgaagtacctaacatttaatggccacatactatttgtcaggctctgtattaattgctttataaacttttgtttccttttattcaaagaacaaccttttagacatgtactattattgtccccattttaagattttacacactaaagctgtgagtgctgacatgacctgcccagggccacatagttcctaagtgccaaacgacataaaaccaatgtgtttgtttccaatactctacccttagctatgatgctatactgcttccttgtattcataacgtttgttcacttatagtgataatataatagatatttttgtcccaccagaaaatatttcagaaatacatatctaaaggcatgtcatcctctttaaggtagacactttagaagactattcatttatttcagtaatgttgtctttgctcaagtctatttagaaatctcctcagggatttgctacacagtcttaaaactggcctgattgttggcaaatccttatcattaaggatgaattttttccaaaagtaaatccaagccaaatgtagtaaacaggatgaaaactaagatttgagtataaagcattagattatttgatatttgtctcataaattgacactaattgaagatataaaagaggaatttcaaagtatttttgatatgattttataacctttaaggagacagttttgacaagtaacactcgtaaaaggtctggtatttttttaaaaaagtcattttcactaaattaatagttatagatcatgtataaacagcatgggaaatgttcttttcaaagagtataaaatgggcagcggagggtaactaggaaactctggagcagaatccacgtttagacactaaataattgttttgaccttaattttctaaatgccctttttgtaaaatggggaaggtggcaggaactacccatgataatgattttgccgagagaagcacatgaaattgtacttctgtggccacttagtgcctcgcatatagaaaattctcaataaatgttagctattatataccatttcactttcaagaaataccccatattcctggaaaacatctcaatgttgtagttatgtaatgatattttaaaagatgttttcttttctgtcagtttcatgcttccaaacagttattttatgtaaagtatttgatatataaagtaaatataaacatttatggtcgtatgtttattcagttaatatgtattatatcaagaagtcttacatgttggactgctaactatattatccttgtcagtgttctatataatattgtctttagataaacttttttggggtattcttattggatttcatcagacttatgaaagtaatgacatacccatttgcccagaatgatgctccaagattttattttttagttacctcagacatcttctaaattgtttattcattatataatcttaaatttaagggaactgagcataaatatgttgaattagtggcttcctattagatcccagtgaactcctcttaaaacagggctcttatctgtgtagcatatgcgcagttgtgatgttgtgaaagtttgtctttacatcactctcttccctatactcaccttcagcaggccctgctttcactttggcatgctccactcacccagcagcaatttttacaatcagtaatagctctttcacgagtgcttctttctcctctgggccttccactgatgcgacctacaaagtcctttcatccctcagccgcccctttatgtccgcggaattctttccaactatgttctatcagaggagccggccactacagccgcctaatccatgacacggtatcattgtgcaatcactttaaatgaacctctcttcaaaagttttctgaaaagaattcataatccaaaggagtatccatgcttccacagataccctgctgtgttggtcaggtggtgttttagggagcactttcagtatgtctcaggtccctcccaccagcagccacttcatttgtccacacagatctaagccttggatgcaagcaaatgggaaacctggcccttacttgaggaagcaattttgtttttgaaaatgttgggattggaagatgaactctctatcagcaaaatattaagatactccttgaaaatttatatacttaaaaaattgtacattgcattacctgttcccctggtctctttttctattccctctttgcaatatgaggcaggcagccactgcgtgtcccttgtaccatagtgactatgttgtcactcagacttaccctgtgtgctctcccttctgccccaccaaagccaccagaggtgtaattagtgattatttatccagaaatgtcttgaacagggtttaagaactctttgaagagaatatgtaccacttgttggatgaaagagagaatttgaaacggttggggagaggtttagggacagagggcaaatttcattctgccttctatctcctctattaaatcacagataaagcatcttcctatgtgcaaagacagggtacataaacaaatatttcccaacttagtgtagtcttaaatctttaaataaagagtatccatatcaaatggaatgcaattttatattaaaaatcatcactcaagattcaaaaggaagaaataagattctaagtaaaagattttgaacactactaaagtaagaaacattctacaactttcttattccttttgacccctttagcaaaggctaaatagctagccaacagatttcctcccaactattccatttaacttcctttcttccttccatctgtcattcattcattctttccttccttccttcatcttttctgcttcctcttttcattttcaagttgtaaattctttagtatcagttgtgaactcagtaaagctacacacacacacacacacacacgcacaactggttattaacaggatttttcctttgcgttggaaaattacattttctgtttcagaaccatagggtattattcttttttgatttatcagaatcacttcaaaataaaataccttcactaaaggagcttatttctaaacaattgatgatgcatgttatagataatatggtcatagaataacttctatgattattttttgttattaatcactgtaattactctatgattgcaatgatgattaacttacaatgaataaggtctgtgcttgtgttggttatatagtatttgtgaaggatttatgttcatgcatccacacagtctcatctcatccttacgtagccgtgagattctagtctgtgtagcctacggccgcaaaataaactcacccacaggagaataaagcctatggtttctctcacattatcagtgggctataagctcttaaactccacaggtcagtgatgattaactgagcattctaaaacttggtgaatgtgtatgctctacactctcatacgttccataataagcactgtctgtattgtttgaatgactgtcctgaagagttcgctcaagccgttttatcacatttcaagctgtattatttagcatcttaaacttaagaaaaacttaagaatgattttttttctggcttttcactagtatttgatgacacttattttccagtctacataagataattaaaataaatgaactactcaacacagtagtgtttaattatagcagacaatacattttaaaaggtaaagtctatacttgtgtgcatatgctccctttcatcttttgggacttgggatcactaaatgttagttttcctgttactgtagagcaggagaactgatcctcttcacaaaagagggctccttgtgaggatgttaacagtctagctcaaagaaccaaagtgcctcagaatcacccaggtgcatgttaaaatccagattcatgggccccacctcaggcccacttagctgcaatctcaggaatctgcattataacaggctcctcaggtggttcttccatagcacttatttgcatgctactctcttaaggtgaggggaagcataagatccacaggtccctctaatgccataatttttttttctctccgtttgttattcactcctgttctctccactaatgttcacaaattttgtggaacttttaaagtcatgagaacctttcaagatagtaagatgaatcttgattcaaaattgtaaacaagaaaaaaagacatgccacaaatattctgcctgttgaaattagaaaaccagttaagcaatatggaaacctaattatctcaaatttctgtacaattcttcatctttacttaattgagggatagccattatcttttcttggatggaatcggttcattgggtcctgatacctctgcaaaacctgtaaaatgggcttcagatccagggacctctaccattggtgataagtgactcccaaacattttcatccttcagtgactgccacctgctgtgagcctagactccaggaaaataggactggcactggtcatagtcacttgaggaatgtggcttctctgtaaagagattttcaatcaatgcagatgttccttgtgacctcagtaatcacctccatctgccaagcagtcataaagggcctgcacatctttgccaaccttgtcaacagagtgatccatatcttaggtctttaacctcttttgtattaagattttttaaaaaatacattaatcatgttttaattctgtcctcatgaacataaaaatagcaataataaatgattattactattgcaaaagtattgctttagtttacaagttttccttaaaaatattgaactccccagctgtatttatccattctttcattccatttattcatcatacataacctaaatacctatatgtagcagacatattgtactaggattcagatatttttaacactgtttcttgttccaacattttcctgacataaataaatatattatcatgctggcttacagcattgtgtgtggagaatatctttctaagtttaaaaattttcctgtcattctataaaattaaaaatattaaatgaccattcagtacttttttgtcaattcagccttatagtgcatactgaaaagttcaaagcttcgtgtcataacataattttgagaatgagactttttgtattatgttactagggtccccaagtggaaaaaataaggcctgctgctctggagtatattgcaaagtgattttgttttccccactgacttcacaggctagatagtgtgtcagttttaattacttggaatgcttacatggtgggctacttatagcaatagggatagggtggggcccagtcattgcagacaggaacccaccaataatattccagattccttttgagacttcctcacatgaaacagaggaaatatctttcattggataactaaaacttactttcctatgatttgtacaaaatggccaaaaaggcccatccattcattagcctcacagaggttaagtgacttgtttccagtcacaaaatgactttgcagtgaaacagagagtctaactcaaatcttcctacttctgctctggtgctctttgaagaacactctttaactctaatgaggaagcctctatgatccttcaaaagcagataccggacaagtcacttattttcactaaaacccctttgggatgcagggcaatgattaaacttgcctatctttcaaattgctagaaatggatgctatttactattttgcttgcaattgatttgcatactgttattacatattgttaaatggtttgttgattaatgactaatgttgatttggactaaatgtaatggaataagcaaatatattttcaaatttagatatacaatttagttgctaaatggtgttgttagtcataaaaatgttgattattttagatcaatcccttgcaggggaaccctagccacaatttccctccatattttttctcaatattttaagctttaccccatctctttttcttattaatttacatgtctgggttttaaagctaatacttcttataagcaagtactgttccaaagcccaggactaaaataaattcttataaattcagaatgtggtagatttcaactaaacagtttcttttctggagatccagaagacaaatatttggcttgaatattaatattttcatgaccttgaccagatcaatatattgcacaaatattatcaacaaattatataaatagaccatatttactaatataattaataattttggaattaatataagatagttatatatacacacacataagctagtcagttgttaagtcagttatatgaactatataatgtattatgcacttgatatatacatatacttatgtgttagtatattttgtatttttaattactcccaatcttaaaaaaaaccctatattccaacttatatttttgatttctacatttatcttctaaatatatgtattacctttgataatttttttatttctgctatttcatatacattcataaatatttccagtttggaaatccatttaaatggtaagacaaataaaaaacttttgtaccatagatgttttagtacatttatagtctttgtattttttagaactacattttaatatgctgtgataaaaatgtgtatttctctaacaaggtattaaatttggtgactgaaaagggttcttcaaaggaatataattcacattaattttccatgtgatcattgttacttatagtttactagtcaacatgcttaaagtctaattagaaaaaaaatccctggatattaagttgggaaacagacccaagtctgtatctacataaaggtcaccaccttggtgacctttggtaaatttcatttttgttctttgatttcattttctttgaaaatgagaagctgaaagctttaaagctttcttcccataactccgaaatagtttatgagctcaaaagaaaatatgactaaaagaaatgtgtgggcatcattacctggctgcccagtattttcatggacacagacttgtaacatattctgaaagttcctttaaggaaaataactctatagatatggacagcaagggaaaagggatcaataagaaaaagaaagggaaatgagttaatgacaaaggaggaatggtaggcagtagaaatgattccccacttacttgttttttatctatagtctagttattcctatttgaaaacctactggcaccaggtattatcaacagggatgagtaatatgtaatttttatctttactgggttacatttggcacatggacagttgacagctgtcagtcaggtggctggtcaatgaggagatacatataaagctgcc

SEQ ID NO: 583 - DNA, 21197 bp, Homo sapiens
acttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtaagtattcatctgcattcttttacattcctttatttcttcgaacatcagaaatgggtagatgtttattgagcccagccacctgctatgccttctccattcttctcccacacaccccacccttagtcctccagaagagaggactagattgattttctcatgctactggatagctgcagagaagctagaatttgctgttcagcccccacacatccccctcacatttgggagaagttgattttccctaaaatggagccaacagcctgtgtccctcagtgtggagtgttaatgggctgcctggaaggaccctgtgtgccctcacggcccccagccgggaagtgaggctccccattggctggcagtgggaggatggtccttgccagcacctagcatggttctctgccaagttctagctccacatctccaggctggtaggaacctagactatatatagcattgtgctaagcaattcttatcagacgtgtctgccctcccctgtgggagtggagcacttctatcagagaaccagaacctagagagcatgagccatctccaagggccttttattctgggaaggggtgtgtgtgtgtgtgtgtgtgtgtgtgtgtgtgtgtgtgtgtgtgtctgtctgtctggttcagggctgcttactttcctcctgtattgcagatgctgatagattgaaaggtcgtgctagatgaaggtgctgatgtgggatgagggccaggaagggctaatagctctgcgatggatattgagcttagagggagagaagctaggggcatgtgacatggctgagggtacagttgagccctgcctccgctttctcttcctggtttcctgtttgccatgctttgcctaaggatgtcttttgacctctctcttccttctttcggacctcttgcattccctgccttcctccaccacttcctcctccctttgattttctttaggatatatgagggcaaacacagtgactggcatcctgggtctgtgtctactcttcatccttacccatttggggtttctggagatctggctccagttgggcagagagggctcagctgtcctctggaggagttttggtggtgggtgagcatgttgtgttggctggttcagggcagggtgggttggatattcccctctttcctctcataggtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgattacagattccagaagcctgcaatcagctcactggactgcaagggccacccgccctctcagaagcgccgggagagaacaggttttcttgccttcttcagctgctagagctgcgttctttggcttgcacccccttcctctgtcttccaagccagcggggcagtcttttgcttcagtggccatgttgtcttctggcacagtcacatctccccctgcctccctcttagaaggacccttgtggttacatttagggcccccacctggataatccaggataatctccctatttcaattttcttaatctcatctgtaaagacccttttgccatataaagtaacattcacaggttccaggtattaggacttggatatctttagaggccatcatacagcccaccacaaacagctccttaggcactcattagaaatgcagaacctcaggccccaaccgataccttttgaatcttctgattctaatttaagaagatcaccatgtaactcactagcacactaagacttgagaagcacgatgctatgggaacctaaccaaagaattctcaagtcccaacttaaatacaaatttacagagtatttttcctaggaacgctttcaggtggaggagattaatcagacgatagataattttcctgaacaccattctgaagtgcttctctaagcatttgttcctgaattctctctcaatgaagccacaagccccaaacaccaggattactgtttacaggggttcctgtttacagtagtttagcacagggtttgccacactgcagcatattattatagtttagttttgtaaaaagctacatgagagaggtaaatcttataaatggaggtggagtctcctaacaccagttttaccacctctgtacaggtttccctgggctatgtactatcgaatcaggaatcaggaagggcggctttttcaaatgttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacctgaggttgggagttcgagaccagcctgaccaacatggagaaaccccgtctctactaaaaatacaaaattagccagacgcggtggtgcatgcctgtaatcccagctactcaggaggctgagtcaggagaatcgcttgaacccagaaggtggaagctgtggtgagccgagatagtgccattgcactccagcctgggcaacaagatcgaaactccatctcaaaatatgtgtgtgtgtgtgtgtgtgtgtgtgtgtgtgtgtgtatatatatatatatatatatacacacacacacatatatatataattttcacctagtgttttattaaacagaatgcttctgtatttttatgtttatttgagacaatgcttctgtatttctaaacaacagctagccttgttcagttagccaaacaacaaaaccttaattcaagtcttcaatgaaattttctgatttaataggctgaattaagaaagccataattttcttctataaatataagcctttaacttctatctttacaagtttatatagaaaaatttactgtggggcttgagatttactaatgcatgggttttcaaccttagctgcactttggaatcatttaggacgcttggaaatccctacacccaaaccacatcccagatcaattacactagaaatctctaggggtgggacccaggtgtctgtaaatatcccccggtgattgcaatgtgcagccatggttgagaaacactgaagcctgctctgagaaatttagcaatccgacttaattcaaatctgcagagagagcaacaatgatttttgcagaaacaaccaaatcctactagttacataaattttatactttgttaggacttgggtttttatttagctctacatatgcgatcataggatgcagaagatatatcttctactggacacgtatatatagatgcttaaatgtggctatcccaaggttaggtaataataaagactataagagctgggcagaaatcaggcacagtttcatgaagggtaatatctgagctgggccttggaagatgcataggatctcaacaggacagtaggtgtttcaagcaacaatgaactaggaatacagcagaaagcacaggggaaatggtcaggcttgactgagagtaggttatttgaagaagtgcaatagaaaatgcttggggaagaaagttgggatttaattgtaaaaggtcttcaagtatcaggctaagaaatgtggacttcatccagtaggtaatgtgatgtcactggatatctgtgcagtatctatgtgatgggttgggagtggagaagcctggggatacttaagggtctgagctaggagggacaggaggaatggctgtgggagtggaatggttagaagatgggcccaattagaaacatacttcaatttgagacaaaacccactagaaataaacacatcatcatgaaacatctccaaatgtacaat

SEQ ID NO: 584 - DNA, 4122 bp, Homo sapiens
agtgtttcctagagccatctgctgacaacacgaacattgggcatctgacagaggagaaatatttataaggtttagctccagtatcacaggcagagcaatggaggatggatttggagctgcaaggcaataaactggtaactgaacaaaaccagtccaagaagattgtatataagagacacctgataatttcaaaatcctaggcccacttcctgagctgagcaagcatgcaacctcaaagagaaaagtttgaggaaatcacttcaaggacaaaaaattgcaatgtaaagagaattatttatctccaaattccagattacccccctgcccaacccctgccagcagcaccgtccacatggtttctcatttagttttgtgttagtttaacaaagtagactctgcaatctggataaaatagtaagtcacctcaggtaggtgccaataggatgctcctttggacattgcagattttaagtactgtctttttataatacaggaggcatgtacaagtctgtcatatgtggaaatgttgtgaacccatcatatatacaatgtgctgttttagaagatagattgtccatttaggtgtgttataacaacctagatgggaagttactttccggtgtgttcaaagttccttatctgattctgcagaggctgggatctgagcaggtcactctatctctggaggcctgttacttgatgataaatactaataaacatctcccgtcagacatctcatctttttgtggattcctgtagtactcttaccctttctacaaacatgtaaataccatccattgatataatttttttttttttttcttttgagagagagtctccctctgttgctcaggctggagtgcagtggcacgatttcggctcactgcaagctctgcctcccgggttcgcgccattctcctgcctcagccacctgggtagctgggactacaggcgctcgccaccacgcctggctaattttttgtatttttagtggagacgcggtttcaccgtgttagccaggatggtctggatctcctgacctcgcgatccgcccgcctatataatattcttatttaacccttggttaatatattggcatcagtttgttttaacaacaataacataattatccctaataatcagcattataaaagctatcataatcgcttacataactacaactattatctagacaataataggttagattaataagaattcagtgttattcaacacattgctaaaatgtttccatgtacttttatcttataagctaaatcttaggagctgttactcctggaatagaacaatatttcattaatatatttaaaattttaaattagtaaacatttttctgagagattctgattctatggagaaaaaataatgtgatcaagaatttctattgctggaaacaaactaacaaatcatttagttcgaaagcccctcttacaaatgcaggaactgagctgattgactcttcatttaatgataatactattaacaggtaatgcagttttgaaggaaagcacaggctgaatacagaaatctctttccaagaggtggtgagtctttacgacaattgaatacgtgttatttttattcactaaaatttggctaagattgaaagggtaaactttgtgggtctttcaggagatcttttactaaaataagtagggccttaatcactgctgaatgaactttgtacagaatgggcccacaggcctcatctgttgtagctgggattgctttgagagaagtggatttgttgaaaagtggatggaagaacacaggatttagaattggcatatttgactatagcttctgcatccacctatctctgcgctatagaaatgattaaagagaagtgggaaaaattcataaactttatgattatttttaattttaaggaggacatgggacctttattaaaaaaaatattcccatatatgaaagattcttatttctataatggggaaatggcgagactatgaaaaaaaaaaaacaaatatgtaattgaactttaatgtataataccaaaataaactataggtcacctttggcagtatatatgtttaaaaataatttcgacgtttaaaatgccttaagagaggaccattaaggtcagattgagaagataaaagaattgatcttttagggtgccattctactctatagctctgtaatttctatggttatgatggttctcttttgttaaataaggacttatagaaattatttattttatctgtttgtatttatttatttgcctgttggtactagtcaactgcttccccttacttccctccacttgctacaactaatcaaatgtcatattttaagattatttaccaaggttgctttaaatttttgtctcctttttaaagtgtgaaaattatttattttaaagttagcattcatttcattattccttctttaataaagtatttattggccgggcacagtggctcacacctgtaatcccagcactttgggaggctgaagcgggtggatcacaaggtcaggagttcgagaccagcctggccaacatggtgaaaccctgtctatactaaaaaaacaaaaattagctgggtgcagtggtgcacccctgtaatcccatctacgcaggaggctgaggcaaaatcgcttgaactcgggagacagaggttgcagtgagccgcgatcacgccactgcactccagcctggatgacagagcgagattctgtctcctccgtctcaaaaaaagaaaataataaataaataaataaataaataaataaataaataaataaattctttattgaatgatggaattcatgtacttccaaagttctgagaggcaaaacatggtgatggctgattctttgcctgtaatatcttgctatgttatcaaagcaagtcaaatatataattataatatagtttaagaagtgccgtaatagatgaacagtactactatgggaattctgaagaaaggaatgcaaatcggacagggggaagagaaaatgttttctgtttctgaatagccagggatatttatgacattggactgataaatgcagagatctcattcatgcctccctgagctaacatgtatgtttcccttactactatgcaaacttcaagaagggaaacgttttctacagtatctagaatagttttttgcatagagtagacatacatgaaacaatgatacacattaattactttctcagtaagcttgataaaatggaagatgctcaataacagttcagtttcttgtcccttgagaagtggtgcatgaattgtagcctgggtaagtttcatgtctttgtatgcttttgtttcttttttatgtctaaatagtaaatcaggaggaatttcttggatatgctggtggttaagacttgattctttggttttaataatgttaatatattgaggtttagttgtgactgaatataaaattcattgtttttaacttaaaactttaaaatcaaattgcagaagccttggccaaggaataattgtataaaatacagtgtctgaacttgcaagctgttcttttatctgatttgtgaacatttattaacatgaccttatgtattagaatgtcctatacaaacatgtcaaacaatcaaaattcaaagcttttcattttcaaaagctgcctaaaatgccactctctctagacaatcaccctggaagtaatggtctcttctctgaaccatcataattctctggttctttcaagaaagagttaaatgctttccagtagtttctttctgatcttgattgttctcaggggtctcctcagagttattttatatattttccttgaaattttaaagagttatttgtggatgaattctcatagaatatatttaattatggaggttctcattatgcttcatacatgggaagtaattctgaaacaaagaaagtaaaaggccgtaaactctctatgggctgctttattaatcaaaggagatatagaattaacccattagaagtactctactttctctgaggggaacttctttgttctgtagattggtatataaattgaaatgtaattatttgctcagttttattaacatatttaaaaagtaattgaatatttgcagatgagagagaaagaa

SEQ ID NO: 585 - DNA, 6708 bp, Homo sapiens
aatgtgtgaggtggtgctatgtagcaggaacccctcttgctttgcaaatagttttttgtttgttttcctttttgcccaatagagccctgctctactgacccttcaatgtgcccgtgtgcctaaatattcctggtcgtgtgaaaagaacccaggtattagctgaactaaggagcacaattctgcaacattttggcacccaaacacggggcttgagaaatgaatgcaattggagaaactggttgttttaccaggcgttgattggaaatgtgtgcttccctttaagcagtcaagctcaacttgcagaactgatgggaaccccttgggaaaactggcctcaaatgtttgtctacacagtccacatacagggttcttaacctgcggtgagtaaagaatgtcactttccaacaggcccagatatcatatgctcttgggacctcaagaagagaggagtttacccaattcataggtgtgtgaggataaaaacctagggctgggctcagctttaaatggtcttatctgagattctttgtgaaacagattttcatgaaagccaatctagagggcctacgtagaaataattgtttttgctgcactttatgcacataatcaagccaattataagactaaagtctatattgcaagcaacacactcctattatgatttgtttttaacagaaatgaggacgagacagagagaaattatgtttcaaaacttatcatcattagtttctagacttattatttctttttaagtttttacctacattttagactgaccctgcttgtgcctgtgaaccaaccaacaatctctggctgcagctcagaaaggacaaaagagaatgggtaatgtaaaaacctggatcagtattttagttctgaacaattatcctgcaaatcctgccagctgatgggaataaataggatgcccatgatccggaggtttactttttgggaaagtaaaaccaagggagctaaccaaagtaaaaccccatacacccaaatctgagcaagcataactatagccaccagttatctgggtgtgtcacaagacactcttttctttcctttgttggaggagaactcatttccacagcttcactttagcattatggcttatgttaaggagtctatgcaacttccatgctgagacacgtttttggtcccaaagttaattccaagctttgtgtcaaaggcctaagaaaactggatcttagggatccagaagccagacaataatgaaagtcaaaaggcacagcacaggtgagcatgactaattcccgctgattaagccaagcttcctgtttcatggataaaggtcatgctagtatccatggcataaatgaggtctagagaactaaaaggctactgccagcaggggagatagggaggacataagacagggcagctattcccatcccctagaccccctgttaacatggatgaaagccactttgacacccatgggtggcaccctgtcacagttggtgggactcagcaatacagggacagaggaaagaaagaggaacaactcactttctctccctcacacaccctgagtatttgctagaaaaagaaaggaaccaggcacacatgctcccctatttctagatgagtagccattcatctttagtctgcacccttttagaacatgtcctgaacccctgggactcttctgaaaaaaatgccttcttttttcctttttcttcctctgtcctctattcactggtaggtaggtaatggtgtcccataccacagaacacttccctcagatgcatccttctaactgggaggagttaatttctcaaaccgtagactaattggcttaggattaggttcaggggaagggaacacagaaacatgacatgccagcaaaagggtaaaaggttttttttccccgttgggcttttggcctctctctccctgtgcaaactggtaaaaggcgtctggattttctagttgtccttacccactgcttgtttcgttttgatacatattttctaataacctgtttgtctcttctcacttttaggccatcaaactccagtctgcacctggagccttggatgatggccttttttactgggaaccctgaaataggcctctgagggaaatctgattgccattttcccaaaacagcttccctgacaataggaagcaattaagattggtcttcatccttatctttatccttattctaatggcagttagaggtacttctttagaggggggaatgagacagccaaatgcctaggcagataaaaaggtgtacctggaaaatttccaacccgtcacacaagtgtttacatcagatgcttttgtgtagatgagggaaacttcccagggcttgtctgggtatgcccacagtggactggagcccaaaatgcacactggaggaagtggatggagccacgtggatgtcatgccttatgcaggggaggagcctgctctcttcagctcctgtggtaatgtgggaatcgatctgtgaggaaacactttctgaaaatgtcagaactcttgaaaacatggatgaggaaaagcataagtactgctttatgcttttcttatgaattttaaaagatgtaatttaaagattgaaactcccacaactttggcagaccaactcctcagaaaacattattctttgacatcaatatgttttgcacaaaattgaatggcaagtgaaaggcatcaaatggtgagaatctagaaaatagtgcatgtacgggaaggctttgctcaatacaaatcacttgcatgggacagtcttctttagtgagtttattatatacgggaacagagaggtaatatgaaatggaatatggaatatggcactagcaagcacaaatattcaaatatgtggaggaacaactggatgtgataaaacactataaaaaaaatagagagaaaaatgacagtaggaaaaagactgtatatattttttgagaataaaagatagtttcatttcattggtggacatgagatgagttgatgcagcatgcaggtggataccatttttttcaaagaaaatatgaacagagtctcaaataaataacaaatgtttatatgtgggtttcaaggacagagaataataaaataaccaaatatacataatgttccagtaaaatgatccatcagggcttacagaaagcgtaactagagagagacattaacttgcagatgatttgtttctggctaatgttgtgacaggagtgtagcatttcctttcttctcagtttcctatctcacttaccttttgaaaagacatgattccatattatatttattctgtttctctctttctttattcatttaccctactttactgaaaaatctcaaacatcatagaaacatgcatgtcttggttctccaagtttgaaaggaaaataatgtagaaagctctgttttttttgccctggcatttatatactctccaatctcactactcccatatcactcttctacctctcttagagcaaaattgcctcttaaaaaaggacattgcacccagcatggtggctcatgcctgtaatcccacaactttgggaaattgcgccagtgcactccagtctgggagacagagcgagactccatctaaaaaaaaaaaaaaaaaaaaagtacattgctgattccatttcagcatcactcaattaccattctctaactgtctctgatttgtctttaccaaaagccacatctggcataattggcaaaagactttttttttttccccaccattccaatgaacacaaaaatgacattctcaacatcaaatcaaatgatcacatttttattcatattttactccaactgaaatgaaggatataactaatttgtccatttttctttaagcacatatctgtattcattttgataacccagcactcttgattgttcccttactgaatgtttgtctcttagtatcctttgcccattctactcctttaaaaaaactgttgcagtaaccaaagagttatttttgattccacttctttgtcaaactaaagtcagctctttgaggcttctggattttgatattaaatatgtgtttagcagttcaaattttatatatgtatattctagctcagatccagaaatctatttccttcttatcattctcacttggattcctcaagcaatttaacatgctctaaatatttcttccatgtttatttaggtttcaactctacatacagaatagactaatttaataattttatacaatccttggccttttactttatatgatcttctacatccaatagaaggttgttcagttaaaccttaaaaacctatcgcacactttttaattctctgaattttcatcaacaccacggtagaaacctcctcaatacagagttttgtaataattgctctttaaattcccaccatgatatgttactatatattctgctcagaatgaaaaggttcactataaaacatggtttaaaaaaacaaacattgatttctctgcttcaggagtttcctttcctatggtagatgaaactaggtacaataatttgttgtttgttttggagagctgtcaaggcatgctccatggcctctgaaactaggtagattgtatcacatacactccagaccaacatacttgctactttctgatttgattggattaacacgatgtcaacaatatagtggaacaatgtgatattcttgtcaggtacagtctctttggactatgtcagacaaatggcatgagagttaacatagtcctcgagctaattcataaatgtatattgttaccattttacataaatgtaatcgttgatgcccttattttctcagaggggtgggggaaaattgctattcccacattaatgtctgtatgttagtgaatctgagtgagtgccaatctacttgagcaaataaacatctggaatagcagctgtaattggatctatgattttcttgaatttgcattcatttacttttattctccagagtgcttttgtaagggtcacactggtaaatcaaaaagaggatgtaatgagggaatatcacctgtgtcattttttcaagaatatccaatctcatattttcccctgccacacaatactatattacttttgacacaatatgttgagtaggaagcagcacttattgataattctacttgcccttcttcactactgcagatctcaccctactaaccaaggaacaaatatgaacatttttttcagctgacagaatataatgtttattccaattatacatttgtgaaaaagggaagtgaaaataagtcttttgagccagtggacccattgtaagcccaaactatgctaggacattatttattacttgaagtctcattagctgcattcttaaaggtggatctctttgtatcaatcctcaaaatatcagggtattaaaacaataaaagttaatacttattctttgtatatttctactgctggtcctcaaggggctctgctcattgtaatcaaataggcaccaaaggtgcagcagtccccagcatctttccctgtagcctttgtggtattgggtatcagtgtttgtcacgacgaaggaggacaacttagagaattgtgcccctgctgttagacggagtctgacaaaatccagacacataactgttttatgagtaaattgccaatgccaatcacatgatctaaaattaatatggtgggtaccaaaggagaggcagactatgtgtgttagtgagatctgatagtgtctgccacaacacttaataatttttggagaattttaccatgggcttgacatttgaatattcaatttaaactacttatttatgaaatagttataggaataattaggaactttatggcaactctatgttttaattaactttctaagtggtgaaagagtgaattattcataaattacttctggaaacaggactcttctaaaaagcatgtaagggaacttgaagcagcatctcaatttgtgcaatatgataaagaaaaaaaactgtgggatccagaaaacaatacacaattacttttatttatggctaccagaacttcaggaaaccgactaatgtttgtgcacataatgtttttattatggatctatctggggcatattgaacatacagtgccctcaaaaatggtcagttttactcatgcccaatcccatatattttttagggtaatttttctggtccagttaagttagaccaggacattttcacttgacaaatctgagtaaacttctctggaaaaaattgtttttgaccattcgcctagaatgaatctctgggtaaggaagatgcatatagtcgtataatttactgtagttattttgacaccttttcttaacgacacaccacagatttattgctggatatttttttccttcctaagccacttgccatatagttctactcttctctagctctagggaggcttcctcatacagactaggtcaacagattccattccactggctcgtggatgggtttggctaccgagaagcagttaagagaagatcagaattatagggagcagggagtaggaaaaggtgaagaatttattttcctgcttccctgctgatcccctcccaggctcctacatgttggtcacatttctctaccaaatggtagttcctgtggggttcttgtaaattcaccttcctctttccatagagacaaaagctccctgctttcattcaccttcgagtactgcaaactttttttttttttttttt

SEQ ID NO: 586 - DNA, 2236 bp, Homo sapiens
ttacaggcatgcaccaccatgcccagctaattgctttgactttagacaatttgactataatgtgctctggagaagaccttttgtattctatctgtttggggattgcttggtgtcctgtatctaaaaatccatatctcttgctagacttgggaagttttcatctgttattttgttaaataggtttttgaacccttttgttctcttttcatcttctgggatattggtaattcatatatttggtagctttacggtgttccactttccatatatcatgaaagctttgtttattcccttttctttatttttgtctgactgagttatttcaaaagacctgtcttcaagttctgagattctttcttttgcttgatctagtctgttgtggaagctttcaaatatgatttgtatttaatttaatgaattcttcagttttagaatttctatttagttctttttaatgacatctatttctttgctaaatttcttattcatatcctgaattgttttctaatttctttgtattgttctttggaattctcttgtatctcactgagcttctttactgtcaaaattttgaattctttttctgtgattttgtgaaattttttttattgagatctgttactggagaattactgggttcctttagaggtgtcatatttccttgcttttataagtttcctgtgttcttacattgataccttcatatttgctattattgtcacttcttccaattttttgtatttgctttcacaggagagaaatttttctgacgatgcattaatggtgttggtcaggtatggccctttggcttttattttgggtgcatactgtagtgtagtctctctgtacaatttctttggctgtaaacaatatcagtggtattcgtgatttccttggtggcttagggtatggttattagtggaggctctggtgagctttggctggaaacagagatgccagatgggccagtcttcagcctccagtggtggcagtggagggccaagcatccctgttcttggaccccaggatggtgtccactgtcaccagtgtcagcaggtccaggcaggctgattcttgggcctccagggtggcttgttcagatgctagtattggcggcagtgggttgggcatgtgggcaggttcttcagtccctgggaagaaagtatggtgtgtgtgatggcagttagtagtggcagatgaccctctgggtcctgagaagtgtatatttgtattggtgatggctcgatgggctgggcaggacagtccccaggctcctaggtagtgcatgtgggtgggtgctggcagtggtgttggtgtcaggttgggtgggcccatcttcaggttcctgaagggactgcacagatgccagaggtggtggaatgggtgtagtgatccccaggtcctaaggcagcatgcttgggctctggggactgggcctctctctgggctgcctctccagtcctctgcctgccactgttttcattgctatcattatttctgtttctctgaaggtagagaatgctgccaacctgctctgccctcctcagactctctcgtctgacagttctataaaggcccctccacccagcctctagcccatttctttctctggcttttgcagggtaacagaagacagagaagctacaaaaaaagcctccaaaacatgaattattgaaatgatcagatatggttcacaaaataacgatgctttttacatttatgaaataaattccaagcttaaaaacatccgtgaaaaggaaactctaaaatttaatgtgacatattaagaaaaaaatccaaaaatataatactcaaaattaagatgggcttaagagcaaatgaaatgtagctaacatttttaaatggaagacaagaagaaaacatcctccagaatgcagcacacagaaataaaagggaagaattggaaaagagtggataagaggcataagtggtcagtgacaagttgtagcccagaaagtgtgaagggaatgggacagatataaaattggaagaaataacagctctgaatttttcaaaagtaaaaacgatatcaatctacaactttaagaatctccatatatcctaagcaaaataaattataagaaactcacacccagacattgcagcaaaacttcagacaacaatagacagagacaaaaatcttaaagcatcagaaaagaagcagttactttcaaaggaagaacagttagactgagaactgacttctcaatagtaa

SEQ ID NO: 587 - DNA, 3630 bp, Homo sapiens
ctataggagaacacgaggaaatatattttataaactgtaaagcactactaagacgtgagcagcggctgctgcatatccaggtcaacctttatgggcctgaagacaacctctccttcgtttgggcactgctaggagtcaaatctacctagacttttggtaaggaagatggtactcatgctcattgtcattgagacaattatctaatgcttagaagtcaagactagaaagcaaggcattaaccatatcagcacccaaacaagggaagacaagttacaagaaagccaaataaaacagcaaacatttgtttagtgctttatggttaacatatatgatctcttttaatccttacaatcctagggaaaaagtgaagctcaaggaggttgacacctgcccaagactagacagtaagtggcagagccaggtcatctgatcctaaatcccgcactccttccactatgataaaataccaggaaagaaaagtgatcaggatatgaggcacattctgatccatcaaagatgcttatatgctttgcctttctctagaaggaaaacggaccccactgaaggtagagatgcaatcccagactttcagagggggggtgtggccaattgctatcagtagtttaggactcacatctggcatttctgtctaccaatacatctattttgacactgcttgtgctgaggtcccaaatgtctattatctccaagtactgtggctttctattcctatctgtacctgtcccagggaattggtcaaggactcacattagggagaaatgaagtactgggtatctgttactcacgtcccttacacttaggtagactgccagtattagcagtagtggtccgcttccagtgaccgtcatattatctgttcagcttcctctggggaagccaatctgccccaatcttcatggttttgtgtctccttttttacccatatgaccatctctctccaccgtgtctccctcatcaaataaagagaagtttagcaactaagtacctgaggaggtgggaaaggaatgctactcattcctcagctctcctagttacctttccactcccttcatccccccacattccctcatttctctcacctggtactcctgcaccacctcctccaaaggcagcacgctgtgctgtttgtggctcctggattctcggcacaccacacagatggcctctttgtccacctcacagaagagtttcagggcttcctggtgtttaaagcacatgccctgatcattactccggtttccccgataaggagtggggcacatctggcgaattatctggaccatgttggccagctgcaagttgggacgaaagctgcgacgtgtaaagctctttcggcactgggggcaggtgaactgccctggaaggggcaaggaaggaggcgggtggatgtcaggatacagctcttcatcttcgtcctcatcgtatgcttccagtatttcttcttctcggtagacatcaattctcaggtcaggtctcaagcctcctaggtaatagtcctgatcttcctcttcttcttcttcctcctcgtcccacatatagtctacgttgtcccaattagttataccactgtcaccgagccagagttcatcgtcatcttggtcttggaacaactcttcgtcagcattcccccgatacaacacctctcgaatggagccgtcccatccatccatggcccccaccgcttcctcgtcctcctcctcctcccattcatcttcctcctcgttctggtcctcctcgtcctccttactccacagctgggtcacacaccctcggcagaagttgtgcccacagctgatggacacggggtccttgaagtaatccaagcagatggcacacaccgcttcctcctgaagggtctgcatggggctgggagtagtggcataaccagccatcttaatgcccgccggcaggtgtagatacgtcagcttggagctgaggagcggggacgcgcctgcaggcctgcctccaaactactctggtgacccgaggctgtcctcaaccttgctcttcttcctcggggccgcaggggagctttgaccccctctctcagggtgcgaacgcccagatccagactcacagcctctctctgggatcggtggggacagagcaggctgcagcccccagctgctcggtcctgtcacgtctctcgctaccctcagggtgtgccctacactgcggcgtccgcctcagatgcagccgctggctaccctgcccgaggcgacgcaaaatgacgtctcgctcctgcacacgctctggagagacgctctaggccggcggaggaccacgtctctatggtgtgccgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaacccaacacatttcagccaagtcctgctgatgtttctcctccgatctagctcctcctttccagccttacttctgccactccagatttcacccccatcagcttcagactggataaaaggaaaccatttctctaaaggatcacttgctctctcatttcaggccatcctgcagccaccagaaccttccacatgaaatgaaaggctcaccacttcataggctttaaggaaattcttggccaggtgtggtgcctcactcatgtaatcccagtgctttaagaggccaagatgggaggattgtttgagccagctgtttgagaccagcctgggcaacgtcatgagaccccatctccacaaaaaaaaaaaaaaagaaaattggctgggtgcggtggctcatgtctgtaatcccagcaattttggaggctgaggcgggtggatcacttgaggtcaggagtttgagaccagcctggccaacatggtgaaaccccgtcactactaaaaatacaaaaattagccaggcgtggcggcaggtgcctgtaatcccagctacttgcgaggctgaggaagaattgcgtgaacctaggaggtggaggttgcagtgagccaagatcatgctgctgcactccagcctgggcaacagagtgagactccatctcaaaaataataaaaataaattaaaaaaattaaaaattacctgcgtgtgatggtgtgcgcctgtagttccagctacttgggaggctgaattgggaggatcatttgagcccaggaggtcaaggctgcagtaagcagtgatggtgccactgccctcagcctgggcaacagaacaacatgcaatcttaaaaaaaaaaaatcctggccaggcacagtggcttatgactgtaatcc

SEQ ID NO: 588 - DNA, 3751 bp, Homo sapiens
agacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccgccaacacaagccatcagccccatgctcagctcccagcaggcagagcgttcagaagcgccagcgccatcatcttgggagcctgcagtccacacaccgctgaccttacctacttcctctttccaggtcgtagattacagactctcctctgggaaattgcccccagatctaacaggagtacaagaagctgggtagattggaaaacagcaccgaattcccctggaactgaggacggaagccttcccagtcctgcagccacctgcagactctcacaagcacggtgctcccgggagaagaccttgctaccccaggcccaaggcagtcgagagaaaacgggaagccctgaaggtttttcaccccgggggtgagagtgtatgatcgaagatatatttgagggtaattgtacagatagtcccaacttagcattgttcaactttatgatggtatgaaagtgatgacattcagtagaaattgtacttcaagtgccaatacaatcagtttttcacttttggtgcagtattcaataaattacatgagatattcaacactttactttaaaataggctttgtgtaagatgattctgcccaaatgtaaggctgatgccagtgctctgagcacatttaagggaaagctgggctaagcaatgatgttccacaagttaggcatattaaatgcatttttgacttagaatattctcaacttgcaatgggtttatcagaacatgacatcgttaatcactcaaggagcatctgtaccactaatgacatagatgctggttgcaggaaggcagccagaggagggcacagtgtggaagaactcaactttttaaagacagagatcagctttaaatattgctaagaaagaacttggagagagaagttggtgataccggagacagcaggcaacagacagagtgagaggcccgaagaacaagaggaggagggagtctcttctgggagcagaaggagtgtcgacttaaatattagggagccaaagatgaacctcgcagagaacctgcaaaacccagttgcagaaatacctgcccacacctaaaaactcagtcactgaaagtctgaagtcaaatgattatgtgaaatcttagtagtgggtacatgtggtttcattagattattctttgtatctatatttgtactatcttataagcactataagttttaaaaccatacaagaggctctatggaaaataaattggacttcattaaaattcaaaacgtgtgcatcaaaagacactgtcaagagaatgaaaagacaacccatatgatgggagaaaatcacgtatctgacaaaggtctacaatccagaacatattaaaaaactcctacaattcaacaatgaaagaccgccacccagttttaaaatggaaaaaggacttgacgtttccccaaagatgtgctcgtgacgaatgagcatgtgaagagatgctcactgttggccgggcgcggtggctcacgcctgtaatcccagcactgtgggaggcggaggtgggcggatcacctgaggtcaggagtttgagaccagcctggccaacatggtgaaaccccgtttctactaaaaatagaaaaaattagccaggtgtggtggcaggcgcctgtaatccagctactcaggaggctgaggctggagaattgcttgaacctgtgaggcagaggttgcagtgagctaagatcgtgccattgcactccagcctaggcaacaagagtgaaactccgtctcaaaaaagaaagaaaagaaaagatgctcactgtcattagtcataaaggaaatgcaaatcaaaagtacagtgagatgccacttaacacccactacgatgggtaatcataggatgggaaaaataaaataagtgtgggtgaggatgtggaaaaatcaaccctcacacactgctggtgagaatgtaagatggtgcagctgctatgtgaccgtctggcagtccctcgaatgattaaacatagagttataatgtgacccagcaattccatatatacccaagagaaatgagcattattcctaatagacaagggaagaaacagccccacggttcatcagcccatgagtagattaactaaatgtggcatatgcatataatggaatactgttccgccatgacaaagagtgaggtgctgataaacggtaccacgtgcagggaccttgaaaacagattaagtgagagaagtcagtcaccaaagaccacatattacctgattccattcatctgcacggtccagaacaagggagtctacagagatagttggttagtggttgcctagggcttggggaagaggtctggggagtggagaagtgatgggtatagtatacacggttcctttttggggtgatgaaaatgttctaaaatggactgtggtactggttgcttattttaatatatctgtgaatatattaaaaaaccattgaattgtacactttacatggatcagctatacagtatgtgaactatttctccataaagctgggggtttttttgtttttgtttttgttttttatttagatggagtctcactctgttgtccaggctggagtgcagtggcgcgatctcggctcactgcaacctccacctcctgagttcaagcgattctcctgcctcagcctcctgagtagctggaattacaggcacacgccaccatggccagttaatttttgtatttttagtagagatggagtttcaccatgttggtcaggctggtctcaaactcctgacctcatgatccgcccgcctcagcctcccaaagtgctgggattacaggcgtgagccaccggcccagccaaagctgtttttaaaaaaccatacatacagtgagatatcacttcatatccactagtctgggccatcatttttaaaatggaaaatcacaagggctggtgaggatgtggagaaattgtaacactcatgcaatgttggtgggaatgtaagatggtactgccactttggaaaagagtgtggaggttcctcagtaaggttaaacacagaattaccatatgatctagtaattctactcctaggtacatacctcagagaattgaaaacaggtgttcaaacagaaatttggacttaatgttcatagcagctccatccacaatagccaaaaggtggaaacaacccaagtttccatgaacagataaacagatcaacaaaacgtgctatgttcatacaatggaagagtattagctccaaaaggaagcactgatgcattctacaacatggttgagcctagaaaacatgctaagtgaaagaagccagacacaaaagaccaatgtatgactccactgatgtgaaatctccagaatggaccaatccctacagaggggagcagatcagtggctgcccagagcttggaggaggggaatagggagtcactccttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaagctctatgaagcacct

SEQ ID NO: 589 - DNA, 5758 bp, Homo sapiens
accgaggcagctctctgcctcgaggctggagggcaacgcggtctgaggcagccaaagaccgggccaactcgctgccaaaaaggggccggattgcttccggatctaggaggcaagcgggacttctccctctccctactggacgcacaactcaggatcctgatggcttcttaccgccccgtcggctgttttttttctccagaggaaagcgtacacaagaaacctttcctggagaaggaataggtgataagaagacgggaagaaacaagcatctgttgctactgtccccattttgctgatgtggaaactgaggcttgaaagggaccaagaacctaatgaaatgttcccaaggttgaaatggtaataaatagccagaaatgaggaaaaggcaaaaagttatccaggctcgcaagtcaaagccatactggatctaagctaaactttcttatacaggatagtctacaaaaaacaataaggggacattaatttattcatattaaaaatacttactgaagacacactacgttccagtgactagtactgggaataaagaggcgagcaaaagagacttaccaagttcctgttgctaaatcagtaagactcaaggaagtagcaacaagttagagtagacgtggtaactaccttcaagaaatttacaattccaaacgagtcgttaggaaatacagtatgaggtgaaaacagttaaaaagtgaaagaaataaaactaaagataatgatgttaaaaaaaaccccacattatcaggcactgttatagccttcatatgtcatttcatcttgtcaaagaatgtctcaaaagacagccacaggaaagaaaagaaaaactttatttgcaaagctgcaagggagtgagacttccaaaaggactgattcaccaaatatgagacatcaagttttaaagattagttaaagtatagagggaagaaaagaacacagaattaaattgactttacatgcactgaaagggaatctaagccaaggaaagttggaatggtagcctgtaaggggacagctacagaaagggccagggaagaagaattcctaattgatgttttcctatgccatttcctgagttcgtgactgtggacgagttatctctccaaatctcattgtccgcttctgtgaaatgctggtagcagggatgactgcaaaggcttgtggtcaagattaaataacataagaaagtgctgctagactataatttcatgtgtgtgaaattcaaggggaaaaaggaaacaatacataatccagtctgtagcttctcatggatcgtgcaaagcaccaccaggacagacatctcaagcacatttgaagagctcctgtttcctaagtaagacagcagcagcaagactgcaatcatttctgggaaggcagtatcatcataatgcaatattagctactgtgatcttctatcatttccttcctggagagttatgactgtggcattgaagatttaagacctacagcctcaacactacttactacaaatctctcacaaagctgctgcaataaatctcgtggaggaaagtcattgcataaaaaaatcctcaactccagggagttggccatttattttcctagaaaaggggctgtgatgagagacactccatgctcctttaactccatggaacagaacccaacaaaacattcatcatggaaagttgactgatgggcccagtgagactagctggggaaggaagatggaaagagaagtgccccatccaaggcctgctccttttcctagctgcagcccggagggatttcctcttagcttgaggattgactttccatagaatcagcaccactgagggtaagcttccctgaagacaaactctgtcattggagagctcagccaggggtctaaaactggaccctatggactccacagatttatttagtctgcacagtgtttaaaaatgtttttagttagggccaggcatggtggctcccacctgtaatcccagcactttgagaggccgaggtgggtggatcacctaaggtcaggagtttgagaccagcctgcctgacatggcaaaacccagtctctactaaaaatacaaaaattagctgggcatggttgctcaggcctgtaatctcagatacttgggaggctgaggcacaagaatcacttgaacctgggaggcggaggttgcagtgagccaagatcgcaccattgcactccagcttgggtgacaagagtgaaactccatctcaaaaaaaaaaaaaaaagtttctagttagttcccaacataaaaaattaacaattttgcaaagaaagataaaatccagattttgggctcccctaaacaaattgggatatctgaaaacagtgggccacattcctacattcctgcccctgttgacagtatgcgcctgctctaattttacttccccttttaccctaactgccctgtagggaatggagtttgcaatccccatactaatccatcaccctgcaggtccattcccctcctccctgacctctgttctgataaggggtgagagaatgaacccccatatgtattgaatggaaaatacatgtattggccaggcacagcggctcacacttgtaatcccagcactttgggaggccaagatgggcagatcacctgaggtcaggagttcaagaccagcctggccaatatggcgaaaccgtgtttctactaaaaataatttaaaaacaaaattagccagacatgatggcaggcgcctataatcccaactactcaggaggctggggcaggagaatcgtttgaacccaggaggcggaggctgcagtgagccaagatcgcaccatggcacaccagcctgggcaacaagactgaaactccatctcaaaaaaaataaaaataaaaatacatgtattgatgagaaaatacaactgactaatcccacctaaaccatgacctcatataaattcagaagatctttctaacatggcagggaggcagcctagtataaagcaaagagcacatgctttgcgaatgtaaaccaaaaataaaagttgaaggccctcctcaccatatgaatggtctccttcctttgccagggcaccctaaaatttaactggttgaggccatgatgggtagtaggggttggacatgcctcattatacccttccagcagtaacatcaacacagactttaagtctgataagaaacatttacagtctattttctctaaagcctgctacttggagatataaaacctaggtctccacaacccctattgtaacccagccatttctttctaatgataataagtctttcaaccaattgccaatcagaatatgtttaaatcttcctatgacctagaagcaccccactctttgagttgtcccacccttccagattgaaccaatgtaaatggttcaattgattgatgtgttatatctccctaaagtgtataaaaggaagctgtacctcaaccatcttgggcacgcgtcttcaggaactcctgagtctgtgtcacaggtgtgtccttaaccttggcaaagtaaactttccattacttataatggcaaaaactgcaattacttttgcaccaacctaataaatggattgagacttgcctcagatacttattggtttatacctagaggcagaccttggctcaaatcccatctctcccttactctgggatattgtccaacttgctcagcctcttgaaacctactttgcttacagcaaaatgggtataaggggatctttcacccaagccttttgtgaggactaaatgtggtaatggacattaagtgccagaccccttgaatgtgccatcttctctcagcttctataatgtcatgctgtcagttccctccttttctttttttcttttcttttcttttttttttttttttttgagacggagtcttgctctgtcccccaggctggagtgcagtggcacgatctcggctcactgcaagctccgcctcccgggttcacgccattctcctgcctcagccttccgagtagctgggactacaggcgtccgtcaccgcgcctggctaattgtttttgtatttttcttagagactgggtttcacagtggtctcgatctcctgacctcgtggtccgcccgcctcggcctcccaaagtgctgggattacaggtgtgagccaccgcgcccagcctagttccctccttttcatggcttctttgcttcatcttttctgtctcctttgaaggtatgccttcctggaatataccataaatgtcagtgttcctcaggattctatcttgacctgactcccccgacccaactgctagcttttccctctgtctaatgctggtacagatacataaactgataggtagattacaacacaattcgattttctgttttgcttttttttttggcttattattacataaactttttttcattgctgccatacattcttcaaaataaacacttcggggggcgagctggcccagcactttgggaggccaaggaggtggatcacttcaggtcaggagttcgagaccagcctgaccaacatggtgaaacccccatctctactaaaaatacaaaaattagccgggtgttggtgcaagcacctgtaatctcaactgctcgggaggctgaggcatgaaaatcacttgaacccgcgaggcagaggttgcagtgagccaatatagtaccactgtactccagcctgggcaacagagctgcgagaccttgtctcaaacaaaacaaaacaaaacaaaataaacacttcatggctgaacaatatgccatttcctgaatagattgtaatttacctaatcatttctctaatagtggacacttaggttgttctaattttgaaaggcaggaataccaagaatgttttcttgcacatggcagattatttctcagtataggctcatcctttcgagtatatggcatcttttcttctttccctcctctctctcctcagaagtactcaaggccccggagatactttggctgtatccccaccaatctcatcttgaattgtagctcccatgattcccatgtatcctgagagggacccagtgggaggtaattgaatcatgggggcaggtctttcccgtgctgttctagagatagtgaatgagtctcacaagatctgatggttttataaagggcggttcccctacacaagttctctcttgcctgccactttgctcctcatttgctctctgccatgactgtgagccctccccagccatatgcaactgtgagtcaattaaacctcttttcttaataaattacccagtctctggtatgtctgtattagcagtgtgagacagactaatacagcccttatgtgtccagaagtactgactttcttggatgataccttaagtaaagcctaataaagctttagtgactgatacatttttaaaaatgaagtaattatttatgtgtaatgagacaaattatttatttcagagtgttatttgccttactctcttcccccagcaaaaggagtcctcaagtggccagccacattttctcatttctcctttcttcaaaaactgatgggatcttgcttgatgaagtcacataacaagtgaatacagcaaagagagagggaagggggaggaaatagccgttgggaatggagtgttgttggatgagctttgtgaagtgtgggaagagaaagatactagaggagaccgagacaaatggataggtgaagaaacagaattttagtaagtggtgctgtatgctatatatgtggatttgcctcaaagttttaaaaaatggcaagcag

SEQ ID NO: 590 - DNA, 1518 bp, Homo sapiens
aacaacagaaattacccaatctgaacaacaaaaaaatacactggggaaaaaaaaagcgcaaagtctcaaggacccgtaggactataaaaaatgatgtcatggcactggagttctgcaaggagtgaagaaagagcagggcttaaaaagtattcacagaaatgacctccaaatatatcccaaatttaacaagctacatcaaccaggattcaagaagctgaacaagctccaaacaggataaaccccttcaaaaaacactctaagacaggttataattaaatttatgaaaactgaagaaaaaaatcttgaaagcagccagaaaaaaaaaaaaaaatgacaccttacccatagggggaaatcagtctgaataacaggagatttgtcattagaaacgatggaggctacctggaagtggcacaatattttttaaacgctgaaagaaaagaacagtccaccccagaaccctagactcagcaaaatgccaccttcaaaaataaaggagaaatgaagacattcttagatgaaggaacactgagaatctgtcatcagcagatttaccctaaaagaatggctaaaagaagttttctaaacagaggaaatgataaaaggaaccctgaagcctcatgaaggaagaaagaacacactgatttcctccatgtcttctatggaagattctgtccgtcccactggtttatggtttatggtggcgcctctccatatcagattatgctttcacgtgtcccaggtggatccagacagcctaggtgcaaatagtgtccctgtcacttagcagctatgtgatttggggcaagtgcctcgtttctttacatacaaaatgggacaatagcatctgcttcacggactgtcaggagataacatgagtttatgactgctcaggcctgcccagcacagggtaaatgcccatcaccgttgcctcttctctgttaggctagtcttatgctaagagccatgaaaatgttaatggggtggcttgtagttttgtattgataaggcaatctccattcattagggattgccttatcaatacgaaactactagctacccccatttttatttttctagaaatatagctattttcatctatttattattttatataaactctagaaccattttatcaagttaaaagtatcatttatgctttcaatatggtttgtgacacgtgaataagcaaatttggggtgaatgcacgtgtttaaaatattcagtcattccattcaagagcatggcatttcttttatcttaatatctcccagtaaaatttttttatttgtcctcatttctgcttcaaacttttctgattaggctggtagatgtaatggtgaaacagatgggttctaccaactctaccatgaactagctgtgtgatctactggcactgaagctattcaagtctcagtttcctgcctataaaatgacataggaggcactactgtatggattgctgtaaagcctattgatatatggttctaatcactacttaagcagaatagaggttac

SEQ ID NO: 591 - DNA, 3831 bp, Homo sapiens
gccccggcccgcatacaacgctgtctgcaccgctcccctgccttcttccgggctcccagagcaccgctatggagatgctctcccggcatttgaggaagaattgattgtcctcatcctgcaactgtacttgcccaaccgatatttattgatgcctgcagtgtcctgggtgcctaccaaggggcacagaactggatccgacgcagaccctgcctgccttcaggttgcttgaagatgaacagagagatcggacctctgcatttggcactaccaccatctggtctgtatgtaatcctttacagtttgcaaggcacttttacatccattatatttaatttgattcttacaaccaacttgtgagataggcaagatgtgaagtcgatattttatagacaaagcagctgaagcataataggagcttaactggtgggatccatttatccattttctcttccatggagcatcttgttgtattcatccaaatccttgacagaaatgttgaagaggacctctagaggctaagcttatcctgaattcttaaatagcactgactgttacagtttaagcaagtcagtttcacctaaaagtgtgattatccaacccacatgttgcctttctgttcaaaaaggatggtaccaaagacagtcacagtcacctggcttactgacataaatattaatactaatcaaatgagtaaaaagcccatgaggattggctgccacaaaaaattttcaacctgtatctaccaagaaactatcataccaactaaggaagccaagtctctctctctttcaaaaccctcacggggccatgctttattataatggtctgccacaggtcctaacccacactgtatttgattatatacagtctcataattaagtcattcctctttatcacacccagcacttagtccactgctgcccatgtaggaggcactcaaattggtaaaagagaaatctatgcaagggaatgatcttctggaccccctccaaaaacaaacttgtgactagaagaggcaccagccatagccacattcctactaacagggctgatttaaatgccctttttattggcttggtcatagtctccaacaggtgccaaggcttttgctagttaaaccagttttcattggatcattttgttttctatgtgtgttttgaccaaaaacaaagataggttctctaacaacagggagagaatatatgaaataggaatatgtctataaaacgacagtctaccagtaaggaaaataagtgatccataaaacaaaacatctgactgtaggtctacccaaagaaaggaaaaaggactaacaaacaagaatatagtgctttaccatttacaaatctttcacatacattctcatttgaccctcacaacaaccctgtgaggtaggcatcacggacattctactcattaaacagatgaagacagtaaatctcagagtagttcactgataatgcccaaggctctacagttagtgagtgatttgtattaatatcagtctttggcctaaaaattcagcacccctcttccccttatacttgtcccacctacttcacagggataatgaagataaaatgaattcaaggctagaaaaatactttgagggagaaaagcactatataattatacctacaaactatgattttccccaatatatggctcattcctcttctcatctcagcttgtgtgtgaacccagagttgtatattgcctctgtcctgtgctcagtaagcaaataaggcaggcagggggtacagtgtgatcctgtttaaagttacataaattacaatcagggtaactgctattattaggcaaattgaaaaacagcacagaaaggccagtgtgcaactaggacccactaaagctcagaggaaagcaatgcaagattatcagacaggcatgattgcatagaaggaaaatgtggtgtcagagttcaaactggcacacacacacacagttatctaaggcaaagtggtggcaaagaagttatttgttccatgtcacacaaacaagagcagaagattcatgggaacccgtacaaaagcatcttgtgtcacacagatctctccagctgcctatagggaatatacagaacagtgtcaccttcaaagaatgactgtacctgtgttcatatcctgaactgcaccaaggaatagctccatgctaaactgtcttggctaaaatacaaccagtgccatcattcctaatcagactaataaacagaatgtcttttaaggtaatgagttagatggctgtgtttaggttttgttcaggatttactttggattctcctgctttaagacccaaagaaagttatattgagtttttattgatgattctatgtgtttttaacagagtgtgataggtgaattaaacatattaaaagagttctatagcatctgttcagaaaagattatatactatacaaactattcaagtcatacaaaaccatttttcattgtctttcaaactgagaagaatcctattcagcacgcttctcctcctgaggtggttcatactgagcaagctatggggcaaagacagaggaatttaggtgaattttattctaaattgagtaaaaaatagtaaaacaaggtaactgttatattcaacttagttactgtcagtaaattgtattaatatcagtttctataactatccattttaaatcattcagtgatttaagatttaatacaatcaaatctaatgaaagccctttttatataaacctttaaaattgctttgaaactaaaatttcattccagttcatgactgcactgttcaaatacttgatatgcaataaactatatcttcccaaagattcatttgcttataaggaactttcttcctctccagcaaaagtttactgaaaatacccactgaaaagtagataaagagttaagtgacatgtcttaacttaaccagccaataaacaactactaatgtctttgagttaaaaggttccaaagagttaactagcactacacattgtggaatcttggataatttaaaataactgcattttcttttatgctaagtgtggttccttgcaagaacactaggctaacattagggttctgccaactacctgttggagttgagaagcttattagacttcactgtgctttcgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagttgactaatttgaagttcatgaaaattctcacaggactttgaaaaaagaaaaaactggctgggtgaggtggctcatgcctataatcccaacacttcgggaggccaggccaggaggaacgtttgagtcatgagtttgagaccagccagggcaacataatgggaccccatttctacaaaaagtttaaaaattagccgagcatggtggcaaatgcctgcagtcccagctactcaggaggcagaggtggggggattacttgagcctgggaagtcaaggctgcagtgagacatgactgcaccactgcacacaagcctgggtaacagagaacctgtctcaaaaaaagaaagaaaaaactttagcactagataaaattaagtcctaacaaatttacagagggccgctacatatggccttgcaaactatgaaccatacaaattctaagaagtgccatttacaaagcagtcgccccatattggcctacttaaaatcaactgcttaagaacctcagaactgaccatttacttataaagaacattaaccaatattctca

SEQ ID NO: 592 - DNA, 1560 bp, Homo sapiens
taaccagaggctgagatgggtgcatgtggggtgtgggggataggatcaaggaagagaggttggttaatggatacaaacacaattagatagaaggaataagttctaatgtttgaaagcagagtagggtgactatattgatcaagtttgaataggataaaaatatttttactttttttttttgcaatttacatgcaagattttttaaatgtgtttttaatataagcttctctctctgccaccaggcttattactctaggcagggagcaagcctgccgtgggaaggcaagggaatggcctcaatctgctctgtttcccttttttcgtgtgggtctactgctccccctacaacacagttgggtttgatagaagggggtgtggggaaggccacagccatgttggtagggaaggtaacgggcagggagagttcatctgcctgttatgttgggacttggtttagcaacccaaatacatatgtactactattagatttggtgcaaaattaattgcggtttttgccattacttttaaatcacaaaatagtctataatgcactttagcactggcaatgtgatattatgtatgtatacattggttggtccaagctacacccaagaatagtaaagaattcatattccaggatggtcagctagcatttatgagaaaggccaaactccaaaagcttgcttcccttatctttatctcccaacaacacccaactgattttgctaaattagcagagtgaatatgaaaatgagatgccattgatgaaattattaccttgtttaattagcataatggatgttaaaaacgggttctcatgtttaattgtttatattaaaggtatattacatgatgttttgatattgtggttttgattttcatttccctagtgactagcgatattgaccaaactaattactaccttttcaacatcggctactcaggaggctgaggctgaggtgggaggatcacctgagccagggagatcaaggctgcagtgagctgcgacggtgccacttcactcaggagcctggatgacagagtgagaccctgtctcaaaaaaaacaatcatccagcaggggctctaaaaccctgtaaatattctctccttggctcatcccttctgagaactggcaaagagctgctctcccttactgaagtgggtcttataaacttagctttgcttgatcaacaggttttcaaggaatccacagtggtattcaagacaagtgaatgcgaaaatgagagacaaaaacattgttcacacactctgttttgtaagcatgatacaaatctccactctctatactttaagcttcagaacaaagggcatgaacaattcttttgtctgagggctaataagtggatagcagaatttgatctgagaatcaacttcattttaacaattaacttggcagaaaggttacttctaagctttggcaattacctgttgctaccaaactaaacccactaattaaagcatacccaaattggcttaggtcagtctgcaaaacaaggtactgcccaggtcttgattccaaccgtagatgaatcacccaa

(The sequence listing continues in the following parts.)

The invention claimed is:

1. A method of detecting levels of expression of lncRNAs in a lncRNA signature, comprising:
    (a) isolating a biological sample from a subject, wherein the biological sample is selected from blood, plasma, and serum, and the subject is human;
    (b) detecting levels of expression of lncRNAs in a LncRNA signature in the biological sample from said subject, wherein the lncRNA signature comprises 13 lncRNAs of lnc-DLGS5-1:1, lnc-EBLN1-1:4, lnc-FAT1-7:2, lnc-PRR5-5:1, lnc-RBKS-6:1, lnc-FOXD4L5-35:1, lnc-TENM3-3:3, lnc-FAM133B-2:1, lnc-ZNF726-1:3, lnc-AP3M1-1:1, lnc-DUSP10-6:1, lnc-TPPP-1:2, and LINC01206:20.

2. A method for treating Alzheimer's disease, said method comprising:
    (i) performing the method of claim 1;
    (ii) diagnosing the human subject with Alzheimer's disease when the expression levels of each of the lncRNAs in the lncRNA signature are increased or decreased in comparison to reference expression levels of the lncRNAs in control samples obtained from healthy subjects; and
    (iii) administering a treatment to the human subject diagnosed with Alzheimer's disease, wherein the treatment is selected from cholinesterase inhibitors, NMDA receptor antagonists, beta-secretase inhibitors, anti-beta-amyloid monoclonal antibodies, modulators of kinases or phosphatases that regulate tau phosphorylation status and anti-tau antibodies.

3. The method of claim 2, wherein the treatment is selected from rivastigmine, galantamine, donepezil, and memantine.

\* \* \* \* \*